United States Patent 12,642,819 (COMPOSITIONS AND METHODS FOR TREATING INFLAMMATORY BOWEL DISEASE) - sequence listing, part 50

SEQ ID NO: 18 - DNA, 2246887 bp, Bifidobacterium adolescentis
  modified_base (464378)..(464472): a, c, t, g, unknown or other
  modified_base (465831)..(465927): a, c, t, g, unknown or other
  modified_base (1657049)..(1657146): a, c, t, g, unknown or other
cgactgcacgatctgccgtttgaacgcctcgtcgtagtggcggggatgtttcgggtcggccatcgtcggcctccaatcccacgtcattcgtccctcatcggagggtctaatacattgtagccaatccaatgatgccctcgacctggtgttcgaacatgaacgagaaggttctgcgttccacgtcttttctgccgtcggtatccaccaccagcagaattttcccattgcgccaggcttcgtcctgcgcgccttggatcacctggccggcgaagggcgatgtggccactccgtcgctgatgaagccgatgatgtcggagcagcctcgggccaatccgcgggcgagcgcgttgtgatggtggccgagttcgtcagcagccctgcgtaccttgcggtgtgtggattccgtgatccgcacgtcccggttgtcgttcaccgcccatgaggcggttgcgatggagacaccagccgcttcggccacgtcccgcaatgtcactttctccatgcccgcgtatcagccccgtccgacgcctagcgcatcaggttgcgcaggacgtactggagaatacctccgttgcggtagtagtccgcttcgcctggcgtatcgatgcgaacgacggcatcgaattcggtcgtggaaccgtccgcgtgggtggcggtgacgtggaccgtcttcggggtgacgcccttgttgagttcctcgacaccggagatgtcgtaggtttcggtgccgttcaggccgaggctctcatacgattcgccttcggggaactgcaatggcagcacgcccatgccgatgaggttggaacggtggatgcgttcgaagctttcggtgatgacggctttgacacccaacatgacggtgcccttggcggcccagtcacgggaggagccggtaccgtattccttgcctgcgagcacgacgagcggcacatcatggtcgatatagtcgcgagacgcttcgaagatcgtggtcggcttcttgtcgaggaagtcgtaggtgtagccaccaggggtgatttcctcgccgacggaggcgagcaactggttgcgcaggcggatgttgccaaacgtgccgcggaccatgacctcatggttgcctcgacgggaaccgtaggagttgaagttcttcggttcgacgccacggtcggtcaggtatttgcctgccgggctggaggccttgaacgcgcctgccggggagatgtggtcggtggtcacggagtcgccgagcagtgcgagcacgcgggcgccgtggatgtccttgaccggatccggggtggccttcatgccgtcgaagaaggtctgcttgcgcacgtaggtggagttctcatcccatgcgaacagttcgccttccggcacgtcaaggcccttccaacggcggtcgccttcgaacacggaggcgtaatccttgaggaacatctcgcggctgacggtgccatccaccactgcggcgacttcctcattggtaggccagatgtccttcaggtacacgtcgttgccgtcctggtccttgccgagcggctgggtttcgaaatcgaaatccatagtgccggcgagcgcgtaggcgatgacaagcggcggggacgcgaggtagttcatcttgacgtccgggctgatgcggccttcgaagttacggttgccggacagcacggaggtgacggtcaaatcgttggcgttgatggcctcggagatttccggcagcagcgggccggagttgccgatgcaggtggcgcagccgaagccgaccagctggtagccgagcgcgtcgagatcatcctgcaggccggcggccttcagatagtcggcgacgacctgggagcccggggcgagagacgtcttgacccacggcttgggcttcagtcccttggcatgcgcgttgcgggcgatcaggccggcggcgatcatgacggacgggttggaggtgttggtgcacgacgtgatggacgcgatcgccacgtcgccgttcttgatatcgaagtcgccacggaagtcagtggataccgcgatcggatcctgcacggtcttgtcggtttcgtacgccggcagcgtggcttcgaacttctctttcgattcggacagcctgatgcggtcctgcggacgcttcggtcccgcgatggaaggcacgacggtgccaaggtcgagttccaggtattcggagtactgcggttctacgtagtccggatcggtggcgtcgccccagagcttgttggctttcgcgtaggcttcgacgagagcgatctgttcttcggaacgaccggtcagacgcagatagtcgagggtgacgttgtcgatcgggaagatgccgcaggtggagccgaattccggtcccatgttgccgatggtggcgcggttggccagcggcacggaagcgatgccttcgccgtagaattccacgaatttgccgaccacaccgtgctggcggagcatgtcggtgatggtgaggaccacgtcggtggcggtgacgccttccggaatggaaccggtgagcttgaagccgacgacgcgcggcacgagcatggagatcggctggccgagcatggcggcttcggcttcgatgccgccgacgccccagccgagcacgcccagaccgttgacggtggtggtgtgcgaatcggtgcccacgcaggagtcgaggtaggcgaggtcgcgaccgcgctcccccgccttggtcatgacgactttggcgaggtattcgatattgacctggtggatgatgccggttcccggcggcaccacgcggaagttgcggaaggcctgctgtccccagcgcaggaactggtagcgttcgccgttgcgctggtattcgatgtccatgttctgttcgaccgcgtcggccacgccgtacttgtcgatctgcacggaatggtcgatgaccatgtcggactggacctgcgggttgatgacctccggatctccgccaagctccttgacggcgtcacgcatggtggcgaggtcgacgatgcacggcacgccggtgaagtcctgcatgaccacgcgggacggggtgaactggatctcgtggctcggctgtgcggccggatcccaatccaacagggccttgacatgatcatccgtgatgttggcgccatcgatgttgcgcaccaggttctcaacgagaaccttcaacgaatacgggagatgatcgatgcccggcaaatccgcgatgcggtaaaagtcgtaatccttgccgcccaccttcagggtgtcgagctggtcgtcgcgcacagacatgctacctccgagcttttgtggctggttgaaactgctttccagcagccgattatccgttgccaacgatacagccacgttacttcagcactggcgtgtcttcttgaaacgtgagaaaatggcgaccattttcggcacgcaccacaggcacagcacgaaaacgatggcggacaccacaagcgcgacgcccgtcgccgcgagcatttcgccggacggtatcacgagcgcgaagaaacgcgcgacgggcggaatgaacatgccggccacgcccgccacggcgaacgccaataccagaccgcctctccacgagttgagcggccgggccacgcgcgccagtacgaagatgcccatcatcagcaggataatcgcgttgacgccacgaagcatgcccagctgcgcggcggaatgctgtgcgtcccagcccatgaacttcggcaacagccacgaatcggcgagaatcgacagagccgtggcgatgcctcccggcaatgcgaagtgcaccacgcgcctgaggaagcccggaatgtagcggcgcgtgttcggcgcaagcgcgaggatgaacgccggcatgccgatggtgagtgcgccgatgtaggtgatatggcggggcaggtatgggaatgggatctgcgtcagcaccacgccgagcgagatcagcgcggaatatacggttttgacgaggaacaggctggccacgcgttccatgttggccatgacctggcgtccacgtgccaccacatcgggcagatgcgagaatttcgaatcgacgagcaccacttgtgcgacggctttggtggcgggtgccgcgttgcccatcgcgatgcccaggtcggcctccttgatggcgagcgcgtcgttcacgccgtcgccggtcatcgccacgacatgatcgcctaggtgcagcgcctggacgatcgccttcttctggtcgggcaggacacggccgagcacgtccacgttctccagtactttcgccagttccgtgatgtcggtgggcagttcgcgcgcgtccatgaagcgtggctccgcgtctccggtgagccgtacttttcttgcgatcgcaccgacggtgacgggattgtcgccggagatgatgcggcagcgcacgccctgctcgcggaaccaggcgagtgtggcttcggcgtcgtcgcgaatgtgctcggagcataataccagcgcgacgggccgcgatgcggggtcgatggcgggatcgctttcgtaatcggcgggcgccttgccgtcatgccgtgcgatcagcagcacgcggtttccgtcgtgtgcggaatcgttgaccagtcgaagaacgtcggcgtaatcgccatccaagtgggacagcacgacttccggcgcgcccatcgtccatgccgcgccgtcatcggcaatcgagctccatttgcgtgccgacgagaacggaacgcgcgccgcgacgggaccggcggagaatccctgcttgcccagtccgttgagaatcgccaatccggtgccgttcggctgtccttcgttcgacaggtcgtacaacgcctgtttcacggcatgttcgtcaacggtattggctccgatgccatccagcatgcgtatttcgttgagcatgatgccgccgtcggtgacggtgccggttttgtcgaggttcaggcagtccacgcgtgcgagggtctccacggattcgagctcctgcacgagcgtgttcttgcgtgccaaacggatggcggcgagcgcgaagttgagcgaggtgagcagtacgaggccttcggggatcatgccgaccacgccagccacggcggacaccacggcggaacgccattggccggtggagacggctacatcccaaccgccgaccgcgtgcacctgcgaccagatgagcagcacgcacagcggtacgacgaggaaggtcatgaatttgaggatggtgttgatgcccttgttgaggtcggacacggtctttttgtagaccttcgcctgcgcggtcaaggtggcggcatagctgtgcgcgccgaccgcgttgaccttgaccaaggccatgccggagaccgcggtggatccggaatagatgtcgtcgccttcgttcttgcgcacggtgcgcgattcgccagtgagcatggattcgtcgagttccagaccccaggtgcgcacgatctgcgcgtcggcgggaacctgttcgccggagcggatccacatgaggtcgccgagcacgatttcgttgtgcggcacttcgacgtccttgccgtcgcgtcgtacgagatagtcggaggctacgaggatggaaagcttgtcgagcgttcgtttggctttcagttcggtgatgatgccgatgccggtgttgatgaggatgacgaggccgaacacggcgtctctccatgatcccgtgaccaataccatgaccatggcggcgaagatgatgccgttgaacagggtgaacacgttggctcgcacgatgtcggcgaacgaacgtgacgtggacgatttgacggcgttgacctgcccgctttccgtaagggcggcgacttccgctgcggtgagccccttttcactggtttcaggcatggtttgactttcgctcatgctgccagcataccgcttggcgatgcgcgcccgcaggcttttcccgtaaagctccggcaaaattcagggttttctcagggtgcgttcagcgccacgcatccgaaccgattcgaactcacccgaatgcgtggagcggttcactgtttgccgccgtggctgatggtggtgacgaggattgctctgtcgtgcgggtcgttgttggctatgccggctaccgcgtcggcgagcggcgtcgcatccgtcatgcggtcgttgattgtgagcgtcgccgcgaacagcgtgctgtcggtcggcgtggcgatcgggttgagcagtgccactggaatgcccgcctgtcttgcggttgtcagcgtgtcgtaccagccgtcatggttcacgccggacacgtcgattcccgaaatgacgatgatgctgaccatgcgttgcgccatatcctcgaccgcttgccgggcggtgtcctgcatgtcgaccgtgccggcgaccggcagatacaccggcctgagcccgcccgcctccatggcatccaacgccaggcgatcggtctgttcgtcttgggagccgatcatggccacgtcgagactgttgcggtccttcatgctgtgggcgaccgcatcgcctgcggactgcgtatctcccaccgcggcattgttcggcgtgcagccggccagcatggagataccgaagacggctgcaaggagaccggctgcggcacgccgcgcgaaaccggtcatcgtgtggctttcctgaatagcgccaccgtttcgacatggtgggtggtcggatagatgtcgaatgcgcgaatatcagcaagatcgtatccgagcgaggccaatgtggcggtgtcgcgtgccagcgatgccgggtcacaggcgatgtatacgacgcttcgcgcgccggattcggcgatctgcctgcataccttcgcacgtgcgccggcacgcggcggatcaagcaccacgatatcgggtttggccaaatcgttgcgtacgttggcaagcgtcttggccacatcgcccacacgggcgtcgacattgcccaaatggatggccctcagattgcgctgcgcgtgtttgacagcggtcttgccaccttccacgctcagcatgcgcgtgcggccagcgcttaacgtggccaacggcagcgtgaacaggccggaaccggaatacaaatcccacaggcatgcggaagcggcgccgtcaagctcgccatgcaccaaggacatcacatggccggtcaacgcgatcggcgcgtgacggtgcatctgccagaatccgccggcgtccacaccgtattcgaattcacgtccgcacaccgtcaccttttcggtaagctcgcgattgcccgccgtcacttcgccatcgacgagcacggcgtagttgtcggcgatttcggcattgccgcgaggctcgggaacagacagacgaatctgcgatccgggagtgaatcccccatcccacacgtgttccttctcggccacgttaagcaacgcgcgactggccaacggcatggtgtcgatcggcacacgcacgtgggtgccgcgtctgcgcatggacggtcggccgttatcgtccgcgatcatctcgatgcgggtacgccagtgcagcccctgctccgcctcatcctcgggcatgcgctcgatcggcacgtcaacgtcgacatggccgagacgtctcatctgttcggcgatggacatggatttccatttaagctgtccgggcagtgagacgtgcaccaaatcggcaccgccgacgccgccgcccatggcgagcggacccgccaacggccatacgggttcgacgcggtcctcgctggcttccagcacttccgtcacttcgccagtccaaaaacggtcctcgcgatcatgtggctcgtccaacacgacgcgtaccagctcgcccggcaacgcgaatcgcacgaacacgacgcgtccgtcgatgtggccgacgcaacggccttggtcggcgtatcgttcgatgcggatggtcgattccatcagtgctgttcctccgtttcgttgttgtcgtccatcgcgtcggcgtttggttcggccaacgtcttatgccgatgcatgggggtggccacgatgaggtacgacacccagatggccaacgcccagaacggaatgcccatgagcagacgtgcagtgccgagccagccgacctggttggacaggtacaacggcacctgcaccaccagtcgtagggagaacacgccgatccacaacgcggtgatgatggtgtacgcgcggttcaatgccttgtcgccacgccaatcggcaagccatgcgcgcagatgctcggttggcagtgtccggatgaattcgatcaccaagccaagtcccggtacacgtaccatcaacgaaatggcgagcagcacgatgtagaaggcgttggtcaggaatccgaacatgtagtagttgcgcgcctcgtggctgttccatgcccagatcaggcagatgccgactgccagaaggccggagacggcgcccatgacggattggcgttggcataggcggacgatcacctgcagtacggcgagggatgcggatacgccgatggtcagatgcaggtcggaggtgatgacgaacatcaccacgaacaccacgcccggcagcatcgattcgacgacgccgcgcggaccgccgatcgcgtcgatgacggagaaatcgtcggcatcgccggcgtcggcgagcgcgccgaggccggttcttttcttggtttcggtttcagccatgcgtttgtgttttcgtggtcgtcgttcgctcagcgcacttcggagaacatcggtccacgcgacaacgtggtcttgacctcgacctgctggtcggagtcaaacggtcccttcggctggcctggaatgtccatcgtcctgcctgcctgttcggcttcggcggcttccttggcggccttgcgttcggccggggcgaccggcggatgcatcgggatgaggtcacgcggggccagcgggtcctcgccgcgttccacgacgatgttggagaaaagctggttcagcgccttggtttcggcgtggtccggatcggtggcggctttgccggagaagatgccgcgcagcatccaccgcggtccgtccacaccgacgatgcgggtgacgaccttgcgtccgcccttgaccacgaccggcagtgtcagttcggtgccgaacacgccgtcggtctccttggcgtctttgttggcctcaaccaggtcggcgcgcacgtcatcccacagtcccatggtcttcggcgcggcgaaggcttcgatctccacgctggaggatccgtaggtgatggtggtgccgagcacctgctgggtggcgcggttggccttcacgcgcagttcgatgccttggaggaacggcagatagtaggcgcccatgtcgaggtattcgtcatagtcgggcacgttctcgtcgtcgacgtcccacggaccgtgctcatcgccacggccgtcgtactcatcggatggttccggaaggatggtttcctgaattccaccggcgggcgcctcagcggtttcggagatggcctcatcggccttgtcgttctcttcggcggcggcttcagcggcttcctcgctctgacgcttcttcttgccgaatccaaacagtcccatgatgttcctcatttcattacggttgcaaccgtgactagcctagcacccatgcttaatacgggctgggaatcggagtgtgtctcccgttgcccggcattggccggatgacggccgcaaaaactcacacgtcgtaggtgatgctcagcggcgcatgatccgaccatcgcaggtcgtaggtcggagctttgtcgatgacgaatccgcgggccgtttcggcgagttcgggtgtggcgaactggtagtcgatcctccagccgacgttgttgtcgaaggcgcggccccgctggctccaccaggtgtacggtccttggatgtctccgcacagggaacgcatcacatccacgaattccaactcccccagccatttgtccacgtaggcgcgttcctcgggcaggaagccggcgtgcttctcgttggctttcgcgttcttgatgtcgagcggcgtgtgcgcgatgttgaaatcgccgcacaataccgcctgcttgccgccgtgcgccgcttcatcgcgcagttgccccatacgtaccagcatggtgtcgaggaaacggtatttctgcttcattttctccggatcgtcggtgttgccggcgtgcacgtacacgcatacgacagtgacggtgtacccttgcggggtcttcacatccgcttcgatccaacggccggaatcgacgtcctcggcaagtcccggcagtccgtagcgtttgtcgatgacgggcagcgcggagagcagaccgacgccggcgcgtcccttgatacggcagatctcgttcatgcgatcaagcccgctttggtcggcgatgcgtccggcggtcgcgtattcgaagccgaattcgtcgaagatggggtcgatttcgttttgcggggcgcgtacttcctgcatgcaccacacgtccggcgtgttcttcgcggcccattgctcgatgcctttgcgtttcgccgcgcggattccattcacattcgatgtcgtgattgtgatcgtcatagcgccttagcctagccggaatacaagaaaacctcccttgtgggaagggaggttttccagatggctgacgcgatcagtcgagtccgagctgcagcttgccgcctgggatggcgtccagcaggtcgcgggtgtactgcttcttcggatggtcgaagacctcgtcggtggtggcatgctccaccagcttgccgtgctgcatcaccacgacctcatcggcgatctgacgcaccaccgccagatcatgggtgatgaacaggtagctcagtcccttttccgcctgcaggtcgttgagcaggcgaagcacctggtcctgcaccagcacgtccaatgcggagacggcctcgtcgcagacgatcatatccggatcgagggccatggcgcgcgcgatggcgatgcgctgcctttggccgccggaaagctcgttcggataacggctcatcaccgattccggcagttccaccatgtcgatgagctcgcgcacacgcttggcacggctcttcttgtctccgatgccgtggatgcgcagcggctcctcgatggaccggtagatggagtacatggggtcgagcgatccgtacgggttctggaacaccggctgcacatgacgtcggaagtcaagcagctccttgcccttgaatccggagatgtctttgccgtcgtaggtgacggtgccggcggtcggctcaagcagtttcagcaccatgttggccacggtggatttgccggaaccggattcgccgacgatggccaatgtggtgcccttcttgatggagaagctcacatcgtcgaccgccttgaacatctccttcttgcgcggcagcttgaattccttggtcaggtgatccaccgtgatgatggcttcgcccttcttcagggaatcctcgttcaccgcgtgctccatgaccgcggtggcgtcgccgccatgttccttgacggagatgatgcgctgcgatgccaaggacggcgcagcggcgaccaaacgcttggtgtacggatgctgcggatgctgcagcacttccagtgaaggaccggattccacgacctggcccttgtacatgaccacgatatgctgggcgcgttccgcggccagaccgagatcgtgggtgatgaacagcaccgcggttcccagggaatcggtcagcatgtgcagatggtcgaggatcttcttctgcacggtcacgtcgagcgcggaggtcggctcgtcggcgatgagcagttccggacggcaggccagaccgatggcgatcagcgcacgctgacgcatgccgccggagaattcgtgcgggaactggcgggcacgggtggcggcgtcaggcagaccggcctcggacagcagaccggcgatgcggtcgcccatggtggagccgaccacatacttcttggcgatgtaccatgcgtcatcgtccttcaccccggctttgatcaggccatcggccacacgccagcgggtttcggatcccggaacccattcctcggcgaaccgggccatgatcttgtcaagctcgtcaccgctcttgccgatcttgacaagagcctccttggccgcggcgatcagatcaggcagttccttggaaccaaggaaggtctcatcgtcattgcccttgagctccacttcgtcaccggccagggccttggcgaatttggaacgcttttcgtggtcgatgtccatgttgttggccaccaacgcttccttgacctgggtgccgatgcgccacaccgggttcaggttgctcatcggatcctgcgggacaagacccatcttgctaccacggagcttgtcgaaatccttctgcttgaagccggagatctcctggccatcaagcttgatggagccgccgaccacatggccggttcccggaagcaggccaagcacggccatggcggaagtggatttgccggaaccggattcgccgacgatggccacccactggccgggatacacgctgaaggacgagttgcgcacggcatgcacggccttgccttcatcggtggtgaagtcgacctggaggttcttgacctccaacagcggcccgtgggcgcgctgcatggcctcgaggttgttctcggtattcatttcagtcatcgaatatcccttcacttacactcaggccgtacggctcttcggatcgagcgcgtccttgacggcgtcgcccatcatgatgaatgccagcacggtgatggccagcgcggcggacgggtagaacagcaccatcgggtcagtacgcaggatggactgcgcgttggagatgtctccgccccagctgaccgtggtggtgggcaggccgacgcccaggaagctcagcgtggcctcgagcacgatgtaggtggccagcgaggtggtgccgaccacgatgatcggagccagcgaattcggcaggatgtggcggaacaggttgcggatcggggtggatcccagagcggtggacgccgtgttgaattcaaggttcttggcttccatcacagcacctcgcgcgattcgtgacacggaggtccagccgaacagcgtcatcaccagaatgatcttccagatggagctgctcgttttgaacatctggagcaccacgatggcgccaagcagaatcggcagcgcgaggaagatatcggtcagtcggctcagcacggcgtcgacccatcctccgaagaagccggcgattgcgccgatcagcgttccgagcagcaccaccagcagtgtggcgaacacgccgacgctcagcgaggtgcgggtgccgtagaccacacgggagtatacgtcgcaaccttgcaggtcgaagccgaacggatggcctgaggaagccggctcaagggaattgtcgagcgtgcagtagttcgggttctgcttggtcaacacgctcgggaacagcgccacgaacacgatgaagatgatcagcagtccggagatgatgaacagcgggttcttacgcagggttcgccatgcgtcggcccacatgttcgaagccggtgcggattcgtccatcgagtcgacggccttcaggggcgtctcatcgagcggtgccacatagcgttcctgtcccggaagcacggtggaaggattggtctcattcatttcggtcatttcttgttccctccctcgactcacgcgtaacggattcgcggatcaagcgcggcgtacagcatgtcgaccagcagattgcaaaccacgaagatcagcatgagcagcgtcacgatggacaccaccaggttgccttctcccttgaggatgctctgataggtcaggtagccgatgccatgcacgttgaagatggtttcggagatcatcgcgccgcccatcagtgcgccaagatcctggcccagataggtgacgacggggatcatggagttgcgcagcacgtggcgcagcatgacggatttgttgtccatgcccttggcgcgcgcggtgcgcacatagtcgagggcgatgttggacgaaatctccgtacggctcagacggatgatgtacgccatcgatacagagccaagcaccatggccggcatcagcagatcaaggaatcctggattcgctccggcggtgaccggcagcagatgccacttcacaccgaggaagtactggcagaggaagccggtgacgaaggtcggcacggagatgagcagcagggagaagatcaggatgacggtatcgcaccacttgcccttcttcaggccggagatcacaccgaagatcacgccgaaaaccgcttcgaacacgaaggccatcagggcgagcttgatggtcacggggaaggcgcggccgatcacgtcgatgacaagctgtccggagaaggtcttgccgaagtcgagggtcagcgcgttcttcaggaacagcagatactggacgatgaacggcttgtccagattgtattcggcacggatctgggccgcgaccgcttcgttgaccggcttgtcgccgaacatcgccttgaccggttcgcccggcaacgcgaacaccagggcatacaccagaagcgtcgtgccgagaaccacaggaatcatctgcagaatgcgtcgcagaagatacttgcccattggtttctccttttgattactcactcgttcgccagccgtttgcggcttcgtcccctacgctcacgcgtataggacatgaggcccggggcggctggcgcttgccccgttacgtatcagtgatactgcaccacaatgctttatattgcagtttcatgaaagacagctgaaaatataccccacgcgcggacatcttctgttgatgtcgcatgtccagccgtcatggacctccgatggaagccccgtttattacgcggaaaggaaggaacggatattcgaatccgttccttccttcatgtcgatcctacgaaatcaaaatcagagaacggctcacttgccggacttggtcatgttctcgtagaccggcaggttctgccagttcatctcgaagccggagacacctgtcgaggccacaccataggcattggcgtagtacagcggaacggccggcaggtcgttgagcagcacttcctgtgcctgctggtacagcttgttggcgtctgcgacggacttggaggcagcggccttgtcgcacagcgcatcgaactccgggttcttgtagtcgccatcgttggagccgttgccatcggcagcggcggaggcgaagttctgcaccaggtagttttcggcggacgggtaatccggctgccagccgctacggaacgcgccgttcaccttgcggtcggacacggcggtgcggaaatcgttgaaggtcgggtacgggttggtggcggccacgccggcgcccagcacgttgttgatggagttgaccacggcggtgtagatgacttcgtggccaccatcggcgttgtaggcgaaggtgaacttgtcatcggaggtccacgggctgatggcgttggccttcgcccacagttccttggccttcttctcgttgtacttcaggttgccggagcccttgagggaatcggagtagcccggggtcagcggggaggtgaagtcggcggccggggtgccggtgccgttgagcaccttcttgcagatgttctcgcggttgatggccatggagacggcctggcgacgcagggtgccttcctcggtgtcggcctcgaagtgcttcagcttggccgggatggtgaactgctggatgacggagccggccttgttgtaggcctgtacggtggagtccttctggaaggtcttggtggcggaggccgggacggactccatcacgtcgagggaaccggactggatgtcggcgtaggcggcctcatccttggtgtagaccttgaaggtcacgccgtcgttcttggcgacgcggttgcccttgtagtcggggttcttcaccagcacgatctggttgtcgtggtcccaggactggaacttgtacgggccgttgccgaccggcttctcgccgaaggccttcggatccttgaagaaggattccggcagcggagcgaatgcggtgtagccgaccttgacggcgaacacggagtcggaacggttcaggtcgacggtgaactcatggtcgttgacgaccttcaggccctcgagctgttcgtcgcccttgagcttgtctccatcctggagcttgtcgtagcccttgatggtggagaagaaggaggagccgagctgtgcgttcttggcgttggccgtgtagctccatgccttggtgaaggattcggcggtcaccggggtgccgtcggtgaacttccaaccatccttgagcttgatggtgtactgggtggcgtcatcgttggacttgatggactccgccacttcgttggaggcgttgcccttggcgtcgaaggaaatcagacgtgcgaacagcaggtcgagcggcttgccgccgccggtctcgttgcagtcgcccgggatgagcgggttctgcggttcggaattgtatgcggtgatgacgttggaacccttgtcagcggtggagtcaccgttggaagagccgcaaccgctgagcagcatgccgaatgcgcatgcggccgcagcgaaagccagagctttcttcttcatggaattcatattctccttatccattatttccagagccgtaagaccctgctcaaaaagaaggcgggcgtcaataccgtggcatcaacgtccgtcttcgttctgatggtaggttcattatcactcgattgagggacaaccgctccatatccgagggaggcccatgcaaaatagccaaatcaaaactcatcatctgataaaacaatccgtttttccctcttatcgccggaacaacttatccgcatcgtgcgtatggacggacgcggacatatccgttcgccgtcagcgtactttgccaatccgcgtcacgcccgtggaaacgcctgcccgtatcgtgccttcaactgttcgatggacacgtgtgtgtaacgctgtgtggtcttcagcgaggaatgccccagcatctcctgcacctcacgcaggtccgctcccccgtcgagcatatgggtcgccgcactgtggcgcaacgcatgcggactgatgtctggcacgccggcctcccgtgcccggtcgtgcaccaccttgcgcaccatacgttgaccgatccgcccgccctgcgatcccaaaaagaacgcgtcgtccgacatgtcaccgcatagtacgggacggccatgttccagccaatcgcgcaaggccttgtcggctggtgcgccgaatggcatgacacgctgcttgtcgcctttgccggtcactttcaccgtgcggttgccgaatgtcacgtcggccacgtcgagtccgaccagttccgccacacgcatgccggtggcatagagcagttccagcatggccgcgtcacgcagcgcgatcgcctgttttttcatattcggttcctgcgatcgcgcctccatgccgtcctcatcaacgcggtccatcagctgctgcgcctgcgtttcgttcaataccgccggcagcgtatcggggattttcggcgtctgcaacgaagccgccgggttggcggacgccatgtcatggtcgtacgcccatgcgaagaatccacgcacggcgacggttttgcgcgccatgctgctgcgtgcgtgatttttggacgatttggccatccacaggcgcaaatcctcgatggtcacctcattcagatccacgcaaccctgtttccgcaacgccaccaagcattcctcgacatcgctgcggtacgccctgcgggtgtttgcgctcaaccctcggttggctttcagataggcgtcgaatccgtccaacgcatcatcgaaacacatgcaaaccaccttccgcttcgtctgaaatgaacagacaccacgcagacaccgtataaatgccattccgcagcgcgatcgaatgtcatctcacgcgatggcacgattccattatgtccccataccgatagactgatgacgattaggcatcttacgaacaggcggtattatgactcgtcattccattcatgacgtacagcatccgacagccgaaaaccccgatgatgggattgtggcccgcgccatcgacctgaccaaggtctacggctcaaaagacaacgaagtgatggcgttggatcatgtgaatgtggaattcaagcgcggtgaaatgaccgccatcatgggcccttccggttccggcaagtccacgctcatgcattgcatggccgggctcgacaccccttcgtccggcaaggtgatcgtggagggactcgaggtctcctccatgaaccagaagcagttgacggacctgcgccgcgagcagattggcttcatcttccaatcgttcaatctggtgccgacgctgtccgccgaagaaaacatcctgctgccgttgcagatcgcgaaacgtccgatcgaccgcgaatggttcaaccaggtggtcaaggtggtcggtctcgaaaagcgtcttacccaccgtccaagccagctgtccggcggccagcagcagcgtgtggcctgcgcccgcgccatcatggcacgtccgtccgtgatcttcgccgacgagccgaccggcaacctcgactcgcgctccagccgtgaggtgcttggcttcctgcgtgattcggtacgcgactacggccagtcgatcgtcatggtcacccacgatccgcgtgcggcctccttcgcggaccgtgtgctggtgctcgccgacggcaacatcacccgcgacatgcagcatccgacgtacaacgagattcttgaggtgttcgccggcgacgacgatatcgacgacgttcctgcagccgacatggtcgcgccgtccaccgcaacggagggcgcacaggcatgattcgcataggattgcgcgacgcgcgcagccatttcggccgtttcatcatgtcgatcgtggccatcgcgctcggcgtgagtttcgtggtcggctcgttctgtttccgcgaaatgctcaacaaccaggtttcacagatgatgtccaccaatgcggaccatgacgtgtacgtgcgcggttcgcaggagaagaaaaaagattcgtcggcgatgtcgatgggatcgacgaaaagctacaacgatgtcgacgtcgatctggcgggcacgatagccaaggtcgacggtgtttcctcggcacgcgtcgtgcacatgctgttcggcgtggtgctgctcgacaagcatggcgatgcggtgaccaccatggggtctccgacgctcgccataggcatgggcaagccgtcgccgtggcggtccgccaagttcacgaccggcacgtggccgaagaacggcgatgagatcgcccttcattccttcgccgccgaacagtcgggtctgaaggtcggcgataagacgaaaatcgtctatccggacggcgctcataaggtgaccgtcagcggcatcttcaccaccgatgccagccaggcaggcgccatcatcatcgccatcgatcccgtaacggccaaggaaaaagccagcaagcagtcggacgatcccgacaagacgtcgctgatcagcgtttacggcaataagaccatgccgcttgacgacaacgcgcagcagcagctggcggaccgtatcaacaaggcgctgccgagatcggcgaaggcgcatgccatcaccggtgacgaataccgtgacgaatcaaccaaatccacgcaggacgcgctcggcttcatccaaccgcttattctgattttcgcggtgatcgcattgtttgtcggctcgttcatcatcgccaacacgttctccatgatcgtgcgcgagtcgatgcgcggctatgcgctgctgcgttccatcggcgcttctcccctgcaagtgttctccacggtgatcgtgcaagctctgttgctgggcctggtaggttcgctcgcaggcatcgggctcggctggggcatggtcaaactcatcgcatccggtttggcgaatatgggtatgccattgaccggcgccaccaatccgaccgtttccgacatgctcgtcggccttgtggtcggcattgtggtgacgttgatcggtgcggccctgccggcgcgaaatgcggcgcttgccccgccgattcaggcgatgaacgaaaccgtcaatccggaaaagtctgtcctcgcacgtggcatcctcggcaccgtcatggtgctgttgggcttcctgagctggggtttcacctacgctttggccgccgcggatggtgacggcggtccgacgccgtggaaggcgctcaacagtatcgctgtcggctggccgctcggtattggcgcggcgctggccgtgatcggcgtgattgtggctggaccggcatacgtgtccaccgcgggcgcggtgctcggctggctgccatcgaaggtcttcaccgtgaccgggcgtctcgcgcaacgtaacatttctcgttcgaaacgtcgcacgtccaacaccgcagccgccctgttcgtgggagtggcgattgtcagctgtctgggcgtggtggccacgtcggcgaaggcttcggtcaattcgctggtggataccgggctcaaagccgatttcgccgtatcttcggcttcggccgggcagattcccgaccaggccatcaaagacatcaaaaaggtcgatggcgtgaatcatgtggtgtcgaaccgtgtggtgcttggtgtgaaatatgacggcaaagccatcaacgggttcacgttcgccacacagccggagctgttcaccaagatcttcgccgccgaaaccaccgaaggtgatgccgctgccgcgttgaaggatggcaagctgctcgtcggcaagaccattgccgacgatcgtggatggcatgtgggtcagaaggtcaaggccacggccgagaacatcgtggtagacaaggaggtcacagccaaggcgcaggccgattaccaggccaaggtgcaggcgcatgtgcaggaattgcagtcgcaggcccagcaattggccgcatccggcgacttggcaggagcgcaggccaaggcttcggaaatcgaacagtacacgaacgacgccaagaacgtcgatccgaaaacgctggtcaagacgaagaaggtcaccaccggaaagacgctgaccatcggcgcgatcgtgtcgaattccgtataccgcgatttcgcgatcgtcaacgacgatttggccgagcagatcggcaacaagcagaccatgttcgtcatgcaggcgttcgtcacggacaagcggggcgccgacacggcccaagtcaagaaggccctgaagaaaacaatcaagaaatactacacaatcgtcgtgttcgatcgtgacgagtacaagtccacgatgagttcgatgatcgatcagatgctcatggtcctgtacgcgttgctggcgttgtccatcatcatcgccattttcggcatcgtgaacacgctggcgttgagcgtgtcggaacgcaccaaggagattggtctgctccgtgccatcggcacgtcacgtggccaggtgcgtggcatgcttggcatcgaagcggcgatcatctccgtgttcggcacggtgttgggtttggtcgtcggcgtcgccgcgggagtggtgattcgtgcggtctacgcgtccgaaggtttggagacgctggcgattccgtggttgcagctgctcgtgttcctgctgctgtcgattgtggtcggtctggtgtccagcatctcccccgcctcccgcgcgttgaagcagccggtccttgacgccgtggcgagcgagtgagacagttggagcggaacatcgaaaggaggcagcaatgcctattcccaatgagattccagtaggagcgcgcatcgtggtgcgcaccttggaaggcgtcgatcctaccgatcatcgtatgaagttccgcgattacgtaggccacgtgcgttcgtgggacggtcagaaactggagatgacgcgcgatgcggcggcgaacggctcacgtcccgagcagcgtgtcacgattcccgccgacgaaatcgtgacgatcaagccggtgccggaacgttccatgactcggccacgtccgtagtcgcatacctccccctaccgcgcgcaaagacaagagcgccgcaatcgcactgattttctgcgattgcggcgcttttgcatagcgatggcgtcagtcgtcagaccacggaacgcgcctgcgcgatcgcggtacgctcgccgtcgaatcgcacgatatgctcgcctctgcgggcggattccagcagcgtgcgctgccaatcgttttcgggaatcgacagttcggccgtcgcgcaatgttcggcgtactccggctgcctgctggcggccttgtagtcgcggaacggttggccttgggtgaagaaacggtccatttgcttcacgtcgccttccgtggggcgcacgccggtatcggccatgtcgtgcagcacgttggccaccaacgtcaatcggttggccatgttgcgtagcagggtctccacgttggccgcgtcctcctccaccatggcacgtgtgcggttcggatcggtcagcgccacgcgcgtcatgtcacgccaggacccggctgcgagcgcggccgcgatgttgcggttcgggttggccaccagctcgttgatcatggcggtggcgatgacgtgaggcatatgtgagatgagcgcggcgcaacggtcatgggtggcgtcgtcaagtacgatgagccggttgccgcaacggttcacgatcatgtcggccacggcgcggaaccggcggtattcggtgtgttcgtcgacggtgatggcccagagcgcgtcgtcatagagtgtcgggtcggatgcctcccagccggacagttcgtttccggccatcgggtgtgctccgacgtagcagccgtcaagaccaatggctttgacttggtcgcggaccatgcctttgacgctgcccacgtcggtgagcgtggttgtttccgtgtcgatcaatggtttcaatgcgccgaggatttcgggcatggccttgagcgggttgcacagtacgagcacgttcggtttggtttcggcgagtgccgccaaggtgggtttgcagatgatgccgtcggcttcggcggtggcgtaggggcggtcgttgtggttccatgcggtcacttcgcagccggcgttgacgagtcggcgtgccagtgatcctccgatgaggccgagtcctacgattgcgatgcgtggcttcaccacatcagctcccttctgacggtttcgtcgttctgccaatcgtccggcaggtggctgtcgtcgagtcgtacgccgccttgcggcagcatccatgaggtgacgggcgggttggggcgttccctgcgagggtagacggcgagtgttttggcccagtcgccatgttctgcgatttccacaagcgcgtcgcggaaacgttcctcccaaggggcggcgtcgagggtgacgatgaagctgtatgtgccggtgcgtcctttgatgggccgtgagatgaagctggtcatgttcagtcccgcgtcacggaacacgtcgagcaggttggcgagcacgcctgggccggtgacgagcgggatgagcgtcaataccgattcgtattcgacgttagcttcggcgcgtggtttggcgagcagccgtgcgacttcggcgcgtggcgcgagcacgaggaagtcggtggcggctccttggtagtcctggatggcggtgccgatgcgggtgatgtcgtacagttcgccgcagatggcgggaccgaaggcgatttcacctgggataaggtcccggcaggccgccgcgttggatgtggccggctgtgtggagagccgatgttcggcgatgaatcgtttgcattgcgcgagaccgtgcggatgggctgtggcgatgcgcgcttcggctggatcggctccttgcgccacgtaggcgtcgaattcgacgttcacaccgacgcgtgcgaatccgacaaggtccttcgcgtcgatcagcgcgtcgaggttgggcaccacgtacccttcgacgttgttctcccaggccacgattccccagccgtcgccgtgctgtgcggcgtcgagaatctgcggcacatcgtccatgggcatcaggtcgaagccttgcggttcgagccgtgccaactcttgggcggcattgacggccgcctgatgggtgaaggtgccttgtggccccagatagaacagcttgcgtgcgctcattgccgcctgtgcctccttgttgcgggtcatcctaagcaccttagcgcattcgcgaggctgtggaggggtctagtccaccggttgggcggtgtcatggtccggttcagacgattcgttctggtcatattccgtggagtcatcctcagtgcgcggcggcatcgtgaaccagcttttgggcagcgccagcatgatcaatggaatcagcaccacgccgtatagccagaaatagccggcgttgttgctgaaatacggcaacgtcgccgtctcgccgaatccgacgggaatcatggcgtccccgcccggaccgtaaccggccatgacggtccagaccaccagtgatgaactgatcagatgcaatgcgaggcccgacacgccatcacgtgaacgcgccgaccatgtcgagatgatgaccagagcatatgcgatcacaagaccgtagggaatattcgccgacgcgcccatgcggtgcgccatcgtgccgatcacgccgacgacggcaccggcgagcaggtcaaccaaaaaccgcgcccataccggtagacgatgcgaccacggcagcagcctgcggtcgatgccgtcctgtgactgcgattgcggttccggctgtgtttcctgcgtgcgttgcgtcatgtcctccactatgccctacgttccttacaaaacagcaagaaaggcaagagatacgcggaaaaccgccgacatctcttgcctttcttaagcgtttagcgcactagcggaacacactaccgtgcccgcgaagcgccaaaacaacgcgaagaatcacttgttattctgagcgttgttctggcgacgctgcttggcgcgccacttgtaccaatcctcacggctcagaatgatcttgcgcacgcggatggactccggagtgacttccacgcactcgtcctcgttggcgaagtccagggactcttcgaggctcatcttgatcggcggggtcagggtttccagcacgtccgcggtggcggaacgcatgttggtcatgtgcttggccagcgtgatgttcacatccagctcgtccggcttgttgttgatgccgacgacctggccctcgtacaccggggactgcggctcgacgaagaagttgccacgtgcctgcagacgctgcatggcgtacggagtggcgacgccctgacggtcacagaccatggagccgttctggcgggtcacgatctggccggcccacggagcgtagccagcggagatggaggaggcgatgccggtgccgcgggtggcggacagcagcgcggtgcggaaaccgatcagaccacgggacggcacagtgaactgcagacggacccagccggtgccgtggttggtcatgttgtccatgcggcccttgcggtcggcgagcagctgggtgacggcgcccatgtactcttccggcacgtcgatggtggtgttttccatcggctcgttgaccacgccgtcgatggtcttggtgaccacctgcggacggccgacggtcagctcgaagccttcacggcgcatctgctcggcaagcacggccagtgcgagttcgccacggccctgcacttcccaagcgtccggacggtcggtcggcagcaccttgatggacacgttgccgatgagctcgcgatcgaggcggtccttgatcatgcgggcggtaagcttgtggtccttgccttcggtgccggcaagtggggaatcgttgatgccgaaggtcatggagatggccgggtcgtcaacgtggatgagcggcagcggacgcggatcgtccgggtcgacgatggtctcgccgatcatgatgtcgttcacgccggcgacggcgacgatgtcgccagggcctgcggattcgaccggggtgcgctccaggccctgcgtacgcagcagctcggacacgcggaagttctcgatggagccgtccacacgggacaggccgtaggtcttgcccttctcaagggtgccgttgtagatgcggaccagaccgagtcggccgaggaagtcggaggagtcgatgttggcgacgtgggcctgcagcggcgcgccttcctcgtattccggagccggaatgttcttgatgatggcctcgaacagcggctcgaggttgtcgttgtccggcaggccgccgttttccggctggttttcggaagcgtaaccggccttggcggcgcagtagatgaccggaaggtcgaagagggaatcctcatcgaggtcgatgccttcctcgatgacgtcctgggccaggccgagcagcaggtcggaggattcaccgacgacttcggagattcgggcgtccggacgatcggtcttgttcacgcacaggatgaccggaagcttggcttcgagggccttgcgcagcacgaaacgggtctgcggcagcgggccttcggaagcgtcgacgagcagcacgacgccatcgaccatggagatgccgcgctccacttcgccaccgaaatcggcgtggccaggagtgtcgatgatgttgagggtgatgccttccggatggccgtacttggcggccagcgggccggtgtactgcaccgcggtgttcttggcgaggatggtgatgcccttctcacgttccagatcgttggaatccatcacacggtccgggacttcctcacgctcgttgaacacgtgggactgggccagcatcgcgttgaccagggtggtcttaccgtgatcgacgtgtgccacaatcgctacatttcggatatcgccgcgaaccgccatcgaaacctctcttagtgttgctgttttcttacgtaaacgttcggtacgtacatgctatcggtacttaaaaatccgtacttacacacaaaccgagccaattctagcgaagcattacgacacatggaaaacggcggacctgtcagatcatgccgacaggcccgccgtcaatcgcgcgaagagacgcgcggaccttaatcctcaagctccttgccagtgcgttcaggcaggcacagggccgccacgcaggcgagaatgaacgccacggcgaaaacgatgaacgccacggccttgttgccaccggacaaggtcaggaaccatggcatcagcagcggcgcgatgatcgcggccacacgaccgcaagccgcggctgcaccggaggcggcgccgcgcagacgcgtcggatagatttccggagtcaccgcgtacaacacgccccaagcgccaaggttggacgcggacagcagcatgccgaagcccagcacagcggccacggaaccggcttgggagaaggcgaacgcggccacggcggacacggcgaggaacacgctcagggtcttcctgcggccccagatctccaccagccatgccgcgaggaagtagccgggcagctgtgcgatggcgatggcgagcgtgtagccgaacgacttggtcagcgagccgaactggtcggccagcagagacggcatccacgtgaacgcgccgtagtaggagaagttcacgaagaaccatgtggcccagatggctgcggtgcgcgcaagatacttcttgccgaacagctcgcgggttttgatcttcggcagcggctcgcccttcggggatgcgaccggttcgacgcctccggcctgttcgaagtagcgcacggcctgctcggcctcatcctcacgtcccttggattcgaggaatcgcacggactcagggatatgaatgcgcgtcacgatggcgtacagcagcggcaatgctccgatgagcagcgcccagcgccatccccaatcgccggtgttcggaatgacgaaatagccgatgcaggcggcgatgatccagccgattgcccagaaggattccagcagcaccgtcatacggccgcgttgtttggtcggagagaattccgagaccaatgtggaggcgaccggcagctcggcgcccaggccgaggccgatgaccagtcgagcgatcagcagagccgccagcgaccatgacaacgccataccgccattggccagaccgaaaatcaccagcgtcgcggagaagaccgtcttgcggccaacgcggtcggccacgaagccgccaagcgcggcgccgatcgccattccgacgaaaccgatggacagcacccagcttttctcggtcggcgtcagattgaaatgcggatcggccgcgatggcggccacgacgaacgacaccagaccaacgtccatcgcgtcgaacgcccatccaatacccgaagccaccaacagcttcctgtgcgccttgttgaacggcagtcggtcaagacgctcgttgcgagtcagcgagacctctcccccgacggtttgttgcgatgcggacatcaacacccctttatcattgttttcctattgtgtcgtgagctcgttcaagcccgacgatggcaggcaatcacgccgtcatcaatgcggataacgcgtcgtcatcctggaaagcaattcgagtgtcgtccgattcggatgccgttccggcttcggtccacaaatccgttcccggcttccggctgtaccggtagaccgccgccggcctgttacggccgatccgcagtttctcaccggtgtcttccaacagtccggaagcgagcattttacggcggaaattcgccaaatcgatacgctgtccggcaatcgcctcgtacacgtcatgcagttggctcaacgtgaatcgctcgcccaccaatcgggtggcgatgtcaggcgattcgattttgccgcgaagccggttcatggcgtattcgacgatggtgcgatggtcgaacgcaagttccggaagatggttgacggggaaccacttgacgttgtcccctccggcgaagtcgattcgtccatcggcctcgcccaccagggcccagtacacgatggacaccatcggcagaccgccatgcgaacgtgccggatcgccgaacgtgtaaagctgctcaagatatttcggatgcagcgacgtcgtcgattccagtgcggcatacgccgactgttccaatgaatggtcggccctcagaccgcctcccggcaacgcccattgccccaaaaaaggctgacggacgcgtttgaccagcggcatccacagggtggagcccatgccggacgaagcggcaccagcgcccacatctgactgcggaaccggtcccaaagccagaatcaccacggatacgccgacctgcggaggctgcttgcgccgttccgagacattgcccatgatcaattgatggcctcttccaatacttcgaattgcttacaggaaaggagtctaacacttatagtcaacatgactataagtgtgtcgagtcgctcataaacaccaagagcccccaacggggctcttgcaaagttcaggccacgatgtcgttggcgatcagctcgcgggccacttcacggtattccttcgccgtcttgtggttcggcgcgtagatggtgatcggcgcggccgccaccgtggaatccggcagcttgatggaacgcgaaatcacggaatggaacaccttgccttggaacgcctcgtagatacgctgcaacacctcctcgcaatgcagggtacgggtgtacatggtgaccagcacgccatacacttcaaggctcggattgatgcgcgactgcaccttctcgatggattgcatgagcagcgccacgccacgcagcgcgaagaattcggcagcgaccggaatgatcacaccgtcggccgcggtcaacgcgttcaccgtcagcaggcccaacgatggctggcagtcgatgatgatcacgtcgtactcgtccttgacctggcgcagcacaccggcaagcacctgctcacgtcccacttcggtgaccagttgcacttcggcggcggacagatcgatgttggccggcataatgtcgagattctcgaaatcggtgtggtgaatcacgctgtgcacgtccatgcgcggattgaacaacgccgtgtacacggtgtcctccaccgcgttggcgttgatgccgagacccaccgtggcggcgccttgcggatcgaagtcgacgatcagcacgcgcctgccgtattggcttagcgcgccgccgatattgatggaactggtggtcttgccgacgccacccttctggttgcacatggcgatgacccttgccggaccgtgcgtctgcagcggctccggtgcgggaaacgtctcataatcacgtccaagcaaatccgtaggcataccgtttaccttaccaacatcctcgtgtcaaaaattccactgtttccatgctagcccatcatcgccgtcagaaacggcagcaacacatgcatctcatgctatcttgcccttggatgcgaggtcagatatgtctcgatgaggttctccgggcttacatgcgtgtagatctgcgtggtggtgacgctcgcgtgacccagcagttcctgcacggtgcgcacgtcggccccaccttggatcagatgcgtggcgaaggaatggcgcaatgtgtgcggatgcaggggcttgtcgatatgcgcgcgttccccggccgcacggatgatctcccacaccgattgccttgacagtcgtttgccgcgcttgttgaggaacaacgcgcgtcgttcggtgggccctttcgccttcgactcgagctgcggccgtccgtttttgaggtatcttgcgatcgcctcacatgcgtaactgccgaccggcaccagacgttgtttggagcctttgcccatcaatctcgcaacgttcgattccaagtcgacatcgtcaagattcgcgccgcacgcttccgacacgcgggctccggtggcgtacatgaattccagcaacgccttgtcgcgcagcatcgcgggatcatcgggcatgtccgccatgccttcggattgaggccgattctgcgagacggggatcgcgtccagcaaactggccacctcgtccacagtgagcacgtcaggcagcgtcgtcgcgcctttgggagccttgacctgtgccgcaacgtcattggacaccacatgttcgttcagtgcgaagcgatggaatgcatggatgctggccagtcttcgtgccttgctgcgcgcggattctccggaatcgtcaagaaaggcgatgtatcgttccacgtcctgcgtggtcactgcattaaggtcttgaatgccttgcgtcgcaagccagccgttgtatttgcgcaggtccgagtcatatgcgcgcaccgtggctttcgcaagtcctcgttccacgtcgatgtacgcgaggaactgatcaatcaagcgttcgatatccgtcatcgtggtcctccgtttgcatcgtcatcatttgtcgtgtccgttccgtcacgctcccgtacggaacgcgctgcccgcatggaggattccaaggacgttcgttccaagtggaagccgtcattggatggaaatcaacattccggaaagtctattcaaagtatccggtatggggaacgcgatacgcaagaacccccgtccgtttgccggatcgggggttctgaagttcacaggtgaaccgtcggggaaactcaggcttccttcggagcgttcacgtcagccggaagagcggccttggcctgctcgacgatggccttgaaagcctccggatcggagacagccagctcggcgagagcgcgacgatccagctcgatgccggcaaggtgcaggccctggatgaagcggttgtaggtgatgccttcggcgcggacggcagcgttgatgcgctggatccacagcttgcggaagtcgcccttgcgagccttgcggtcgcggaagttgtaggtaaaggagtgcagcagctgctccttggccttacggtacaggcgggagcgctggccgcggtagccggaagccctctcgagaacgacgcgacgcttcttgtgggcgtttactgcgcgcttgacacgtgccatatttgattcctcagctttctattaagtctttgtttctaagctctcgctatgctcagcgaccgagcagcttcttcatgttcttgctctgggaagtggccagaacaccgtcggccttcagctcacggcgcttacgagcggacttgtgctcgaggttgtggcgcattgcggagccggcgtgcatcagcttgccggaaccggtcacgcggacgcgcttggaagcggcggaattagttttcatcttcggcattgctgccctccttgtttgttacttcgtttcggaagtcttcggtttgtcggatgccacggctgccttggctgcggctgcggccgctgcctgggcctcctgcttggccgccagacgggcggcctggcgggcctggcgctcggcacgggactgatcgccacgacgacgctgctcggactgggtatggaccttcttgcccttcggcgcgagcgtcatgatgatgttgcggccttcctgcttcggagcgaattcgacagtgccgtattcctccacttcgctggcgagacgctgcaacagctcgacgccgccgatcggtcgggactgttcacgaccgcgcagcataatggtgaccttgaccttgtctccgccgttcaggaagcgcaccacatggcccttcttgacctcgaagtcatggtcatcgatcttcagacggaagcgaatttccttgatttccgcggtgctctgattgcggcgggcctcacgagccttgatcttctcgttgtacttgtacttgccgtaatcgatgagcttggcgaccggaggcttcgcgttgggcgccacctcgacgagatcgaggttcgcttcctttgccaggttcaatgcgacggaagtcgcgatgactcccacctgctcgccgttcgggccgatcagacgcacctgggagacgcgaatctcgtcgttaatgcgtggttcgtcgctgatgatgactccaatcctcatattccatgcaacggaacatcctttgattggcagttttccaaagtctcgattgttcaaggcatgccaaaacgcatcacaacgcgccgtaaacccgtaagagcggcttacatatctcaccgagacgaccggtggaaggcatctgcctgaacccgaggccctgaaaggcttccaggtggggatatcccgctttcttgatttctcaagccttgtagataataccacaccccgggaccagcgcgtgtcgcaccggtcccggggtgttcgtcaccattcggacggcatccgccgtcaggcgatggcgatgacgtccggcttctcgccgtcgtgcacgaagtagacgtcgtaccacgtcaggaacgagtacacggtccagatcttgcggcgatcgtcggttttgccggcatagttgtcatcgatcatcttcagcagcgcgtcctggtcgaagaactggctgacgtaatcgcgttcgaacacggaacggacgtacttgtagaacttctcctcacgcagccacttcttgatcggcaccgggaagccaagcttctcacggtcgtaccattccttgggcagatgacgtcccgccgcctggcggaacgcgtatttcgtgttctcgtcggtgatgaggtacttggtcggcacctgctcggccacgcccatgagctccttgtcgagcagcggcacacgcaattccagcgaatgcgccatggtcatcttgtcggccttgagcagaatgtcacccggcatccactgatgcatgtcaaggtactgcttcttcttcagttcgctcagacccttgccttccacacgcgcatacgtcttgtcgacgatgctttgcacgctcggcgccttgcggtattcaggcttgagcagctgttcggactgcgattcctcaaacacacgtgcctgtccgatgaagctttcctcggccggcgcaagattggcgtacagatgccatgcgcctgggaaggtcttgcccttgcagaaccgggcgatcgccttgcgcgcgccggctggcagatgcgtgagccagcgagtcaccaccttgatgggcttgaatttggtgtgcacgccgtagtcgatgtatccggcgaacaactcgtcggcgccttcgccgctcagcaccaccttcacgtctttggcggccaatgcggacaggaagtacagcggcacgcagctcggattggagtccggctcgtcgagatgccattggatgcgcgggaacgcggcgaacgcctcctcgtcggtcaacgactcggcggtgttgttcagtttgagcagttccgccagttcgccggcctgctgcgattcgttgtacgtgcctttgccgaaaccgatcgaatacgtgtgctgcggacgcgccacggcggcgacgtagctggagtcgacaccgctcgacaggaaggagccgacctccacatcggcgatctggtgcgccttgacggaatcgcacaccgtctggtcgatcgagttcaccagctcgcccagcttctgcttgccttcgcggaaatcctcgtcgtaataccggtggatgtccatcttgccatcccggtacgtgaaatagtgcccttccggcagcttgtagacgcctttgaagaaggtctcaccgatcgccggatactggaaggtcatatacggcttcaacgcctcggcgttgagctccttgacgaaatcggggtggcgcaacaggctcttgatctccgacgcgtacatgaacgtgccgttcatcttcgcatagtagaagggcttgatgccgaaatggtcgcgcgcgccgaacagctcctgcttgttcttgtcccagatcacgaaagtgaacatgccacgtacgcgctgcagcaaatccacaccccactgctcatagccgtgcagcagcacctcggtgtcgcttttggtggtgaaggtgtgtccggccgcgatcaattcctcacgcagcgtctgatagttgtagatctcgccgttgaaggtgatgaccttcgaaccatcctcgttgtagatgggctgctggccgccgccgaggtcgatgatgctgagccttcgatggccgagcgccgcatgctcgtcgatgtaatggccttcgctgtccggcccgcgatgcgcgatcatgtcggtcatacgttggaggaccgggcatttcacgtcaatgggcatatcgttgacgaaaccagcaattccgcacattatctgcaatcccttcaaaacaaactcggtgtcagtgtaccagcatccgcatgtcgaaaaaccgccgccgcgcctccgaaccgattcatgcgtgacaatctccataggtttcagacattttaggtatgccgcatagccatgaaaatgacgattctttcctttcgtccgtcacggctacactaccgggtatggatttccacgatgcccgcacctgcgtgatcttcggcgcaggcgattattacgatgagacccctgcgattccggatgacgccttcgtcgtcgccgcggacggcggcctcgaccacgcccgtgccttcggcatcgacgccgatttcgtggtcggcgacttcgattcgattaccggcgaccgccccacgcaaaacgaccgcaccatcgcattgccttcggaaaaggacgatcccgacctgctgtcggctttgaagatcggctggctgcgcggcgcgcgcacgttccacatatacggcgcgctcggcggacgaatcgaccatacgatttccaatatccagcttatggcgctactggccgaccgtggcgcgaccggctacctgcacggcgacggatcgatcgtcaccgcgatctgcgacggcgcgctcgatttcccggcggatgacgccgttgcgggacgcatggtctccgtgttctcccacagcgatatctcgaccggcgtaagcgaaacgggattgaaatacgagctgcaccacgccgacatgagcagcacgcgcgtcaacggactgagcaacgagttccttgccggcaggccgtcccgcatcacggtggagcatggcacgctcatcgtcacgttccccatcgaggctcccctgccgcacgtggcgcgatggcatggcttctccggagatctcggtgcattggacacggacgtatcctccgcgctggtcgagccaagcggccgttgaacgcatgcgggacatgcatgtgagcgttcactgaaaatcgcactgcattttggaacacgcgcctcggaacgttgccctaagtacaggtgacgcactacagtggacggtgttggtaaacaatggcttcagtgtgcctggcacacgcgtggcctaccctaaagggagaattacatgacagttaagattggtattaacggctttggtcgtatcggtcgtctggctttccgccgtatcttcgagctgcaggctcgtggcggccaggccggtgacattgaggtcgctgcaatcaacgatctgaccaccccgtccatgctggcctacctgctgaagtacgacagcacccacggcaccttccgtcatgacgatggcaccccggtcgaggtcacctccaccgacgactccatcgtggtcgacggcaaggaatacaaggtctacgccgagaaggatgccaacaacatcccgtgggtcaagaacgacggcgttgagttcgtgctcgagtgcaccggcttctacacctccgctgagaagtcccaggcccacatcaacgctggcgccaagaaggtcctgatctccgctccggccaaggacgagaccaccccgaccatcgtgttcggcgtgaaccacgagaccctcaaggcttccgacgtgatcgtgtccgctggctcctgcaccaccaactccatggccgccatggtcaagctgctggacgagaactggggcatcaaggctggcttcatgaccaccatccacgcctacaccggcacccagatgatcctcgacggcccgcgcttcccgaaggctcgcaacaaccgcgccgccgccatcaacaccattcctcattccactggcgccgccaaggccatcggcaaggtcgttccgtccgtgaacggcaagctgcagggccacgcccagcgcatccaggttccggatggctccgtcaccgagctgaccaccgtcctgaacaaggaagtcaccgccgatgagatcaacgccgccttcaaggccgccttctccgacaccgacttctacggctacaacgaggatggcatcgtgtcctccgacatcatcggcgacacccacggtggcgtgttcgatccgacccagaccgatgtcaacaccgttgacggcctgaccatggctcgcaccgtctcctggtacgacaacgagtacggcttcacctgcaacatggtgcgtaccctgctgtacttcgccgagatctccgagtgaatcggcgcggagtaatccgcacggttcgtctctgaacctcagacaaaggggctttcgcttcggcggaagccccttttcgtatccgaaacgccgcaacggacacgtggaaggcttattatgggcggcatggcaaagaaaaagcatgagaagggcgccggttccacaccggccaccgtgcagttggaaaaagccggagttccgttcaaaacctacgaatacgcgcattcgaacgatcacatggatgacggttatggggttgaggccgccaccaagctcggtttcgacgagcatcaggtgttcaagacgctgatggcggacaccggctccgaacgcgtggtcggcgtggtgccggtcagcggacatatggatctgaaggcgctggccgcggcagtcggcgcgaagaaggcggcgatggccgatccgaaggtcgccatgcgcgaatccggctacgtggtcggcggcatctccccgcttggccagcgcacacaccacaagacggtgcttgacgaaagcgcgctgcaatacgacgaaatcctgctgtcgggcggcaaacgcggtttctcagtcggcgtcaatcccaacgatctgctcaaggtgctcgacgcggtagcggcgccgatcggcacttggtaaaaaacacgccgatacatcacaccaatacataagtgggtggtcggaacaacacgatgttccgaccacccacttgcgtaagcgaaaggttcgcgctatttgcgcagttccgcaggaagcacgaaatgcatgttctccttgatggtttcgatggtgctcacatcctggtagccaagttcttgcaacgctgcgaccacgccggaaaccagctcgtccggcacggaggcacccgaggaaatacccacggattcgacaccttcaaaccatgcggggtcaagttccgaagcatcatcaacacgatgggcgcgaccagcggcgccaacagccgtttttgaggcgtaccgcgcgttaagtccctcctgagcgacttccatcaaccgcacggaattcgaggaattcgcggagccgacaatcaccacgcaatcggcttgctcggcaacgagcttgaccgccgcctgacgattcgacgtggcatagcagatatcggagttcggcggcatttcaagccatgggaaacgagctttgagcgcggtgatcgtgccagcggtctcatcgacgctcaacgtggtctgcgtaagcagcaccagtttcgtgtcaggttggaaatccaacgagtcgacgtcggacgtatgctcgatcaaatgcacatgttccggcgattcctccaccacgccaacggcctcatcgtggcctttatgcccaatgtagatgatctcgtaaccttccttgacaaaacgcagcacctcgcgatgcactttgcttaccagcgggcaagtggcatcgaccacatgcatgccgcgcgccgcggcctcggctttgaccgccggagacacgccgtgggcggaaaatacgattgggatgccggcttcggcggcggcatcggggatctcagccaattcctgcacgaacaccgcgccctgcgcggccaaatcctcgacgacatgcttgttgtgcacgatctggcggcgcacatacaccggcggcaatccgtcggcacgtggcgtatcggcggatttgagaatcgtccgcaccgtcagaatcgccctatccacgccggcgcagaatccgcgcggatccgccagcacgatgcgtttgcccatgtcaagccgccttccaatcgtatccatccatcacaacagcaatcaccaatattaaggcacgggcgccgtcaatcgacatcggccgtcttcatccgcagaatttccacacgacaagcgcatccaccaccacatcgtgagcggtaacatagtagcggaaacacagtcgacaacactatggagtgatttatgacctgcaccaatctgccgccacgcaccggacagcaattttccatttcgcatggcgattaccatgccgtcgtcaccgagttgggcgcgacgctgcgcaaactgacctaccaaggcgaggacatcatcgtctcccccggtccggatgacatggtgacctgctgccacggccagctgctcatcccgttcccgaaccgcatcgagaatggcgaatacaccttcgaaggcaagacctacacgctgccgatcgacgagcatgagcgccacaacgccatccacggctacggcaagcgcgcgttctggaagcttgtctcccttaaagaggatgccgtgaccctcagctggcgcgcccccaacatggagggatatccgttcgacatcgtggtgaccgcgacgtacagcctcgccgacgatggcctgcatctgaacatcagcgcctacaacaacggcgatgcagacgcaccgtgggccttggccatccacccgtggctcgccaacggcttcaacggatacggcgatgagatcgacgcccacaacgccaagtgcagcctgaccatgccggggcgcacgcatgtcaccgtcaacgagaacctcattccgaccggcaccgagccggtggacggcaccaagtacgacctgcgtaaggacacgctgctcaccgagcagccgttcgacgacgcttggacggatctggagcatgccgaagacggcaccgtcaccgcggtgttcacccgtccggacggcaagaaggtgcgtgtgggcggcgacgagaccgtcacctcgttccaggtgtgcaccggcaccggtttcccggccatcaagcatccggccggcgtggcggtggaaccgcagacggcatacgcgaacgcgttcaacaccggcaaggacctcatcgtcatcaagccgggcgagacgtcaagcacggcgctgttcatcgggatgctcgactgatataatcaccatcggaataagtcccggccacacagcggacgccgaatttggcaaacgtctcgctcgtgtgcgataatcccgaaggcttattaatcgcaagtaaaggagtccaatcatgggcatgcgcggacgtaagcgcaaggatcgtcgtaagaaggccgccaatcacggcaagcgcccgaacgcctgatccctgccggcgcgaatagcgtcacagagcatggaaaaccccgcggaatcattacggttcgcggggttttcccatattcagacgctgatgcggcgggcgcgcctcgcgtcacatcagcgtggcacttggcgcatgaaacgccgcacgtccttccaattactcgtcacaacagtggtcaagtgtcgcctcaagcctgtcgatcaggctttgcggcgcgtgtttcggccgcaggtacgcgcgcatcgctgcgatcagcgcacgttcgcgttcatcgcaacaggtctccgggtcgaagcagtccccggaagccacgacatgcacgctggcatgcgtcacctgcgtcaccacaccgttcgtgttggtggtggtcgaagtaatggagatgtgccgttccattggttcgctcatggtcgatccttcccggcagtggcatagccacgttccttggcgtaattggcaagctcacgtttcagctgtgtgcgggcgcggttgagccggctcatcacggtgccgattttcacgccttgttcctcagctacctggctgtatgatttgccgtcgatcgcggcgtcgatgaaaacctgcctgcgttccggggaaagccggttcaaagcggccatgatctcctccggcgcgtaggcgtccaagtattcctgttcggcggatttgagttgttcggaggaatgctcggacgcggaatacaggtcccagtcgtcgtattcgccggtggaatcgttagcgcgttgcggccgtcgcttggctttggcgtactggttgaaataggcgttgcgttcgatggtggtcatccaagccgcgaaattcgttccttctttgaaggagtcgaacgccttgaatccacgttcgaaggtgtcctgcaccagatcctgcgcgtcgtcgggattgttggtcagtttcatcgcctgccggtacagcgagtccacaacgggcatggcaagcttctcaaaccgcgcgcgccggcccgccatggattccgtttcttgttcagtcacaccctcattgtaacttccccgacgtcacacgtcgtgcacatggttgccgctaaaatggctcttcggtatccgctcggcgtctcatacacagggagaacacgaaaacatggctttgactctggaatcggcggcccgactgctcgataggcacggactgctgcgcgaaatcatccgcggcgatgtctggacgcttgatccgcacgacatcaagggattcgacgagccgttctccgcaatcacctacgacacccgcaaggtggagccgggcacgttcctgtgctgcaagggccgtttcaaggccgaatatctgcagggcatcgacgaacgcggccttgccgcctatgtgtcggagaacgacttctccgacgccacgcaagctccgggccttattgtggatgacgtgcgcaaggccatggctttgctatcggctgaattctatggtcgtccgcaggaccagttgaaggtggtcggcatcaccggcaccaaaggcaagaccaccaccgcctatctcacgcaggcgatgctcaatggctgttccggcggcaagtgcgcgctgttttcctccgtggacaattgtcttgacggccacacctacgtggaatccgatctgaccacgccggaatccatggatgcgttccgcatgatgcgcgaggccgttgataacggcatggaatatctcgtcatggaggtctcctcgcaggcctacaaggtggaccgcgtgttcggtctcacattcgacgtggccgcgttcctcaacatcagcccggaccatatcagcccgatcgagcatccgacgttcgaggattatctccactgcaagcgtcagatcgtcaagaactgccgtgccctcgtattgggtgccgattgcgcgcgcgccgacctcatccggcaggacgcacgtcatgccagcgttcccgtcaccacgttcgcgcttggcggcgattccacggcagacgtcatggccgcgccggcgaatgacgatcacagccgcttctccatcgtcatcgacggcacctcgatcggcgagttgagcctgacattggacggcgatttcaactatgcgaacgcggcggcggccgtcgcgatcgcccgtgcggccggtttcgatttcggttccgcacaggccaaggacgcgttgcgtgagatggagccggtacgcatcgccggacgtatggagcatttcaaggacacgcggtcgaacaccatcgccattgttgattacgcgcataactacgcgtccgtcaccgcgttgcttgactacgtcgatcagcgttacggcagcgaaaagccggaaatcacgctcatcaccggctccgctggaaacaaggcatacgatcgccgcgccgaaatcgtccacgccgcgcaggaccgcatcgaccatctcgtgctcactttcgaagacaccgacgacgagcctgtggaacaggtctgcgcggacatgaacgacagcgtcaccaacccgcagcttgacgtgaagaccattctcgaccgtgccgaagccgtggagaccacggtaagccgcgatcgcaaggatcccgagcatctgcacatcatcctcatcatcggcaagggcaacgaacgttggttcaaagaccacggcaagcacatcccttacgagggcgacgaccgcatcgtggaacgcgtgttccgtctcaaataacaactaaggtgaaggcattatgacacgattccaaccgattctgctgggcagcgacatcaacgtctacggcatggccagggcgttccatgaggagtacggcatcgtttccgaggcgtatgcgtatttccagctgagccccacgaaattcagccgtatcgtcaacgtgcacatcgtcgacgatttcaacaacttcgtcacgttccgtaatttcatgctcaagctcggcaagcgtatgaaggccgaggatccggaacgcgtgctgctgctcatcccctgcggcgacgtgtacgccaatctgctgagccagtgcggcgacgatcttcgcgaatatttcgtatacaacacgcttgacgtgaacctttcgcgccggctcgcctacaagtccacgttctaccagatctgcgagcagtatgatctgccccatccgaagacgcgcaccgtcaccgccgatgaggtgaaggcaggagcctaccgtgatttgccgttcagctatccggtggccatgaagcccgcgaattcggtggaatggctcaacatcgatttcgagggccgtcgcaaggcctacatcttcaacgatccggccgaattggagaccatcatcaagcgtgcgtacgatgccggatacacgtccgaaatggtgattcaggacttcatccccggcgacgattcccgtatgcgtgtgctgaacgcctatgtggaccagcatcatcgcgtgcgtatgatgttcctcggccacccgctgctggaggatccctcccctgtcgccgcgggcaattatgcggccattctgcccgactacaacgagggtgtgttccgtcgtatcaaggctttcctcgaggacatcaagtacgagggcgtggccaatttcgacatgaagtacgacgaacgcgacggcgagtacaagctgttcgaaatcaaccttcgccaaggacgttccagctatttcgtcacgctgaacggcttcaatctggcgaagtatttcgtcgacgacctcgtcgaggacacgccgttcgacggcaacaccctgttcggccgcggttcgaaactgtggcttgagattccgaagtcgattttccttgattacgtcgcagaaggcgctgacaaggaaaccggcaagcgcatgctcaagtcgggcgattggggtaccaccttggagtattccaaggatatgaatccgctgcgttggctgatgattcggcacatgttctcgatttacaagaagagctatgccaagtacttcaccaagaagggcgagcttaagtgaaacgaccgtttttcgccgtactgggcggcatgggcacgctggccaccgaaagctacatccgcttggtcaaccgcgccacgcatgcccattgcgatcaggattatctggactacatcgtcttcaacgattcctccgtgccggaccgcaccgcgtacattctcggcgaatccgacgagaatcccttccccgtactcgccgacgatatcgagaaggcaacggcgatgggcgcgagtttcattgtgctcacctgcaataccgcgcactatttctatgacgatttccaggcgttgacgacggtgccgattctacatatgccacgcggcgcggtggcacgcatggctcagcgttatccgaaggatcgttttccgcgggtcggtttcctcggcaccgtgggttcgagcaaatccggcgtgtacaagcgtgccgtcgaagaggccgggtacacgttcgtcgaaccgaccgacgagttgcaggcccgtatcacttcgctgatttatgacgatgtgaaaggtagtggcgagctcaatctggaacgctacgaatcggtgttgcgcgatatgctcgatccggcaggcccctgcgcgtgcgacacgctgatattgggctgcaccgagctgagcgtgctcaacgaggcgtttccgctaccccagctgccggtcatcgacgcgcaggccgtgctggtggaagataccgtggcgcgggccgaagcgttgcgcgcgtagctattatttgtcacgcctatcttcgactgcttaggcgtcggacgataaaacaagattgtgggtgacttcccattgcctggggagccacccacaatctgttttacatggacggtgtacgccgcacgtatggcgtcatcgtccgatgttgtttcgcttcgtcacttcgtttcgttttccgaagccgtttccgcatccgccggttcgttggcatccgccgcctcatccatttcatccgcatcggcgtctgctaaaacggaatcgtccggaccgacgctgccgaaatcgttgatgttgaaatcagggttggcgtcggattcgaaatccacgtcagcctcgtcctgctttttgcgcggttccggatcgacggcttcctggaacacacgttcggcctttggcttcttcaggtcggggttgatcttctcctccagcatgagtcgcgcatcaccggcggttgtgaagctgccacagacgagcacgccatgaccgtagccgacgcccagttcgtcatcggcatcaaccatgttgacggcttcctggatggcgtccggcaattcgggaatgcaggtgacgcgttccggcccgaaaacacggtccgcgatcttcttcagatcctcagccggcatcactcggtcacgccacgagttctcggtgacgatcacatggctcagcaacggttcgagcacgcccagatactcctcgacctgcttgtcccccatcatggcgaccacgccgacgagctgctggaaatcatagttctcttcaatggcggcacgcagcgattcggccgcgttcacgttgtgcccgccatcaaggatgatggtaggcgaggtacgaatttgttcgatacgtcccggaatgcgtacgctgctcaacgcttcggccaccaaatcgccgtccaacgcgccgttgacgggaatcaccacttccgccgcgcacagtgcggcgagcgcgttgtgtgcctgatgctcgccgaatttggcgatcggtacttccgtgtaagtgccgttcggagtgcgcagggtggccacctggccgccaacggccggcactcgggtaacgacttccgattcgacgccgtcgcgcaccaagctggcgtggttctccttggccgcggcctcgataatcggcatgacctcgtcctcgtgtggctggcggccgatgatggcggtgcagttcggcttgatgatgccgaccttttccgtggcgatttcctccacggtgtcgccgagccatgccatgtggtccatgtcgaccgggccgatgatggccgcgtccgcgtcgagcacgttggtggcgtcccatcggccgcccatgccgacttccacgatggcgacgtcgaccggcgcgtcggcgaatttccagatggccatggcggtgagcacttcgaagaagctcatcttcggcttgcccagctcgcccattttcatgtccacgatggcgacgaggtccttgacctggtcccaggtgtcgacgaaatcgtcgtcggacagctgctggccgtcgatggcgatgcgctcgttgacgtgttccagatggggcgaggtgtataggcccgtacgcatgccgtaggcgcggcagatggcttcggccatacgtgccgtggagcccttgccgttggtgccggtgatgtggatgacgcggaacgactgctccggatggcccatgatgtcgaggatcatcttcatgcgttgcaggtcgagattggtggtgttgcgttccgatggacggctcatgatgtcgcgttcgacgtcgatcatgctttcgttgttgcgattgggatgttcgaatgacatatttcccgttttcctcccgtaccttgcggacagcacactaaacttttcccattctagatgtccgcatgaacgttgcgcgccgggaaaagttataggatgggttgcggtaatttccgtacgttacgaatgcatgttcaggagatgtgatgggcgaagtcattactgacaaggacaaggaatacgagaagatggagcgggaggccgctccgggaccggatcaggccatgagcgatcgtgtgaacaatcgttcgctgcgtccgcgttccgaggcgttcaaggagttcatgaccaccggttgggatgacaacgagccgcagatcgagccgttggagtcctccaagtacacgccggcgcgtctggaggcgttgggcaaggcgttcccgggcgagcgtatcgtgattccggccggccagccgaaggtgcgcaacaacgattgcgattacgcgttccgtccggatacgacgttctcctactacaccggtttgggtgaggatttcgaggccggcgcggtgctggtgctgaatcccgtcgatccggattctccggaggcgaagaccggcaagacgcatgttccggaactgttcgtggctccgcgtgccaaccattacacgcaggactttttcatgaacgcccattatggcgagtattgggtgggtccgcgtgccggtgtgaaggaaatgaccgcgatgaccggcatcgaaaccaacgacatcgcgcagctgcccgacgcgttgagcaaggatgtcggcactgaggccggcgcggtgcgcgtgcgcgtgatccgcgaagccgatccggcgattaccagcatggtcgaggagatccgtgaagccaacggtttcgccgatccggacaacaacaccgctgccgatgacaagctgcacgaattcgccgccgaggcacgcatgtgcaaggatgagtatgaggttcgtgagatgcgcaaggcggtcgcggcaaccaagcatggtttcgacaacattctgcgcaagattccgtcttcccttggcaagccgcgttcggagcgcatgctggagggcgcgttcaacgccatctcccgtgaagaaggcaacgaggtcggctacgacaccatcatcgcttccggcgcccacgctccgattctgcattggatgcgcaataccggtaccgtggagtcgggcgagctgctgctcatcgacgccggtgtggaggtcaacagcctgtataccgccgacatcacccgcacgttcccgaccaacggcaagttcaccgatttccagaagaagctgtaccaggccgtgttggattcccagcaggccggtttcgaggcggccaagccgggcgccacgtattcggacatccatcatgcgtgcatgcgcgtgatcgccgaacgtctgcatgactggggtattctgccggtcgatgtcgaggagtcgctctcccctgaaggccagcagcatcgccgttggctcgcctgcggcgtggcacatcaccttggtcttgatgtgcatgattgcgcgcaggcgcgttatgagtcgtatcagaacgccaagattcgtccgggcatgatcttcaccatcgaaccgggcctgtacttccgtgaggatgatctgctgattccgccggaataccgtggcatcggcattcgtatcgaggatgacgtgctcatgacggaggatggtccggaatggatttccgcgggcattccgaagcggatcgacgatgtcgaggcgtggatggccgatatggccgccgaaggcgtgaaggcctgaggacgcatcatgcccacgcctgaattcgtactctcgctacgtgaaaaaataggccacgatctgttatggctcatgggcgtctccggctatgtcgaggacgagcagggccgtgtgctgttggggcgtcgttccgacaccggcgaatgggccatggtgtatggcatcaacgagcccggagaggaaccggccgataccgttgcccgcgaggtcaaggaggagaccggcgtggatgtggtcgtcaccgatctggtgtcggtcaaatcgtccagaaaggtcctcacctatgcgaatggcgacaacaccatgtacatggatcacctgttcatctgcaggcccgatccgaatggcaacacggagccgttcgtcggcgatgaggaaagcctcaacgtgggctggttctcccctgatgctctgcccgagccgttggcagccaccacggtggaacgcatggcttacgtacgcgaatatctgaaggccaaggcgaatggcgattcccatgcccagtttgccttcaacggcaccatccgctgaaatcgccttccatacatcataaaatggaatccccgcaacgtttcaagcgttgcggggattcctttttattagattccgtggatcagctcactgctgggcggcaagcagctcatgcagatgctcgcgatgcttgcgctgttcgcgcggatcgggcaccggcagggaggccagcagcttctgcgtgtatgggttctgcggattctgcatgatctggtccgcatcgccatgttccacgatctggcccttgtgcatcaccatgatgcggtcggcgagcatgtcgaccacggcgagatcgtgggtaatgaacaggcatgcgaagccgatttcggcctgcagcttcttgaacagttccagcaccttcgcctgcaccgacacatccaacgcggaggtcggttcgtcggcgatgagcaggctcggcttcaacgccaacgcgcgtgccaaggaggcgcgctggcgctggccgccggacagctcgtgcgggaaacggttcatgtaggcgcgcggaagctgcaccatctcaagcagatcgcccacatacttgcgggcgtctgataccgacgagaacttcttgtgcacgatcaacggttcggccacgttttccgcgatggtcatcagcggattgaacgagctgcccggatcctggaacacgaagccgatgtcggcgcgcttgggcttgaaatcacgttccttcacaccgttcatttctatgcctagaacgttcagggaaccgccggaaaccttctgcaggcctgcgatggcacggccagtggtggatttgccggaaccggactcgcctaccagaccgagcacttcggaacggtggatggtgaagtcgatgccgtccacggccttgaaatcaggctgcatgagatgacccggatacgtgatggtcagtcccttggcctcgaccgcgatgggctgatcgcgccaatccttctcacgttcgatgaccttgccatcggcatccttgacgaccagtttctggccaatacgcggcacggcggtaagcagacgcttggtgtagtcgtccttcggcgagtagaagatctgctcgacgctgccctgttcgacgacgtggccgcggtacatgaccacgacctcatcggcgatgtcggcgatcacgcccatgttgtgggtgatgatgagcacggatgcgtcgaactcgtcgcgcgccagacgcagcaggtcgaggatttcggcctgcacggtcacgtcgagggcggtggtcggctcgtcggccagaatcaggccggggttgagcaccagggccatggcgatgacgatgcgctgcttctggccgccggagaactggtgtgggtagtagtcgatgcgggtttccgcgtccggaatgccgaccttcttgagaatgtcgatggacttggcacggagttccttcttgtccttcatgccatgggcgcgaaggccttcctcgatctgccatccgatggtatacaccgggttgagcaccgaattgggctcctggaacaccatggccgcttcggcgccgcgcatttcgcgcagctgttcgccggacagcgacagcacttccagctcctcggtgcccgcgcggttcgacaggtacaccgcgccggaggtcgtagcggtctccggcagcagcttgatgagggagcgtgcggtcacggacttgccggaaccggactcgcccaccacgccgatgaccttcttacggggaatttcgaagctgatcttgtcgatggctttgatggaaccggcgtcggtcatgaacgagacgctgaggtccttgatctcggcgagattgccttccttgatttcactcatcggttcactccccttcctcggaagcccattcggaagccacgaatgacggatcacggtcggtgacggtcaccggtttgtcgctggctcccatcggattcttcgccgcctcaagttcggcgacgacctcgttgcgcttgcctggctcctggctggggtccacggacgtgtcttcgatggaacccaccacttcgcctgcggacttgcgggcgcgcagacgcggatcggccagatcgttcagcgattcgcccaccagggtgatgcccagcacgatgagcacgatggccagacccgggaacacggcggtccaccagatgccggcggtcacatcggagacggcgcggttgaggtcgtatccccattcggcggccgcggtcggttcgatgccgaagcccaggaagcccaggcccgcaagggtcaggatggcttcggaggagttcagcgtcaggatgaccggcagggttcgtgtggagttcttgaacaggtgcttggtcatgatgcgccacgtggaggcgccgaccacgcgggcggattccacgtacgcggattccttgatgcggatcacttcggcacggatggtacggaagtattgcggaatatagaccacggtgatggagatgccggaggcgaagatgccgctccacaggccggactggccgtgggagatcatgatcgccatcagaatcgccagcagcagcgacgggaaggagtacacggcgtcggcgatcatgacgagcacacgatcgacccatccgccgaaatagccggagaccaggccgagcagcacgcctgcgaaaatcgacagcaataccgcgacgacgatggcgatgacggcggtgcgggcaccccagaccacacggctgaacacatcgtagccacctgcagtggtgccccagatgtgttcggaggacggtgccgcctgggccgggaaggaaacgccgtcggcgcccttgagctgcgcgtagctgtatggcgcgatgagcggcgcgaaaatggcgaccagcaggaagaacgccgtgagcacgaggcccgtgatcagcatgcctttctgccagccgactgcgacgcgtagttccttgatgatcggaatcttatgccagaatggcgtcttgttgccgagcttgagctcgtccagacgattgtcgcctggaacggtgaccttgttggcagatgctgcggtcatgtcagtacctcactctcgggtcgaccaacgcggcgatgacgtcgacgatgaagttgacgacggccacgatgatggcgattaggataacgatgccctgcacggccacgaagtcgcgtgccttcaggtactgcgacagcatgaagccgagtcccttccattcgaaggtggtttcggtgagcaccgcgcctgcgagcatcagggcgatctgcatgcccatgacggtgatgattggaatcaacgccggcttccatgcgtgcttgttgagcagacgcttctcggagacgccgcgggaacgtgccgcctcgacgtagccggaattgtaggtggcgatcacgttggtacgcaccaaacggatgaacacgccggcggtcagcaggcccaacgcaagggccggcagcacggcatggcgcagcacgtcaagcagtacggacatatcacccaactggatcgcgtcgatgatatagaagccggtcggcgagaccagtcgggagaactgcatctcgctgccaagcgatgagcgcccggatgccggcagcacgttcagccagatggcgaagatgagcttcagaatcaggccgaggaagaacaccggggtggcatagcacaggatggcgaaggtgcggatgcccgcatcggccgcgtggtcacgcttgcgtgcggcgatgcgtcccaagccgatgccgacgatgagcgcgacgatgagcgcgaggaacgccagttcgaatgtggcggagccgtagtggacgaggatgctgctgaccttctggttgtcggtcagcgtggtgccgagatcgccgtgcagcaggccgccaagataatcgatgtactgcacgatgagcggacggtcgtagccggccgcatggatgcgcttctgcagttcttccggggtcaggcggccgccgagtgcggcggagatcgggtcgccggtggcgcgcatcacgaagaaaacgatggttacaagaatgaatactgtaggaatgatcagcagaaagcgtgtgagcacgaaacggaagaatccgcttgaaagcttgtttttcttggctttcggctgagcctcggttgcgctttgcgtcacgtcgggctcctttttccttattggtgtttcagatacaaattgagcccctgcccatcttaagggtgggcaggggcgatcaaaacctttatcaggccttggtcacggaagcgtagcggaagcggaaggaggcgtcgaggacgacacccttcacgctggatccggtaaccgcgacctggtcaccctgcagcagcgggatggtggaaaggtcttcggtctcgagcttctggatttccttcagggtgtcttcgcgggccttggcgtcggtctggccggcctgcttgacgatcaggtcgttgacgtccttgttggaatagccgttgttcacgaagttgccgtcacggaagaacggggacaggtagttgtccggatcggagtagtccgggaaccagccgagctggtagaccgggtaggaaccgtccgaatccttggtgacgttacggtccttgttgtactgggtccattcggtggactgcaggtcgaccttgaacaggccgccttcctcgagctgggccttgatggccgcatactcgtcggcggaggactggccgtagtggtccgggttgtactggagcttcaggtctaccggggtcttcacaccggcggcttcgagggtcttcttggccttggccgcatccggcttgccggaaccgtcgccataggctgccttcagggtgtcgtcgtggccggacaggccatccggaatgaaggagtacagcggggtgtaggtgctcttgtagaccttggtggccagctcgttgcggtcgatcaggcttgcaacggcctgacgcacggccttggccttgtcggcgttcggctcgctggacttctcgccgtacggcatgatcttgaagttgaaggcaaggaagcgctcttcgccgcccggtcccttgacgaccttgaccttgttgtccttggacaggtcctcgacgtcggtcggggtcatggagcggtaggccacgtcgacctggccctgctgcacggccatcttcaggttggaggagtcggcgaagtacttgacctgcacaacgtcgttcttagctggggtcaaacccttgtaggaatcgttcttggcatatgccagggcctcgttcaccttgtaggaggtgagcttgtacgggcctgcgaaggcgttgtccttgacgatggtgttggcatcggtcagcttgtcggcggagaaggactcttcgtcgacgatcgggccggccgggctggagagcacctgcttcagggtcacgtcgtccttgaccgcggagtggaacacgacggtggtgtcatccttggcctcgacggactcgatgttggccagcagggaggacgggccgttctcgtcgttaatcttcttgatacggtcgaaggagaacttgacgtcggaggcggtcagatcgtggccgttcgcgaacttcaggcccttcttgagcttgacggtgaactcggtgccgtcggcgctccaggtgccgtcatcggcggcgatgtccggagacagctcggaagtgttgtagttctgcgagtacaggaacgggaacacctgaatctgcacggcgtaggaaccgttgtcgtaggagccagccggatcaaggctggtgatcttatcggtcgtgccgacggtgatggtgttgccagttgcggcgccaccgtccttcacgccgccgcaggcggccagggaagccagagccgcgacagaagccagagcggcgataactttcttgcgattcactatggaatcctctcttttctatccgaatcgcccctgtgcaaggcgatatagtgacaagaatcggcgcgcaatgttaaccgtacgtttcattggaggccattttacccacctaccttatattcgccgttttctgctatgcattaaaacggcgaaattccaacgttttaacgactagtgaaagaaaataagaaaaaccagccattttatgagacgggcccagccaaagtcgcattcaaggtctacgtccttcttttttactcattgctttcgcacagagagacccagataagcgcgcgacacgcggcacaacacgaattgcattaatcaattaacagcgttaatatattaagaagttcaacgagggtccatgcactgtcgcaaggaggtgagcatgagtaggtacagcgcccaacagtcatcgatctcggaaaacaaccgttcccgcatcctgcaatacctgtaccacaatggcatctgctcacgcgcgcagatcgccaaagccatcaagctcactccggcggcaatcaccaaaatcaccgcgaaactgctggcgcagggcatcatcgacgaaaccggcgacatggacggagacaagaaccgccgttccatcggtctgaatctcaattgcgccaaataccacatcatcggcgtgaagttcgcccgcagtctggtgcaaatcgcggtcttcgacctcaagtgcaaccgtatcttcctgtccgacttgcctaccgtcagcgaagagcacatccccgaaacggtggagcgcattcgagataccgtacgccagctcatcaaggacgaccccagcatcgtggccgtcggcatggcggttccggggccctatttaaaggacgaaggacgcaccgctttggtctcctccatgcagggctggaggcaaatcaacttcatcgacgaattcagcaacgcattcagcgtccccgtgttcgtcgaacaggacgcccgcgccggcgcgctggcgcagttcctgctcaatccggaactgtcggaaggttccctcgcctactatctgcttggcgaaggcatcggcctcggagtcatcgacaacggcaccatctactacggcgagcacggcaccgccacggaaatcggacacgtctccatcgacgtgaacggcaagccatgcgactgcggcaatgtcggatgcctggaacgctactgctccgccaacgccatccacgaacaactcaacgccaacccgagcatcgttcccggatgcgagacgatgacgcatgcgcaggcttgcgcagcactgttcgccaaggcgaacgcgggagacgagaccgcgacgcttctgatgctcgatgttgcccgatacgttgggtacggcgcggtcaccatcatcaacgctttcaatccgacacacatcgttcttggagacatcatcgcgcaagccggccagccgttgctcgacgaagtcacacaagtcgtgcgcgaacgcacgatccccgaaatcgggcgcaacacccgaatcaccctgtccgccctgcccaccgacgccaccgttaccggtgccgccgccgtggcgataaccaattttctggaacatccttcgatgttcttcgacgtcgcatagcacgccgcccaccaaagaaaggaaccacccatgtccaagccaatcgtcatcgccctcggtgaaatcctgtgggatatgctccccaccggcaagcgcgccggcggcgctcccgtcaacttcgcctaccacgcgtcccagaacggcgcggaaagctacgccatcagcgccgtcggtaacgacgagctgggcgccgagctgctcaacgatgcgcacaaggccggcatcaacacgctggtgcagaccaacgaatacccgaccggcaccgtcgccgtggcactgaccaacggcattccggaatacaccatcgtgcagaacgtggcttgggaccacatcggctacaccgacgaactcgccgaggccgtgtccaaggccgacgccatctgcttcggcacgctgggtctgcgttcccaggaatcgcatgacaccatcatcaaactgctccagcatgccaaggaaggcgcgctgaagttcttcgacatcaacctgcgcgccaacttctactccaaggagctgatcgaggagctgctgggatacgccaacatcttcaagatcaacgacgacgagctcatcatgatgcgtgagatgttctccattccggagggcaacgacgaagaggcctgcaagtggttcatggatcgcttcgatctggagtacaccatcctgaccggcggcgcgaccttcagcaccatcatcgccaaggacggcgagacctccactctgctgaccccgcatgtcgaggtggccgacaccgtcggagccggcgattccttctccggctccttcaccggcaagatcctgtccggcgcctccctcaaggaagcgcatcgcgcggccgtgaacaccgccgcctacgtgtgcaccaaggaaggcggctggccggcctacccgaccgaaggcgttccggattacctcgccgcagcagccaagtaagcgtatcttctcctttcatcatcaccgattccgcatgccgtcaaataacggcatgcggaatttttttaccggttttgcgaagtttcgtcggtatgatgaatcgccgatagcataatttggtttgtcggataaaccgtggtatcttgaaatgtctggctataaagccggaaggtttgataattcaatatttggggatgatcggtttcgacggtgacctgttcgtcgcagggaagcgtgccgagaacgtagggtccgctcgtgaatgccccctacaaaagaataagtgctaaatctaaccgcactgagttcgctctcgctgcctgagcttcgcgccaggattaaccagtgggcagccgctccgttcactccccctcgtctttggggggatgttgagcgtcgtttagaagacttgccttaccggctgagccacagggccggcaagggacttttactgtagatatgctcgccatcagttgtctgcgacatcgatgggggcagaaaaaccgccgcacggccagcagactacgcacgtagaagactgagggttcggtcatcggaccggggttcgattccccgcatctccacggattgaaagccgccagaaatggcggctttttcctttatttccaacggtttccgccacttttgcaattcgctgcaattcaccctttatcgcgatatttctcaaaaacatgggcaaaatgtgggcacgaatcatgtgtcagcaatgacggctttctgtattggtaatcacatttctcgtttggtgaaacaacgcatgtcggcagcaacgcctccgtatcatcgaaataaccgtccggcgccttccaatattacaagccgccggccagccaaccatcgaaagggacgatatcatggcgaagcttacagaggaaatgaaggatttcatcagcagcaatctcgcttgggtggccaccatcggcaaggatggacacgtcgatttggggccgaaaatgagcacgttcgtcatcgatgacactcatatcggctatcacgagcgcaccgccggtcaaatgtaccgtaatctgctcgacggcagcgaactggtcatcgcagtggccaatcttgagcagaagcgaggttatcgtttccgtggcaacgtcactctgcattccgatgatgcgatctacgatgagcaggtcgccgtggccgaacataacggcacgaagaagcccatgaccattcccgttctggagatcacggagattcaggacttgacgccaggggcgaccgcaggcaagaccatcgtcaaggactgacgcccgttcaacgcatacggctaataccatccatccaaacgcggaaacgcgctctggccctcccttggaaagaaggtccagagcgcgtttcgtttttctgtcaagacaaaaagagctagatcaaagtatttccgctccgtcatgcagtgacgttgcgcaataacgctatttgatgatcggtctcaacggcgcggacacgtccacgttatgcttgtctccaatcacgttcggatcattgacgatcttgtccaccaccgctttcttgagcttcaggtccgaggaatcaccccatacgatcacgcggtctcccccattgagttccgtggtgatggaatcctgggtcgccgcggtgaccttggtgatggagttgcgcatcgattccggcagtgagctgagaatcttcaacgcttccttgataggacgcctagacaggctcgcatcgacgttctgcacttcgatgacgggaatgccttccacggaaacgccgctgacggaattgagcacgcggcccttgctgtcgaccgccgtcatatggtcctcgctggttttgagcatggccgcgggtttctgcgccttgatcgtcacttcaagcgagttcggcagctgtttcttcgacttggctgacgtgactcccggaatcgccttgatctgcttctccacggctccatccgaaaccaggaacaacgattttccggactgctgcctcgcgatgtcaagcacctgcgattcactcacccattcgttggcgccgaccacgctgatgttgcctggctccaaacggaacaccgacgagaagaggaacagccagacgacagctcccaaaaccacggctacgacaagaccgatgagcacgcgcaggactatggctcgcgcgccggcctgacggcgttccttgagccgttcgccgaaatcaaccactttcggacgtgtcatgatgccgatcgtgccggtggtctcctgcagggttttggaaaccaggtcctcgctttgcaaacgtcgcgcgtctacgaagccttcggcttttgaacggtccgcgtacccttcaatcgaccgtccttcggcatgctccgatgagatggaccgtccggaacgtcgtccgcccgactggtctgtctcctgcacatccttgccggaactgatgacccgtcgagccatcagccctcgcaatcccaacgatgcgcttcaagagcatgcaggatgacctcgtccatctgcgtgatgtcgccggcgcctacggtgaagatgacgtcgccatgatgcgcgcgcatcaccatcatctgggccgcggtgtgcatgtcttcgacgccacggatccagtcctttgccggttcatgctcaagcttgagcgcctcgtccacgatggtggccggagtcacgtcggggaaatcctcctgcttctcgcgcgcggggaagatgccggtaacgatgacgtcatcggccttggcaagcgcctgcgcgaattcagagctgaagaaacgcgtgcgggagaacaggtgcggctggaagatcacacggatcttggactgcgggtagcggcgacgggccgcatccagcagcgcagcgatttcggtcggatgatgcgcgtaatcatcgacgaccgtcacttggctgacggtgccacggacctggaagcggcgtgcggcaccgaggaacgaggtgaccgccgcggaggcacgttcgacgtccatgcccaacagcgcggccgcgataatcgccgcggaggcgttgcgtgcgttgtggatgccgggaacggtaagcgtcactgcgatgcggcgctcctcttcgccgatcagtccgcccggaatatgcagcgtgaaatgttcggctccgctttcggcggtttcgctttccgattcgatgcgtaccagcgtggcaccgttcaggtcgcccaattcggcggcgttccgtgttgaatagacgatcgtgcgtccggccacggtggcgtcaagcgcacgtagcacggcaaggttgccttcgtcgtcgccgcacatgattacggctttggtggcgtgtccggcatggtccacgaatgcggcccgatagttgtcctgcgtgccgtagtggtcaaggtggtcggcttcggaattggtgatgatggcgatttgcggatggtatttggcgaagctgccgtccgattcgtcggcctcggccaccagcacgttgcccttgccggcatggccgccgtccaaaatggcaccgtctttgccttggatggaaccgccgatggcatagctcggatcggcgagttcgccttctccggcgttcacgagaatgtgcgccagcatggagctggtcgtggtcttgccgtgggcgccggccacggtcaccgcacgtttcgcgttcatcagcagggcgaggatgtcgctgcggtgcacgatgcgctcccctgcctcatgcgcggcgacgatttccggattgtccggcttgatggcgctggagaacacgacggtgttcttgccttcgacgttcttcgcctgctggccgaattcgacggtgatgccgaggctttgcagacggtcggttttggcgcttggctcacggtccgaaccatcgacctcgacaccctgctcatgcagcatttcagcgagcacgctcatgcccgcgccaccgatgccgatgaaatgcgtggcacctaggtcatgcaccgtctcttcaggtgcgaacgacgcatgggttgggtcaagaattatggtaccggcttcacgctggttgtcagacacgattgctcctcgtaaattgttttcaagctcatttcattatggccgcacccatggtctcccacggggtgcggtcatgattgttcggccggttaatcagctggctgatcgattagcgcgagcacgcgcttcgccatgacttcggcggcgtcgcggatgccgtatttccacgcgttggcaccgtatcgggacagcttgtccggatcggcgagcagttccggcacatgaccacggacccaatccggggtgaaatcgccatccgccaccatcaagcccccttccgcgtcgaccacgggctgcgcgttgaagcgctgctcgccattgccgatcggcagaggcacgtaaatcgccggcagtcccaaagccgtcagctcgctgaccgtgccggctccggaacggcagatgatcagatcggcgcaggcgaacgccagatcgatgcgttccagatagggagccacacggtaatcgccatccgaaacgtggtcggggccaagctcgccgagcacgtcctctccggcgcttaccgacaccaaggaacgcacttcgtcgtctttgcccttaccggtcagatgaatcacctgggcatgcgcaagcagatccttggcggaagcggccacagccctgttcacgttcaccgcacccaaggatccgccggtgacgaccacgagcggacggtccggatcgacgccaagctgcgccgcggcggctttacgagtggcggtacggtcatgttccagatcggacgccaatcgtgcgattgccggacgaagcggcaggcccacgcgttcgacttcgacgcccctgcgtggtttcagtcctggctgggcgtatgcggcaccgatcatggacgcccaacgcgcgcccagcttgttggccatgcccgcgcgtgcgttctgttcgtgaatcgcaatcggaatgcccatgctgtgcgcggccgcgtatacgggtgcggacgtgtatccgccgaaaccgacgaccacttgggcctgatgccgggtgaggatgtcacgtactttggccttctcggccttccatttggctggaaactgcagcgcagccttgttgggcctgcgcgggaacggcactttttcgatggtttccagttcgaaaccggcctgcggaaccaaatcacgctccagaccgacggcggtgcccaccaccgcgatatccgcttccggttcaagctcgcgaatcacatgcgccacggcgagcagaggattgacgtggcctgccgtgccgccaccggcaagaacgatatgcttctgattgctcataatccacgagcttagcccaccatgcggcggcaggccacgcggcataccgccgccgatgcagatacttacatttcgtctacttttcttttgcttgcttcgcaactcgcatgacgggaaccgattacagtatgcggttctcggctttgacctgcggctgctccttcatcaggctgatggccacgccggcggcccccagacacatgataagagacgatccgcctgctgatacgaacggcatcggcacgcccatgaccggcagcaggctgacgacgacgccgatgttgacaaacgcctggccgacgatccataccgcgatgcacaccaacgccatggtgatgtaccggtcgcggacctgcacggccaccatcagcatgcaccacgtcatgacgatgaacagcagaatcaccatggctgctccgacgaatccggtttcctcgccgatgatggcgaagatgaaatcgttgtgcgcttcgggaagatagccccatttctcgccggaattgccgatgccgacgcccaacaagccgccggatgcgatcgcgtatttgccgtggaccgcctgatagcacacgccctgcaggtcggacggagagcaggtccggtaggccgccatgatgcggccgagtcggttggggctggtcagaatgaatccgacgataccgcatatgccaagcagcgcggctccggcaagccatttgccggggaatccgccaagcagcaatgcaatgccgccaattgcgagaataatcaagcccgtaccaagatccttgccggacatgaccaggcagaacgcgcacagatagccgagaataagcttggagtacgcgcggggcgcgccgaccttcttcacctgcttgcgcgcgttgatcagctcgttcggcatccagatgcataacgccagcttgacgatttccgcgggctgcatggtgaacacgcccggaatgccgatccatcctttgttgccgttgacttcgacgcccaatggcgtcagtgtggcggcctgcatgaccatggcgccaagcaggaaccagaagctgatctttcggtagaagctggccggcagcatcatcgtgatgaatgctatgaccaggccgaacacgcagtacatgccctgtttcagcgcctgcgcccatggcgactgcccgttggcgatcatgttcaccgaagagctggagaacaccatgatcacgccgaagatcgtgaggatgatcacgcataggcggaatccgtggaagcaccataacgggttggcgagattacgcgttccgccgttcttcaacggttctcgtgtctgtgccgcggcgccgtccgtcatgttcggacggcttgcggaagacgtgatgctacggctggcctcaggcttccccatgctcattcacccaacgctgagcctgctgcgcgaactggtttccgcgatcggcgtacgacttgaactggtccatggacgcgcaggccggagccatgagcaccacatcgccggattgcgcgtaggtgccggcagcgtcgatggcgcgggccatgacggtgtcgttgtccgtgggatcgatgatggacatgggaatgtcgggagcgcttgccttgaacgcgtccagcattggctgctggtccttgccgatgatgatggccgccttgatggtgtgcgcctggtcggcgacgagctgttcgaaacggcttcctttggcaagtccgccggcgatccacaccacggacttgtccgcgaagctgttaagcgacgccttggccgcatgcgcgttggtggctttggagtcatccacgaaacggatggtgccaccgtcggacgttttggcgacggcgacggtctggatgcggtggccgcccggcgtgaactgcttgagcgcggccaacgccttgtctttgtctgctccgagacccaacaccagcgccaacgcggtcagggcgtcggcgagcagatgcgggtagaccgtgccatccggctcggtcagatgcgtgaaatcggtgaccttcgccacttggaacggctttcccgcttctccgccggcaatgccggacatgtcgacgatccagccatctttcacaccgatctgcccgtccttcggctcggccaacgtgaagccgatccggcggcattccggcacggtctgggccgcgaacgccaatttggtgacgcgttcgtcgtcggcgttgtagaccagcgccttcttgacgttgtggaacaccttcgccttgtcggcggcatagttctcgatgccgccatgccaatcgagatggtcgtcggcgatgttggtgatcgccgcgcagtcgagttccagagaataggtgaaatgcagctggaacgagctcagttcgacgcagagcacgtcgttcgcggggtcgacggcggcgtgcgacacggctttgccgatgttgccgacggcgggagcggccaggccgcatgcggtcagcatttcggaggtcatttccgtggtcgaggtcttgccgttggtgccggtgatgccgatccactgcgccggcttgccggtggtgttgctgttcacgcgcagctgccaggccagttcgacttcgctcatgaccggtatgttgcgtttctgcgcctcaagaatgaatggcgtgcgcgggttgaagaccggcgaggtcatcaccatgtcggtattgtcccaatcgatttggtcgaaggaatgcaggtcggcgtccggcttcttctcatccacgcccagcactctgccggcacgggagcccagcacttccatcatgctttgcccggagacaccgagaccagccacgattacggtcttgccatccatattcatatccatcacccttcaatcggaaacgtcatttgccgtgatagcacactcatattgcgggcgtaaagccgcgcccgcaatcgtgtcacaggccggaacgggccacccaatcgccgtagaacagcaccaaggcgatcagcacgaacagcatctcgatcatccagaaccggaccacgaccttcacttccggccagcccttcaattcgaaatgatgatggatcggagccatcttgaaaacgcgcttgtgggtcatcttgaagtagccgacctggatgatgtcgctcatggtctcgatgacgaacagaccgccaaggatgatcgccaggaattcggtgtgcgtggcgatggacatggctgcgaacagaccgccaagcgccaaggagccggtgtctcccatgaagatggaggccggattggagttgtaccacaggaagccgaagcaggctacggccgcgcacgccgcgatgatggtcaggtcaagaggatcggacaccgcataggtgaagcctggatggtccgaacccttgaggtggtagaactcccagaacgcgatgatcgcatagccgatgaaggcgatcatcgaggagccggcggccaagccgtcaagaccgtcggtcagattgatggcgttggtccatgcggtcatcaggaaattcacccagatcacgaacagcacgatggccacgacacgaccggcgaattcaaagctgaagaacggcttttcgatgaagctcatgccggcctgggcgctggggaagccggatttggtcggcagaatcagcgccagcaccgcgtatatggtggcgaggatgaactgtccgatgaacttgcccttgacggtcagtccctcgctctgcttcttgcggaccttcgcgaaatcgtcgatgaatcccaagaatcccatcgacagcatggcgaacagcaccaacaccgcggaccacgacggcacctctcccctggtgaggaaccgatacagtgccgaggagcaccagccgagcaccaccgcgaggttgatgaccacgccgccaagcgtcggcgtgccgcgcttgacgagatgcgacttcgggccatcctgacggatgtactgtccgtaattgagcttgtgcaccaacttaatcagcagcggagtgcccacaatcgtcacgacgagcgacaccataatgccgatgatgagtgaaatcacctgatcttctccgtttcagtcagctatgatcggcacgacgccgattccgtcagttttgcgtccaacgctccgccagagcgctcaatccggacgcgtgggatcctttcagcaacaccactgtaccctcatggtcggtcgcaagccgggtgaccattcggtcggcctgttcggcatcatgcgcccattgcaccatcgtcgggtcggcggcaaccgccttgccgccctgcgccatggcctcggcaagcgcgtccaacgcctcgtcggaagtgctgccgaccgtcacaagcgcgtccgcaccgccctcgacggcgtatctgccgacgtcctcatgcaggcgatgctcatccggtccgagctccaacatggctccgagaaccgctattctgaacggctgctgctcggcgccggcatgccagcgcgacagaccatcgagtccggccttcatggaatcggggttggcgttgaacgaatcgtcgatcagtgtgaacgacgtttcgggcttggtgacggtggacaccgccatacgatgcgggctgatgctcgtcacgtcggataggccggaggccacagcgtcaatcggcatgcccaacgtcatcgccaccgtggctgcggcaagcgcgttcatgacgttgtgctgtccgcagatgccgagcgtgacgttggcgtgccggcctgtcttgtcttccagtacgaatgacggatggtcgagatcgtcgcagcgcacgtcgagcgcggtcgtgtccagttgcgcgtcttctttctgcggcaggccgaaccacagcacatcggccggagcgatggcgctcatcgcggccacatgttcgtcgttggcgttgaggatggtcaggccgcccggcaccagtccgcgtacgatttccgatttggcttgggcgatgcgttccgcagagccgaattctcccagatgcgccacgcccaccttgagcaccacggcgatgtccggcggaaccagggaggtgaggttggcgatttcgcccacgtgattggcgcccatttccgccaccaggaaacgcgtgccggcgttcaccttgagcgacgtcagcggcaggccgatctcattgttgaacgatccgaccggagcgacggtgtcgcccattttggacagcagcgatttgagcagatccttggtggtggttttgccgacggaaccggtgatgccgatgacggtgaacggcgattccagcgcgcgccgacgctcgatattatgcttggcgagcgctcccaacgccttgacggtgttttctacgacgatctgcggcacctgcgcgcccgcgatttcgtggtcgaccagtgcggccacagccccctgcgcgccgaccttcggcacgaaatcatgaccgtcgacgcgttcgccggcaatcgccacgaaaacggatcccggcacgatctggcgcgaatccgtgaaggcgctgatggccaccggttcgtcggtcggcacggtcgtcggcatcaaccgtccatcaaccgcctgcgcgatctccgtcaggctcatcggcatcatggtcgggctgctcactgtcgttactcctctaatggttgggtttgtgtttgatgtggagaatgtttcgttccacgtttagttcaggtcacgcgagacgcgtaacgcgcttttgatgttggctttcctcacgccggcggccagcaccatggcgatggacagggacagcgaacggctgtccgtctggccgtatgccgtcgcggcctgcgccgcaagcaggtcggattcctgggttcgtcccgcgatgcgggtctgtttgccgaccgcgcatccgaattttgcgacgagtttcgcaacctcggcatcgctcaaaccattgtcatcgcaggcaagcacatcgacgctgaccgattgcaacgcgtcctcacgcagggtctcttcatccaacgcgaggatcacagcggctgcgccgtcttcggcgcacaccgccatggtacgttgcacatcgatggccgacagaggatattccagattgaggaagcgttccaatgactgtgaatcggacgagctgatcacgccgacggggttgcccagcatgtgcaggaaatccgcgaggttcctcacttcggattccacgatctccctgttcttccccgtgatggcgaatacggccaatgcgtcggacggattgccggccatgtcgctcaccagtttgccgagctgtcccatggtgggttcggcgtagatgagcggaatctggatgtcgtcggtttgaccgcgcagcgcatggggcacaatcgcgccatatgctccctgctcctgagcctgcgacaactggtgcacgtccacatcggcggacgggacgaacagtgcgccgggacgcaccgattcgacatcatccgcgatggaagtgatcgtcacttcagccgccgacgtcggatcaagatcgaaaccgtatcggctggcaagcagccctaaagtcattcgtctgttcatggattcgctgaccgcgctcacctttccgcccctccgtgtctgaatacgtattcgctcaccaattcaccggaatagcatccgtgcgaggtgaagacgccggcacttcatacttctgcataaggaattcaccaatctccgcggtgacaggacccgccgtcaaaccgccgaagctgccttgggggtctttgagcaccacggtgatgacgaagcgtggattatccgcgggaatgatcgtcgagtaatcgctgatgatcgaggtcagtcggccgttcgctccggcgacttctgctgtgcctgatttcgccgccatacgatagccgtcgaccttcacgaaagtgttgtagtgttcagcggacgattccatggcgttgagcatctggctcgccacggattcgtcgatgacgcgtgtcgcctcgcccttggactgctgctcttcgacatgccccgcggtgtcggtgatggacttgatgatgcgttgcggctttttgacgcccttgttggctatcaccgaaaccgcgttggtcagctgcatgacgttcaccgtgtacccttgaccgaacagcacggtgttgcgggttcgcctgtcccagctatccgaggggtgcagcacgccttcggattcgcctggcaggttcagtcctgtggcctgtccgataccgaatttgctgatgaagttgtaccgctgctcgttggtcatcttgtctccggcaatgaccatgccaacgttcgacgactgttcgaggatgccggcgagcgtccaatgttcgttgccatggtccaccgcgtctttataggtctgtccttccacggtcaccgtgttcggtaccgtgaatttgtcatcgaccttgtgcaatcccagttgcagcatgcccgacatggccagcaccttgccgatggagccaggttcgaaggtctcgctcaccgcccgggaggcgcccatcttcgcctggtcgcttccggcctcggtcgtatcgctgtccgccaaagcgaggatgtcgcccgactgcacgtcctggaccatggcgatgccccaagcggaatggtatttgttttcgctgtcgctcagcactttctcggtgtaccactgcacatcccgatcgatggtgagggtgacgtcggatccgttgaccgcgtctttggattcggtcatggttccggggatttcgacgccgctgttgccctgttggtacacctggtagccgtcacggcccgtcaatgtcttgttttccatctgctcgatgccggccacgcccttgccgtcggcgtcgacaccacccaatagcgagcccatcaaagtgccgttggagtacagacgttcgttgcttagttccgcgtagacgatgccgccgaggttcagcttggagattttacgcttgaccgcaggcgtcacgtccttcttcaataccacgtattgcccgctgatcgacagtttggcgcccagttccgtggcgtccatgcccaatacgggggccagcagacgagccacggctgcggctcccgtcacgccgaccggcttgccgttgatctggtggcagttgctgccggtctgtttggtgcaggtggtcggtatgaacgcctgcgcctgttcggggttgccgatgatggtgtagcgttcgacactttgcgcgagaatcgcgccattggtatccatgatcttgccgcgtcgagccttcaacgtcacggtggtggtgcggctttgcgccgcggcctgcgccatccctttgccgttgaccagttgaatattggcaagttggataaggcaggtggtgcccatcagcgccagaacgacgccgatggccatggttttcgtcaacaggttcttgtggaagaacgtgtagatcctgcggatagggttcaccgggtcttgtctccacttgcgtttgcctgatagccgttcagatcgatggtcaatgcgcctttctgcgggaccatgcccatctcttcggccttgctcggcaatgaggcgtcaagttcgtcgagcttggcctgatcgtcctcgacgtcctgggtcagctgggtgatatgcgtttcgatttggctcgcctcgaaggaattctgcaccatttgggtacgcagcatcagtgagcccagcaggcatacaccaaggaacaccgcggcgatgaccaggtgcagcagcggcgtgctgcgggtccgcgtccatgtgatgagttgttcgaagccgtgacggatgccgttgccttcgactctgctccctttgatgacgtgcagttcgggacgcgtggtgccgatggtctcggtctggcttttgcggccggccggagccgcattcgaagcgatcgttcttggtgccgccacttcagtcccttcttccttgtctggtcatgcttgcgtaatccgcgccttggtcgaaccgtttgcgccatcgtgcgggaatcggtctggtcaattccaccgcgcgcaatctgacggacgccgatcgtggattgttggcgatttcctccgcgtccgccttgatggcgccgcgggtcagttccttgaagaacggcatcatgtcgggcggcaccacgggcatatccgccggagcgtcgaccttaagcccttggttcatgaaggctttgacggttttgtcttccaacgagtggtacgactccaccaccagacgtcctcccactgcaaggtggttggcgatttgcggcagcgtgccggcaagcttgtccagttcgccgttgacttcgatgcgcagcgcctggaagacgcgtttcgcggggttgccggcgggacggtgggcctgcggcacgacctcgtccaccaaacgattgagctggcccgacgtggtcagcggctcggtttcacgccggcgtacgatttcccgtgcgatctgcttggagaaccgctcctcgccgtatgtgcggaagatacgcaccaaatcggcgaacgaatattcggcgagcacctgctctgcggtcaggggctgcgtcacgtccatacgcatgtcgagcggcgcgtcatgggaataggagaagccacgttccgtctcatcgatctgcaggctggacaatccgaggtccatgaacaccgcgttgaccttgtcgacgccttggtcggaaagcacttgggagaagtcgtcgaatgccgcgtgcacgggcgtgaaacggtcggcaaggccatccatttccatgcgtttcgtggcgagcgcgagcgcctcggtgtcccggtcgatgccgatcaggcgggcgttggggcttgctttgaggaacgctgtggaatgcccggcgaggccgagggtgcaatccaccgcgatcgagccgggcttcgccaatgccggtgccaccaagtccacgcaatcgcggagcagcaccggctgatgaatcgtcgtcacgtctgtcattagaactccatcgccggcaatacgtcatcggcaatgtcggaatatccttgttccttgtcggccaagtaatcctcccatgcctgtctgttccaaatctcggcccgggttcccacgccgatcaccacaatgtcgctgtccagattcgcgtaatcgcggagcatctgcggcacaagcacgcgtccttgcttgtctggctcctggtcgaccgcgccggaaaggaacacacgcaggtagtcgcgtgccgccttgtttcccatggacgtgcgttggatctgcaccgcgatccgtctgaattccgattgcggcagcaggtagacgcatcgttcctggcctcttgccatcaccatgccggagcccagttggctgcggaacttcgcaggcaatgccatacgtcctttggcgtcgattttcggagtgtaggtgcccagcagcaatggcggcaagtccgccatcatgccgccggattgagccgggtcatcgtcggagacggattctgttccaatgtcatggaccattaccgcacctcctttttgcccacactcggcccaccaatccgagacactttccccactctaccccactgctcaccatttttccccacgaaaaagcaaaaatgcctcaaaatattgtcgatttctccccatatttgagattgcgcgtccgcaccgtacagttccgtcgctgtcagaccgtcgcgattcgccgcggtcactcgccgctcgtagaagccttggggtacattagagtgccttaagtttttgatgaagggacagcaatgtcgagttattccgcccagttgcgtgaggagcaacaggccgtcagccgcgcatatgatcgtctggacgcgttgagggcgcaggctcggtcgcgtctcgacacggtccgggccgcaggatcgcacggttcgcccacgcaacgcaccgaacgcgattccttcgccaccatgtacgaggaccgtctcacccagcttcgtgcggtggaggatcgcctggttttcggcaggctcgacgacgtgcatggcgcgcatcgctacattgggcgtatcggcctgtccgatgaggatcatgagccgattctcaccgactggcgtgccgacgcggcacgcccgttctatgaggcgacgccttcgaatcatggcgacatcgtcatgcgccggcatatcacgttgagtttccgggaagtggtcggcgtcgaggatgaggtgctcgacgtgcattccgatcaggtcggcgaggcgtcctccaatggcacattgaccggcgagggtgctctgcttgcgtcgcttaacgccaaacgcaccggcaagatgaccgatatcgtggccaccatccagggcgagcaggaccgtatcatccgtgcggacctcaaccaggcggtggtggtgcagggcggtccgggaaccggcaagaccgcggtcgcgttgcatcgcgcggcctacctgttgtatacgcatcgtcgcgcgttgcagcgttccggagtgctggtggtcggccccagctcgacgttcctgcattacatcgaccaggtgctcccctcgctgggtgagacgggtgtggtcagccgtaccatcgcggatctgattcccggcatcatcgccaccgcgcatgacgacccgtatgcggccaagctcaagggtgaacgccgtatggccaaggcgatcgccaatgccgtggcggctcgtgaacgcgtgccttcgcatctgccggtcatccgcatcaacggtttcaacgtgccgatggtacgtgcggatatcgagcaggccatcgccgatgccaagcgcacgcggcagccgcataacaaggcgcgcgagaccttcgtgcgcgacatgctgtcggccatgcgcaaccggtacgtcgaacggcttgactacgagccggagcaggccgagcttaacgatgtgatgcagcagttgcgtatgaacgacgatttgcgcaagacgctgaacctcgcatggctgccgatgaccggcgaatggctggtcgaccagctgttcgcgaaaccgcagcaattgcgccgtttcgccccctggctcgaagagcgtgacatcaagacgctgacgcgtccgaagggctcgcccttcaccgtcagcgacgtacctctgctggatgaggccatggaattgcttggaccggatccgaaggccgtggccaggcagaaggcgttggatgccaagcgcgccgaggaagagcagttcgccaaggacacgctggcgcaggccggtatcggttccggcatcgtcacttcgcagatgctggtggacaatatcaatggtatggacgccgaattaaccgcgcagcgcgccgcggccgaccgcgagtggacgtatggccatatcgtggtggatgaggcgcaggagctgaccgcgatggattggcgcatgctgatccgtcgttgtccgtcgcgctcgttcacgattgtgggcgacgtggcgcagacctccgcgttgggcggcacccggtcctggcgtcgcatgatggacccgctgttcggcgaacgcaactggcagctcaacgagttgacgatcaactaccgcaatccgaaggaggtgtcgcagctcgccagcgatttcgcctcgtccgaaggcctgtacatctccacggtgaacgccgtgcgtggcgtcccggattcagtcaagcgtctcaccttgcgtgacgatagcctgatcggcgacgccgtcgcgcagcagaccgtcgagttggtgcgcgcctacgtttcctccgacggtaccggtcgtgtggcgatcatcgcgccggacgatatgctcaagccgttgcgcgcacgcgtatacgcacaacttcaggatgagctcgacccgaaggaattcgacaggctcgatgcccagagttcctgggacgagcaggtcaccgtatgttccacacagaccgtgaagggtctggagtatgatgccgtgatggtggtccagcccggacgaatcgaggagaacgcgccgtcgcgtatcgtagcggcctccgatttgtatgtcgccatgacgaggcccacgcagcgtctgcttatactgcggacaaaagacgacgaaaagctgctcaagctataaggtaggaaccatgcctaaagcattgttacttgaaaacatccatcccgacgcggcgcagtcgctgcgcgaccatggcttcgaggtcgagtgcctcaagggagccctgagcgaggacgagctgattgatgcgttggaaggtgtcgacctgctcggcatccgttccaagaccagtgtgacccgcaaggtcatcgacgcgcgtccgacgctcaccgcggtcggctgcttctgcattggcaccaaccaggtggatctcgaatacgcgggcaagaacggcatcgccgtcttcaacgcgccgtattcgaatacccgttccgtggtggagctggtgatcggcgacatcatctgcctgatgcgccgcattcccgcgcacacccatcatatgaagcacggcatgtgggataagtccgcctccggctcccatgaggtccgaggcaagacgctcggcatcatcggctacggcaacatcggctcccagctttccgtcgtcgccgaggcgcttggcatgcgcgtgctgttctacgacattgaagagaagctcgccatgggcaacgcccaccgttgcgacacgctcaacgaattgctggaacagtccgatgtggtcacgcttcatgtggatggacgcaagtcgaacacgggattcttcggcgaagaccagttcgagcatatgaagcaggatgccatcttcatcaacctgtcccgtggtttcgtggcggatttggatgcgttgaagaagcatctggattccggccatctgtccggcgcggcggtggacgtgttcccaatcgaaccgaagaagaccggcgacgagttcctgaccgaccttgcggacgaggacaacatgatcctcaccccgcatatcggcggctccacgcttgaggcgcagaagtccatcggacagttcgtctcccagcgtcttgaggattattggttcaagggttccaccatgttgtcggtgaatctgccgcagatcaccctgtccgacatcaagtcgaatttccgcatcgcccacctgcatgcgaatcttccgggtgtgctggcacgcgtcaaccgtgtgctgggcgaggacggcatcaacatcgccgcccaggccttgggcacagaaggcgagatcggctatgtggtcaccgatgtggcgcagcgcccggaccagagggctctcgaccagctcgcctccatcgagggtacgatccgcatgcgcgtgatcagctgagcacgcaatacgaaacgttacgataatgcgggcggggttccaaccatcaggattggaaccccgcccgcattatatatgctgtatttgcttacggatgcgacacccgtctcacgccatcattcggaacttgcgcccttcagctcgtcgatggccctttggaagtcctccagattctcgaaattctggtagacgctggcgaagcgcatgtacgccaccatgtccaagtcacgcagcggcttgagaatcgccttgccgacctcatcagatttgacttgggccaatcctcgtgaacgaagatcctcctcgaccttctgccccagcatcttcagatcgtcctcgttgatgggacggccctggcatgccttgcgcacgccggaaatcaccttattgcggtcgaattgctcgacgtttccggaacgcttcacgaccaatagcatggtcgtctccaatgtggtgaatcgcttggagcatttcgggcattcgcgcctgcgacggatggagtgaccatcgtcgctaatacgggtatcgaccaccttggtgtctggattctggcaaaacgggcaatgcatgttgtccagaatagactgagcccttgaaataagccacgcttggcggcccctacgcctcatggggaacaatgaggcgctgccccgcatgcaaagacaccgtatcaaggttgttcagccgcatcagttcatccaccgtatctccgacattgccaccctccggagtgatgctcgccgcatacctccacaaggtgtcgccgggttgcaccgtatacacgacgacagcggtggaatccggcgcggactgcgcacttccgggcgcgatgaatccaaaaagacaccaggcaagaccggccgccatgatcgccatggcgattcgatttgccacatttccgatattcgccgcaccgttcaccacgccactccttttcgaacagctgttctatcgaacgcttgttccaagtatggcacatatgttcgataaacgcaaacacacctcgaacagatgtttgattttatcggcgtttcgcgttatgcttctaaggaactacgaaaggagcccatcgtgagcaccatccccttcacgcccaagaagagcgacgaacgtccggatgaaagcacgttgaccgaccgccagcgcaaggtgcttgacgccatcaaaacgcatttggccaagcagggattcgctccttcgttccgtgagattggtgaggccgcagggcttaaaagcccgtcatccgtcaaacaccagcttcaggttcttgacgaaaaaggcttcatccgcatgaacgcgaacaaggggagggccatcgaagtggtgaacctcaatgacgaggagccgaatggaaaagtcgcccaggtcatcccgttccccagtcaggacgatgcatgcggctccatcatggcctcgcatgacgttccactggtcgggcgcatcgccgccggcgtgccgatcacggccgagcagcatgtcgatgatgtgatgaggcttcccgaacggcttaccggcaccggcaatctgttcatgcttgaagtgcacggtgattccatgatcgacgccgccatttgcgatggtgatttcgtggtggtccgcgagcagaacagcgcggagaatggcgatatcgtcgccgcattgctggatgacgaggccacggtcaagacgttccgcaaggatcacggccatgtctggctgattccgcacaatccggcctactcccccatcgacggcacgcatgccgagatcatgggcaaggtcgtcaccgtgctgcgcaagatctgattgctttcacacgttaaacggcaaagggcgtcgaacataccattttgaggcatgtccgacgccctttgccataccctttgccataccgcgcggttgtgcattcaccttgcgaatccatcaagaatgaacgcgagggcatttcaaaatgtcgtcgcattcttgaagttcgggagcacggttcaggaatgcagttccttgcggctgtccgaatcgtatccttcaggttcaagctggaaggtggtgtgcggcacggatacggggaagtgctcacgcaggcagttctgcaattgggagaggatgtcggcggcatcatccatggtcagcccgcgctccactaccacatgggccatgacgacgggcatgccggtagagacggtgctggcgtgcaggtcgtgcacggccaccacgtgcggcacctgctcaagatgttcgcgcacctcgtccagatcgagttcctgtggggtttcctccagcagcacgcgcacggcgttgcgcagcagcacgaacgcccgggggatcatcatcaatgcgatgatgccgcccgcgacggcatcgaagccggcccagcccgttgagatcagcacgatggctgaaacgatcacggccacggaccccaatgcgtcgttcatgacttcgaggaacgcggctttcatgttcatgttgtcctcgctttgccccgcgaggatgaagatcgaaccgacgttggcggcaaggccgagtatgcccatgaacagcagcaaccgcacgtcgtgcacttcgtcggcggctccgccgaacagcctcatgccggcttcgacgagcgcgtagatgccgacgatcaggagcacgagcgcgccgaccgcggcggtgagcacttcgagtcgcgcccatccccaggtgcgtttgttgctaggtttgcgttgcatgagcaccgcggtgacggtggaggcgatcagcaccgacatgtcggtgagcatgtggccggcgtcgaccagcagcgccagcgatccggtgacgatggcgctgaccacttcggcgatgaacaccgtggaagtcagccccaatgacatcatgagtcttttctggtgttcggccccgcttgcggcggtcgtggcgtccacacccgcatggctgtgtgccatgatgggtttcctttcgtcgtctttggttcgatccgcggctattgaaaccgcttctcaataccattttcattcgtctcaaaacgcaggaaaccccagtccgaaggctggggtttccaagttctgctgacagtctagcggctcaccgctcccctgtcaataaagtcaaaccgtcaattaaaaaccgaactgggcggcggtttccttcagcgtctccgcggagcgcttcagggccgcgagctcacggtcggacaccggggtgttgatggcggtattgacgccggaacggttgagcagggtcggcacggacatgcacacgtcggagatgccgtggaagtcgtgcagcatggagctgactggcaggatgcggttggagtcgcgcatgacggcttcgatgatgtccacgccggacatgccgatggcgtagttggtagcgcccttgccgttgatgatcttgtaggcggcgttcttgacttcctggtggatctgctcacgcacttcggcgtccagcggatcgtggcccggcagcggggtccagtcgcacatcgggacgccgccgatggtggcggaggcccacagcgggacttcggaatcaccgtgttcgccggcgatgtaggcgtgcacgttcttgacgttgacgccggtctgctgcgcgatcaggaagcgcagacgggcggagtcgaggttggtgccggagccgaagacctggttggccggcaggccggagatcttctgggccacgtgggtggcgatgtcgaccgggttggtgatgagcatgtagatggcgttcggagcgaccttcacgaggcccggaatgatggccttgaggatgttgatggtggcaccgaccagctcgaggcgggactggcccggcttctggcgcgggcctgcggtgatgacgatcatgtcggcgtcacggcagatctccggatcgtcggagccatcgatggtcacggtcggatagaagctggagccgtgctgcatgtcgagcacttcggcctcgacgcgttccttggcgatgtcttcgagcacgatctcacgtgcgacgccacgctgagcagcagcgaaagcgagagtggagccgactgcgccggcaccgatgatagcgagctttgtgggcttgattggtgaatccaccatgtgctttacctctctttgagcaagaagaacgtcccgcgttgtggcagggtattttctttcgatttcaaccctactttatccatacagcatgacgtttcgccgtgaatccgcatgatttgcaaccactgaaaagtgattttcgtcacagcttttgtgagcgctcacatacactgcgcccgttgaaatgcagctgttgcaatccgttgcagcgtttgcacggccgctccggtaaacgtcatcgggaacggcttgcgcggaagctcagtcgatggcctgctccacgatctgcgcggccagctggtcgtcgacctccgcttcgagcatcatgccgtcgtcgcggtattcgacgttgatcaccttgccgtattcgcgcacgcgggacatgagcgagccggctgtgtacggcagcagcgcctcgacgtgcacgttcggcgtgggcagcatcgattccacgtgctcgcgcagtgcgtcgacgccctcccctgaaaacgcggagacgatgtgcgcttccggcatcagcgcctcgatacgttcgcgtgcggcctcgtccatacggtcggctttgttgaacgccacgatcgtggggatcgtctcgacgccgtcgatgtcggacagcacgtcgttgacggcgtcgatctgggagaacgggtcgggatgcgagccgtcgaccacgtgcacgatcaggtcggcgtcggcgacttcctccaacgtggatttgaacgcttcgatgagctgcgttggcaggcggcgcacgaaaccgacggtgtccacatacgcgtacagtcgcccgtccttggctttcgcacggcgtacggcggtatccaaagtggcgaacagcgcgttctccaccagttccgcggaaccggtcagccggttggtcaacgacgatttgccggcgttcgtatagccgaccacggcgacggtcggcaggccgaagcgacggcgcgcgccacgtttgacgtcacgcgcgggcgccatctgtgcgatctgccggcgtagtttggcgattctgctgcggatcacgcgacggtccatttcgattttcgtctcacccggaccacgcgagccgatgcccgcgtcgcctgccgcgcggccgcccgcctgacgcgacagcgacccgccccagccgcgcagtcgcggcagcatgtattcgagctgtgccagctccacctgcgccttgccttcgcgcgaagtcgcatgctgtgcgaagatgtcgaggatgacggcggtgcggtcgaccaccttcactttggtggcgtcttccaatgcgcgtcgttggctcggcggcagatcatcgtcgacgacgatggtgtccgcctcgtcctgcgccacgatgccggccagttcgcgcgccttgccggaacccacgtatgtggccgcatccggcttgatgcgatgctgcagcagaccgtcgcacaccacggcgcccgcggtttcggcgagcgcggcgagttctcggagcgattcctcggccgcggcctgcgtggtctcgcggctggaccatacgcctacgagcacgacgcgttcgagcctgactttacggtattcgacttcggtgacgtcctggatctcgcccagacccgccacatgcttcaatgcgttgcgggattcgcgttcctgccactgttcgtcgtgggtttcgcgaaagtgttccccgccgtcggtatcaagcagcacgtcggattggtcggcgagcactcccccgacgtcgcctgcggtcatgctctgctcgatatcgttctcttggctcaatggcacctctcacggttaaactatggtgtctttattatcatcattgtctagagacatgggcatcaccgttttcgccacgtggacgcgattaccgcgcggatgccggaggacgaacgtttgcaaggagagagcatggcacaggccgagcagtatttcgcggcggaaccgcagtcgaaggacgtgcgcaggaagctgcatgtcacgttgcgtggcaatgaggcggatgtggaagtgtcgaaaggcgtgttttccggcaatcgtgtggatttgggcacgtcggtgctgcttcgccaggcgccggaaccgccggaggagggcacgttccttgatctgggctgcggttggggtccgatcgcgctgacgttgggtttcgaatcgcccaaggccgatatctgggcgttggatgtgaacgaacgcgcgcttgagctcacgcgccgcaacgccgagttgaacggcatgggcaatatccatgccgtcaccgccgagcaggttccggccgttctcacgttcgatctgatctggtcgaatccgccgatccgcgtcggcaaggaggctctgcacgagctgctgatgacgtggctgccgcggcttaacgcgggcggtgccgcctatctggtggtgcagaggaatctgggttccgattcgctgattccgtggctcgccacgcagttgggcgacgggtttgaagtgggcaagtacgcgagttcgaaaggcttccgcgtcatcgaggttgtgagggcatgagattcgaatatccttccgaactgccggtttccgcggctcgcgacgaaatcgccgaagccgtcaagtcgagccaggtggtgatcgtctccggacagacgggttccggcaagaccacgcagctgccgaagatcctgcttgagctggggcgcggttcgcacggcaggcagatcgtgcacacgcagccgcgcaggcttgccgcacgtaccgtcgccgaacgaatcgccagcgaaatgggcgtgacgttgggtgaggaagtcggctatcaggtgcgtttcacggacgaaagctcgccgaagacgcgcctgcgcgtcgtgacggacggtattctgctggcgcagatccaacgcgatccgaagctcatgcagtacgacacgatcatcatcgacgaggcgcatgagcgcagtctgaacatcgatttcctgctcggctatctgacggcgctgctgcccaagcggcgcgacctgaagctcgtcatcacgtccgcgacaatcgattcggtgaagttccaggagcatttcgaacacgcgctgcatgcgaaggtgccggtcatcgaagtgtcgggacgcacgtatccgatgcaggtcgtgtatgagccgttgggcaccgcgccggcgctgatgcgttcggtgccgggtttcgaaacgggcgcgatgcccggcgacgcggattacgaggcgctgtcggccgcgccggatggcagggacggccgtgattcgcgcgacacgaacgtggacatgcccaccgcggtggcgcgcgcctgcgccgaattggtgatccattccacgcacgaccgtggtccgcgcgacattctcgtgttcgcttccggcgagcgcgacatccacgatttcgagaacgcgctgcgccgccattacggtccgcgcgcggcggatatgcgcaggccggatgcgatcgagatcgtgccgttgttcgcacggttgtcttcgaaggaacagcataaggtgttcgaaccgcatacgcatcagcgtattgtgatcgccacgaatgtcgccgaaacgtcgctgacggtgccgggcatccgctatgtggtcgatccgggcacggcgcgtatctcccgctattcgaagacggcgaaggtgcagcgtctgcctatcgagccgatcagccaggcgagcgcgaaccagcgttcgggccgttgcggccgtatcgccgacggcattgcgatccgcttgtattcgcgtgaggatttcgagacgcgtcccgaattcacggagccggagattctgcgcacgtccctgggcgcggtcgtgctgcacatgctgtcggtgggtgtggcgcgtacggcgaaggatgtgacggatttcggtttcatcgatccgccggatatgaaggccgtgtcggatggtttcaacgagctgaccgagctgaaggccgtggcgcgcaagcatggcgaggtggtgttgacgcataccggccgtctgctggcacgtattccgatcgacgtgcgtttgggccgtatggtcatcgaagccgcgaagtcgaccacgccgaacactctggcggcggtgctggtagtagtcgcgttcctgagcctgcaggatccgcgcgaacgtcccgacgagaaccgtgaggaggcggatcggatccacaaccggtatgcggacccgaccagtgatttcctgaccgcgttgaacctgtgggaccgcgtgttccaagcggatggcgagccgagcaattccgcgctgcgccgcatctgcaagaccgagtacttgagttggctgcgcatgcgccaatggaaggatttggtcgcccagctgcgcgaaatgtgccaggagttcaaattcaagcttggcgagccgattcccgtgtcccgtccaccgttggagatccgccagctgccgcttaaccagcaggcagcgcattcgctgtgctgctcatgggacgcgcagggcatccacacgtccatgctttccggcctgctgtccatgatgggcatgcaggtcacgcgcgagccgaaggcatccgatttcgctggtttgaagggtgcggcacgcgctcgtgcgatgaaacgcgcgcagaagatggcgaagaacgactatcagggcgcgcgcggcacgcatttcgccctgttccccgcctccgccgtagccaaatcgacaccgcaatgggtgatgagcaccgaactggtggagacaagccggctgtgggcgcggtattccgcgcagattgatcccgcatgggcggagccgctcgccggagcactcacccgtaccacgtacgcggatccgcactggtccggttcgcgcggctcggccgtggcgagcgcgaaggtgctcctgtacggcctgccgatcgtgcaggaccgcaccgtgcagtgggggcgcatcaatccgcttgaggcgcgcgatttcctcatccggcagggtctggtggagggcgacatccagcaacggttctcctatgatgatttcgtcaccaggaaccgggacatcctcgaggatgcagccgatgatgcgagccgcacccgccaggtggcgcagaccgtcggtgacgaggatctgttcgacttctacaacgccattatccccaacaccgtcaccagcgtggccgatttggcgaaatggtggaagacgaagcacgacgagcagcccgatctgctggatttcgatccggacaaggtggagcgtctcgccggctccgattcggtgtccctggacgactatcccgaccattggcatacgctcggcaccgacggctcccccatcgatctaaggttgagctacatctacgacccgcacgacccaaacgacggcgtcaccgtgcatgtgccgttgaaagcattgtctcgactgactccggaacagttctcgtggaatgtgccgggattgttggacgagctgatcgtcggcatgatcaagtcgctgccgaaaacgttgcgcgtgcagttcgtgcccgctccggacacggcacgcaaaatccgcgcctggatcgacaaacgctatcccgacctgccgggctccggcagccagcaaaagcctgacatcgcccccgaaaacgaggatggcatggccgcatggcccgacctgccgcacgtgttcacgcaggcggccatcagtatcgtcggcgcgcaaatccacccggaagtcctcaccggcgaactatggaacaagctcgcgccatacctgcgcatgaccttcgccgtggaacagcagctgccgcccaaccgcaagaaccagcacggccgacgacacgcgcgaggacccgtcaaaacgctcggcaccggcaaatcactcgtcgaactgcaacgcagattcgccgaacaagccaaagcctccgcacgccacatggtcgaaaaacaagcccgaaacgcaggagaccaaggcaagttcgtcgaacaagccaacctgctcaacaaagcgggagcgaccaccgaagcacgcgccaccatgctctggcaaggcgcgctcgacacgctgcgcctgcccggtgaacgcatctcctcacgctggctcggcacggaagcgctcatgctcgcctctgccccctacaagtccacgaaggagctcaccgaagacctgcagctggcagccgtcaaacggctcctgcccaacatcgaccagctgcccgacgacgaagcgctcgccgacgcagtgctcgatgtgcgcgaagtgtacgaggacaccgtgtacgcggtggcgcatgacgtgatcgccatactgaaacggtatgcggaagtcgacaaagccgtgtccggcaaagcggacctgccactgctgagcgtgctgcagtcgatccgcgaacacatcgccacactcgtataccccggtttcatcggcaagacgccgccagaggcattgccgtccatcgaacgatacctgcacgccgacctgctgcgcctcaccaaggcgaaaaacgacaagaaccgcgacgtgcgatgggcttgggaagccaacgaagccaaacaacttgccgacaaggccgtggcgaaagcacaacgtgaaccagccggcccacgccacgaaacgctgatgaagcaggcggaaaccgtacgttggatgctggaggaattctacgtgtccctgtgggcacaggaactcggcacgccgaaaccgatcagcctgcaacgcatcaaaaaggcgatcgcctagccaccagccaaaaccccaacggattgttccgtttcttcaaacccgtcaacgcttcttgaagaaacggaacaactgcgattcacgaatcaacaaccccaccaatagactcgccaccatgacaccggcgaacacagccaacggcgtgcgcaccgcagccgccaacaccgccacccaatcggaccggctcatccgcaccgcatacgccaacaacaacgcacacgaagcaaacgtagccagcccggcccaaacaccggtctccacaccaatacccagcaactgcgcacccttcgactgccccgaatgcaacgcacccgcatactccaacctacgccggcgcacaccaaacacaccaaccaacacgccaatcgccaaccccacccacggcatccaccgcgtcgaacgattcagatacgacgcacgcgcgtcataatgcgcatcaaaccccttattcacctgcgtcacacccgcattcgacgagccggaacccgccaccaacgtggcatacagcagattttccatctgtccatcggccggccaccgcttgacccaacattcgttgaacgtcgaggcgctcgccgacaccggcacgatgaacgcgtaggcgaaacgcgtgtcacgcccatcgttcggccagtcgaacacaccagccacacgtgtggtgccttcgcgtgtccgcaatgcgctgcccacggcgagcccgaagtccttggccacgtcgcgcggcacccatacgccggacacgtcggccttggcattgccggcgatcagccggatcataccaggcgtcacgtcatacgatgagatgtccttgccgggtgtcgcgagtggcacgacctgttcgccggcacgcatcgcaccagccaaggttcccgtcattccatcgccggcgtcggacaaccggtcgcatgcggtgccatccaccgttccaccgacgatggcgttgacgtcaacgtacgcgttgatgcgctgcacggcctgcgattccaagtcaatcacggtcatcgcctcatatccgcccagcagcgttccggagagcagcactgcgaggaacatggcgaacgcgcggctcacgcccgaaccgatgttgcgcagcgcttcggaaagcaccgatccaagtctcatatacgctcccttatcggcggtttcatgcggttttcacactgtttggcgaagctcaacggtttcttgcgattcatccgccgactatttgcaaaccagcccgttgagcccgctgccgatttcgacgttggcgatcgcggacacgtcggcatcctgcgtctgcaccagactcacgcccagctcgctgcccacaatcgtcaccttcgccggcgtattagacgcattgtgggattttggtacgatgcagccgctgctgccgtcgatgccaaacaccgctcccgccggcacacgcagcacctgtaatggttccttcaatgccacggtggcatcgagaccggcctttttggtctgcatgtccatggactggaacgtctcgcttgccgacacattacgcaggaattcggcgtcggtgatttccgtgctatcggccggcaatattccattgacgccatacatgcttatggtgcgatcctgtcctaccgccgcgccgtttttcacggtgagtttcgtcaacgctcccggtatttttccgattgccgtaccgcccgtcaccatggaaccggtggtggccgtccactcgtcgaccgcgactgcgttttcaggaatccacatggtgtcggcaagcgcaagcgtgccgtcggaggggttgccgttgtcgttcatgagttgccgccagccgtcggatgttgcccaccagtaggtgtcggaaccggccacgctgttgtatccgagtcggctcagctcgttgttcagtgcgagcacgtcgtcgcccttgtctccggttttgaggtcacggtataggggtgtggcagtgttcaaggccacgaccacgcggtcgttgactttgtatgcgcctttgccggaggcgagtccgtctgcggaccagtcggcggtgacggtgccgttggcgttgccgagaagattacgttcggtggagatagtgggcacaaccgtcacttgctggctgccggagtattcctgcacgctggctggcgcggtggtcgtctcccctgccgagccgagcaatgccggcgcgcgatccggcaggagcagcgcgcatgctcccacggacacgcagatggcggttgccacggcgagcaggctccaagcccatgcgagtcgtccgcgtccggcaccgttcgtcacggctgtggcgttatgtttctttcccatgagtcgatgcctttctattcgtctattcttccaattccggttcctgcgatttgctgccgcctggcgcgtagtcggcgaggtcgagcacacggtcgcaggcgtcgcgggtgtcgggatcgtgtgtggccacgagcacgatcatgccttggccggaaaggttgttcagcacatggctgacggaatgcgcggtgcgcgtatccaattgagcggtcggctcgtccacgagcagcatgtcgggtttggagcagacggcgcgtgccagcatgagacgttgcgcctcgccgccggagaggtcggagaaccggcggtcggccgcgtattcgaggtcgaacagccccatggcttccaaggctttgagctccgcttccttgcgccgcatgcctttggcgagcagcgggaacaccacgtggtcgagcgcggtgcgttccgccacaccgtacgggttttgaaacacccatcccacacggttcacgccttcacgggttacggttccggcatatggtttctcccaaccggcgagaatcgacagcaatgtcgatttaccacaaccggatggtccgcataccgcgatggtggagccaggttccgccacgaaatcaagatgctcgaacagcaggtctgtccccgggaaccggtgggccagcccttccacaaccactcgcatatgagccccttcgcgcatcagactacttcagcggataccagaccgtctcatccgaggcggtcacgttcactccggccgtcaccaagcaggtcagcgccttcctgttatcgcgcagtcctgcgctttctccggattccaaatccttctccagcttatcggcggtgtagtctttgggctttatgccttccttgcgcagacagtcggccgccacctccttgtcattgagcagcagcttcggattgcccaactggagcctgtacacggtgttgatatccgtgacatgcagcatactgcaggatgtcagatcgtcattgagtttgcggatcgcctctttgctggcaccatcggtgttgtacgagggcagagcgtaaatgccgttgtcgtacttgtcgaacgtcggctcggcatagcctttgtctatgatgcactgcttgtaatccgcccatgcgcgttcgtagtcggcctgactcacctttccgcccgaagcggccttctccagtgcagacttctgctgatcggatattttgccgccgtcggaatccaacaacgatcgcgcataatccttcagcgacgacgcgattcgttcaccctgttgcgatgattgaccctgctgggattgacgctcccgtcgcgagctttctttcagtgccccgcagcccgtgcagccgacaagcaaagcgagacagcatatgacggcaatagctttgccacgcatgcccgttttcctcgacatcgtcatcagccccctcacaaacgacgcagccgtcaggccgccatggcccgctttacccctattctatacccccaagacttgcctccatgcgcggcatacccaatatgggtatgtggaaccaggtgttccccagcatcatccaccggctcgttgcatttaccccgttctccgcgccggaaagccatcagtcaaacggaatgcgcgcgtggaacatccatatgccgttctcgcaatcggtggaaagacttcctccgatatgctcgatttcagccgcgaactgtctgagaccatggccgccgggcaggctgccggaatgccaggcacccatatcattcacttcagtgatttccaaggaatcgtcttcaccagaaccgacacctcgtacttgcctccggaaggcacatgacgcgaaacgttcgcgtacacctcgccaatcaaccggccgatcacatccttatgataggcatacggacgcgcgcacgggaccagaaataggcgagaccggtcagcataatctgcatgacggtaaacatcaatgccattggcgaaccggggtggcacaccgcctcatagaccatcagaagttcgcacgtcatgatggccgcaagacggaacggatgtttgattcgcggcatatccgacaaccggaacgctccgttcttttcggtcatgtcagcgcccgttcccacgtttcagccatgtgatgatggcttgccgttgcgtacggcagttcagtcgtttgacgatgttctgcatgtgcttgcgcacggtggcaatggatatgccgagccgttcggctatctctccatccgtcagatactcgttcgcgcacagattcatgatggtttcctgcatgttggtgagcgtggactccgcttgagtatcgcatttcagcttcgcataagccgccatcggagtttcaaaaccgggcaggaaacatcctgaaaggacacgggagacggcttgttcgagctgcatctcgtcacccttaccgacacagccgccgccagcggcacgcgataccggttcagactgaagctggtcatgccgagaatcggcgtggaacagtccatcaaccgcatgcgacgacagacttccgggccttgcataccttccaacgacatatcaagcagcacaagagcatattggtcggcattcgatgcaaacaattccaaagcctcaacgccgctggtagccgaatcgacgatactcaccgccggaagaatccgcttgaataggtcagtcagcgcttcgacgacgattttgtcatcgtcaacaagcaatatcttcggaccaccaaccgttttccccgtcatggtacaacgctccttcccctgggaaacatccccctaccgcaatacaatacatcatttcatcaccgccccttactcatattgagtacatcgttcgcaataaccccgtaaaacaactcatatcatatgaatcaccgggccaaggcggttcgatatgatgatgaaaggtggacgatgatgtcctggatgaaacacaataaattgatgaaaacgctctccgcatcagtactggctgtcggaatatgctatggaacactaccaatactcgtgaggctctcctagattgtcaaagatacaaacaaagcagaggtatatgacaaacttttcgatgagttgccgctgcatggccatcggtctgacggtagtatcacttttgtccggatgctcaagacaagtctccgatacagcatcatctcccgaaggcggtggaactacttcttccgaaccgatcaagcaatatatagcatcggtgatcaaagacaatgacgatcctcgcgcgacgtatccgatgaccaaagcccaacgggagattctcaaacgttcggaagcggctggaggcgtgtcctctaccgattacgaactcgcttggtcccattacaaacaatgcgtggtcgacaaaggatattcaaccccagtacttgaccgttatcccaatggcctgtatttcgtcgccagaataaacgccgagggcatgaccgacgaacaacgaaacaaattcaacaaagacgatggcgtttgtttcaacacggaagtgatctacatcaatgacacatatgccctccaattgggcaatccgcaaatgatcaacgatgtcaatcaagcggccgtcaattgcttgaagagggagaatgtggcaccgaaaggctatacgaagaaactgttcgagcaagacgagaaaaaccgcttgcaggacgagcacactgagctgaattactcggatcccaaagtccaaagctgtctggccgcgctcggcatcaccactatggaaagcgataaggtgtggagacctgcgaaaacttccagctaaggcaatacaaaaaacaaacaacgaaaccccatcaaggctcgtctatcacgagaaaggagatggcgatgatgcaactgaatatgggtacatggcgaggaagcgtagccatcgtatgcttcctcgccatgcttatcggctgcacgggttgtgggacggtcggcgatcggcaggatacgcaacagcagactgaaagtgccggcagtgacgcttccaagaccaaaatcgcgaattcgataccggattacatcgattttcttcttgatttggacgccaaacccgataccaagtatcccatgagcgacgctcagaagacgattctgaaacgttccaggaagtcgggaagcgtatcgaaaccggattacgagcttgcctggtcgaattacaagcagtgcgtgaccggctatgggtatacgacaccggtgctcaggcagttctccaatggcctgtacatgatcgccatgcgggataccaccggcatgagcgaccaacagcgcaagaagttcaacgaggatgagaacaaatgctataacactgaagtcattgcggtgaccggtgtataccagatgcagatcggcaatcccggcatgctttccgatggcgaccaagccatggtcgattgccttcataaggccggtatcgtgccgaaaaactacgacaaggaagcgtacaagaaggatttggacgcgcacgccaaaaaccagcccaccacagtggatttctcaaacgcggaaatgcaaagctgttgggtggcgaacggcgcgtcgttcggggacgtcaatgacaccgatcagtggaagccgctcggctgaccaccgtgttccccgtcatatatcagcatagaagtctcgttcctgcgcgacgaacgggcgcaggaacgtggtgatggcgatggcgcataccaggaacagcgcgccgacggggccgagccacatcagtccgaaatggccgttgattagacctccgaccgcggaaccaagcgcgatgccgatgttgaacgacatggagttgagcgacgcggccaggttcaacgatccgggatgcgactgcgaggcgacgtccatatacagcacttgggacgcggaattttgcaggtacatgaacatgccgagcaccaccagcagcagcgcgccgtataccggtacccaatgcgccacgacaagcgacgccatgagcaccgcatgggcgcagtagatgggacggatgtgcgtcagcggctccactcccctgccccggtccgcgagcttgccgccatacaggttgctccacaggcaggccgcgccgaaaaacaccagtccgacactcaagtactgttcaggcacatgcacttcatcgcgcatgatcggagtcaggtatgtgtagaacacgtagctggcggccgcgccgcacaccacgtcgagcacgcccaactggatgcggcggtcgaagaacaggcggaactgcggcaggaatccgatcttcacgatgtggctgttgcgcggcagcgccacgaccataccgacgatgagcataatggtgagcacattgatcatatggaacgcccaacgccaaccgaacgtgttggccacccatgtgccgaccggcacgcccaccacggatgcgatggagaagccggagaacacccatgcgatgaatttcgtacggaatctgtccgttgtcacatcgggcgcgtacgtcatggccacagccaccaacgttccggataccaaggcgatcatgatgcgcgccaccaccagaaccgcgtagttgggcgcgaacgcgcataggatgttgcctgcgaggaatatgccgatcagcgtcagatgcgtagcgaatcgcgggaaccgtgccgacagcgcggatccgagcggcgtgacgggcgcgtacacgaaggcgaacagggacaccagattgccgaccgtcacctccgatatcttcagatcggctgcgatgtcgggcaggatgcccaccacgatgaattcactcatgccaagcatgaaactcgatgcgatgagaatcaccaccggcagattgaagaaccgttccttgtcgattcgcacttttccgctctccgcttccgttcgcattcccctattcgtttcccgatatttcgatttgtttagcatcgcttacgtcaatcgattgacgatttactttcttcaggaaaggataaaccgcgcgcgatacaatacggtaccgatgacacgcaagatgacacgcaaaaccaatcggagcggaaacagcggcgggaaaaccggcggaaacaggtcacgcaaccgcaaaacaagcaatcgcaagacgggcaaccgcaaatcccttgttccaaagaatctgcgcagaaaactgcgcaatacatggaacaaggcgagcctcaagcaacgcatcggcatgatcgccactacattggtggcgacggtcgcggcgatagccatcattgcgggcctaatccgctttgtcggctggcgtgtgcaggtcagtgaggcgaaagcggcgcagagcgagatgcgatcgctgtacgatttcaacccgggcaacatcatatccgacggcgcgttcttcaacggcaacgcgttaagcgagcggcaggtgcagaccatcctcgaccagcagggcgcgacgtgcaccggcgacaagtgtctgaagaccatgacgttcaccacgcaatcgcaagcggcggacgaatattgccaagcgtataagggcggacagaacgaaagcgcggcagccatcatctataaggcgggcaacgcatgcggcatcagccagaaggtgctgctcaccgtactgcagaaggagcagcatctgctcaccgccaccgatccaagcgattttcaattcaaatctgcaatgggcctgagctgtccggacgacgcgaactgcgatgcgaaatacgccggattcttcaaccaggtgtacggggcggcgaagcgataccagtactacgtgcgccacgaatcgcaatacgcgtaccatgccggcgctctcaactacgtacgatacaatccgaacgcaggctgcggcggcagcgacgtctacatcgagaacaaggcgaccgcgctgctgtacatctacacgccctaccagccgaacgaggccgcgctgaaggccggcgcaggcgaaggcgacgcgtgctcgacgtacggcaaccgcaatttcgcgatcatctacaattcgatgttcggcaatccacgagactgatatttcggaaaaattccggtagaatacctctaggaaggaatgaaccgaaggagcctcatgggcctgctcaacaatgacaactacatcgacccattcaagggagccgattacatcgaccccggcaaaaacgccgaaaaactatccagcaacgtggaccgcgagcatgcacaacgcgaagcatacgaacagcagcgctacgccaaacaacagcagacaccccaacgcacccccacacccccacaggagccccgtcacacaccacaacaggcgctcgtcaaccgacagacaccaatcagccgaacgacacgcacaagaaaatcaagaataccgataatcatcatcgccatcgcagtgctgacgatcatcgcgatgaacctcgtcggcacaatcgtcagccacggcggactggactcaatagcggacagacttgatccgaacaccgaaaaatatgagcagctctccgaacagaagaccatcaacgaaaccagcggcaatctgtactcatacggtgggatggcgctcaccgtcaccatcaagaacatggaagtcggaccaactgacatcaacggacagccgacggtgaaagtgacctatggatgcaggaatctgagccggcgcgcgatttaccccaacgccgtggccgattccatcgtcacacagaacggcatagagttacgaaaagcggtggtgacgggatacaacgggaatcttgatctggccagcaagaaaatcaaatcaggtgaaacatccgaaaaagtcagctatcatgtactttccgacatgcagactcccatcgccatgcaggtaagcaatttcagacacaagaatctggttcgttccgcgttcgccttcgatggcagcaacgagacactgaccagaatcgactattccgacgtgccggaagcaccgaaggtcgataaagcggcgttcgtcgaagacggacgcgttgaagaattgaacggtaccatacttcatttccgattggactctcttgagatacagcagaatgatgaagacgaaccacttatggtggcccgcatttcctggtaccttgagaacacttccacgtatgaaacattctcataccatgcgagcgtcaatgcacgacagggaaccgagacgcttgaccaggattatctgtacggcgacgactctagcttgattctcagagcccaagcggatgtgctggccacctctatctacgcttatgagctggatgatgagcggacctctgtgaagctcaccattgaaggcgatgacaccgtactgttcgagaaggatttcgaacccagcagtggcactgtggtgtagtcgacgcggcttccatctcaacaagaagcctaatcccagctccgcataaacgacaccgaaggggccgtcatctggaaatcaacccggatgacggccccttcgatgtcgtttatgcactaacctgcgattacgcaatcacagcttcggcagatacttcttcagctcgaacggggtgacctgcttgcggtactcatcccattcctgatgcttgttgcgcaggaagtattcgaacgcatgctcgccgaggacgctcgcgacgaaatcggatttctccatgatcttcagcgcctcatcaagcgattccggcaacggctggatgcccatggcctgacgctcggcgtcggtgagctcccacacgtcgtcgctggtgggctcgcccagctgcatttgcttgtcgatgccgtcgagaccggctgcgagcagcacggaatacgcgaggtacggattggcgaccgggtccaacgcgcggaattccatacgggcggagttgcccttacctggcttgtactgcgggatgcgcagcaacgcggaacggttgttatggccccagcagatgtagctcggcgcttcggcaccgccccacagcctcttgtaggagttgacgtactggtcggtgaccgcgcagatctcggccgcgtggtacaggatgccggcggcaaactgacgtgcggtgacggacatattgaattcctggccggcctcgtagaacgcgttggcgtcaccttcgaacaggctcaagtgcgtgtgcatgccggagcccggagcgtcggcgagaggcttcggcatgaagctggcatggatgcctcgctccagcgaaatctccttgacgacggtgcggaaggtcatgatgttgtcggccgtggtgagcgcgtccgcatatcgcagatcgatctcgttctggcctggccccgcctcgtggtgcgagtactccaccgagatgcccatctgctcgagcatgttgacggtggcgcggcggaagtccatgccggggctgcgcggcacatggtcgaagtagccgccctcatcgatcggcttcggagtctgcgcccagtcatcctgcttttcaaacagatagaattcaatctccggatgcacgtagaaggtgaaacccttctccttggccttggccagcgcttgcttgagcacgtggcgcgggtcacccaaggacggctcaccatcaggcgtgagcacgtcgcagaacatgcgcgcggtgccctgcgggcctccgcgccacggaagaatctggaacgtcgacggatcgggcttgacgatcatatcgtcttcggacacgcgggtgaggccttccacggcggaaccgtcgaatccgagcccttcctcgaatgcggcttccagttccgccggcgcgatggccacggacttcagtgttcccaacacatccgtgaaccatagacgaatgaagcgcacgtcgcgttcctcgaccgtgcgcaaagcaaactcttgctgtttatccatagtgtccaatcgttccatgcgcatgttacgaacgtcgttaacacatgccgtgtcgcgacatgtcagcgtgcgacttcgagggcttcctccagcgtgaaggcgcgcgcgtacagcgatttgccgagaatcgcggcgtccacgcccagttcggcgagctccttgatgttgcgcaggtcgtcgagcttggagatgccaccggatgcggtgaccttcgcgtcggtgcgggacgccacttcgcgcagcagctcgatgttcgggccgctcatcatgccgtcgcgtgccacgtcggtgaccacgtaacgggagcagccgacggagtcgaggaacttcatggtctcgaacaggtcaccaccttccttcacccagccgcgggccgcgagggtgtggccgcgcacgtcaaggccgacggccacgcggtcgccgtacttcttgatgacggaagcggtccagtcggggttctccagagccgcggtgccgatgttcacgcgggccgcgccggcttcgagcgccgcgtcgagcgaggcgtcgtcgcgcacgccaccggacatttcgatgttgaccttgtcgcccagttccttgacgatggcgcgcagctggtcacggttgttgccggtgccgaatgcggcgtcgagatcgacgaggtggatccattccgcacccgattccacccacgtgcgggcggcttccagcggggagccgtagtcggtttcggagccggattcgccttggcgcaggcgcacggccttgccatcacggacgtcgacggcgggaagcagcgtcaaagacatgtcatacctttcgttgcgttgaacggttttcggccgttcaacggatcttgcgattaccgatttgaattcacgattttgcgattgttgcgattgccttgcgcgaatccgcgttcagaacgtcgcgacccagttacgcagcagctgcgcgccggcttcggcggatttctccggatggaactgcgtggcgaacaacggtccacgttcgtaggcggccacgaatcggctgcgcccgtaggtgcaccacgtcacatgctcttccgcgtcgccgaagtccagctggtcggcggaggtgtcggcaggcgaagcgctcatcgcggcaaaggagtgcacgaaatagaatcgttcgttctccacgcccttgagcagcacggaaccttccggcgcttcgacggtgtcccaacccatgtgcggcaccacgtcggcgtcgagcagctcgacatcgcccttgatcagaccgagaccgggcgtgccgtctccatgttccatgccacgttcgaacatgatctgctcgcccacgcagacgccgagcaccgggcggccggcgcgcagacggtctttgatgaccctgtctccgccgacgcttttcagtccttccatgcatgcgccgaacgcgcccacacccggcaccaccagtccgtcggcttccagagcctgacgatggtcggacgtgagggtcacgtcgaggtcgagattggccagcgcgcgcaccatggaacgcacgttgccgaaaccgtaatcgaacaccaccacggaagtcatgggcgctctccttcttttgcttgccgaagaatccatccttcggggaaaaacttattcgatgcttgacgaaccacgaccgaatcgcgtgtgctcggcgaggatcttcatggcgtcatcacgggtcaggcttgcggaatcgacggtttccacgccggaatcacgcaccccctgaacgtcggtgatgcccagcagcaggtcttcgacgaacggcgcggtggaggtgaacagcaccggtggcgcgaacgtctggccgaccttgccttgcaggtacatcgtcgcctcgagcttgtccgcacggttgatcgcgaggacggcaggcatgccggagaccacggtggtcagatctttgatggccgcttccgggccatcgccgtcgagattgcgtaatacagcgaccgcgccttgcggtgaggcgaggcattgcgcggagatgtcggacagttggcagaacgcggcgaacaggcgtgcggaggcaagtcgggtgatgatcaccgcgactttcgcacggttgcccagcagtccctgcaactcgtcgtcgaatgacagcgagttctcggcttcggacagtaccgcgtcggcttccttcgattgcaggccgtcctgcgattcgtcggaagacgcatcggaattaaccgtctcatccggctgatcgaatggcacctgcgcgggagcatcgttctgttgggcagcttcctcgtcctggaattccttttcgaagccggccatggccgcttccagctcctcttcgctgaaatgcatgccgtcgtcgttggtcttccccaagccgtcgaaaccgttcaaatcgtccttgtcgtcggacatcacagcgcgcccttcgtgctgggaatgccgtcgacgcgcggatcgggttcgatggcgaaacgcaatgcgcgggccaaagccttgaattcggcttcggcgatgtggtgcgggtcgcggccggaaatcacgtgcaggtgcaggcagatgccggcatgcatggcgatggattccatgacgtggcgaacgagcgaaccggtaaaatgcccgccaatcatgcagtattcgaagccttccggctctccggtgcacacgcagtacgggcggccggaaatgtcgacgacggctttggcgagtgcctcgtcgagcggcacggtggcgtcggcgaaacggcggatgccacgcttgtctccgagggcctgcttcagagcctcgccgaatacgatggcgatgtcttcgacggtgtggtgcgcgtcgatgtcggtgtccccggtggctttgattttcaggtcgatcagcgaatgcttgccgagcgccgtcatcatgtgattgtagaacggcacggatgtgtcgatgtcggttttgccggttccgtcgaggttgagactcagctccaccttggattcgctggtttcacgaacgatggttgcagtacgtgccatgttgcgactccttttgcgatgttgcagttgcgatattacagctacgatattgcgattgcggtggttgcgtcttccgcagccaccgcgattctgttctgtttcaagcttattgccgaatactgtcacgaacttccgttccggacagtatcccagcttgcgttccggcttgttcagccctgttccacgatgcgcagcacttcgaccaacgcctcacggaaccgtgccatttcctcgtcggtgcccatgcacactcgcatccagccttccggaccgacgacgcggatgagcacgccgcgcttcaacagttcgtcgaagatgcggtcgcggtcgtcgaaatggccgccgaagagaatgaagttcgactgggtttcggccacttcgagcggctggcccttgtaggtctgctccttgagccatgcggaggtggcgttgcgggtttcgcgcaggtgcgccacgcggctcagctgttcgtcggtgtgttcgaacgcggcgagggcggcggcctgggtgacggcagacaggtggtacggcatgcgcacgatgcgcacgcagtcgatgatgcccttgttggcggccaggtagccgacgcgtgcgccggcgaaggcgaacgccttgctcatggtgcggctgacggcgaggttttcgtattcgccgatgagttccagcgcggtgggcgtgcccggatctcggaattcgatgtacgcctcgtccaccacgaccaccggatgcacgccttcggcggcgcctgccacttcggcggtacgggcggcttcgagcacgcgcttcagatcttccggcttgagcggggtgccggtcggattgttcgggctggtgagcacgatcatggccggcttgacctcttcgatcgccttgatggtggcgtccacgtcaagcgtgaagtcggcgttacgatgcgcaagcttccacgtggtgaacgtgtcgcgcgcgtattccggatacatggagtacgtcggatcgcagccgagcgcgatgcggccggggccgccgaacgcctggaacagctgcagcatgatctcgttggagccgttggcgccccacaactggtcgacgctgagcttcacgcccgattcgcgttccagatatgtggagaacgccttgcgcagttcgatgtgctcgcggtccggataacggttgagcgtcggggcgatctccttgacacgctgggcgatggtttccaccacggccggttcgggcgcgtacggattctcgttgacgttgaggcacaccggcacgtcgagctgcggcgcgccgtacggttcttcgccgatcaggtcgttgcgcagcggcagatatgccggaatcgcgttgctggaagtctcgctcatcggaggccggcctgctcttcctgttccttgatggtcgccttgttgtacgggtcgtcgatgaagcggctcagcacgcattcgccgtgtgccggcagatcttcggagacggcgaaggcgttcacacgggcggcgagggtcttcagtccctgctcgtcgtattcgatgacttcgaccggcttcatgaaggtgtgcacgccgaggccggcggcgaagcgcgcggtgccggaggtcggcagcacgtggttggaaccggacatgtagtcgcccagcggaaccggggagtacgggccacggaagatggcgccggcgttgcggatcttggcgatcacggcatccggatcagcggtctgcacttcaaggtgttcggccgcgtacgcgttggccgcgtcgatggactgttcgatgccgtctgtgaggatgatgccggactggcggccgcgcagcgacgtgttgacgcgctcggcgtgctcggtgcgaggcacgcggtacttgaggctctcctgcaccttgtcggcgatgtcttcgctgtcggtgataagcacggaaccggcgagctcgtcatgttcagcctggccgatcagatcggcggcgagccagcttgggttggcacccttgtcggcgatgatggcgatttcggtcggaccggcgacggcgtcgatgccgacgatgccggagaccatgcgcttggcggtggcgacgaagatgttgcccgggccggtgatcttgtccaccggatcgcacagaatctcgccgtcctgcggttcggagcccttggcgccgtaagcgaacatggcgatggcctgagcgccgccgaccgcgtacacctcgtccacgccgaggatggcgcaggtggcgaggatggtcttgtccggcaggccgtcggagttgctgcggctcggcggggtggcgatggccagcgattcgacgcctgcggcctgcgccggcaccacgttcatgatgacggagctcgggtagacggccttgcctcccggcacgtacaggccgacgcgctgcaccggaatccaacgttcggcgacgcgcgcgccttcggccaggtcggtgtggaacggggccggcacctgggatgcggatacggcgcggcagcggcgcacggattcctcgatggcggcgcgcacttccggatcgagctcgtcgacggcggccttcatggcctcgaccggcacacgcagatgctcgggacggatatggtcgaacttctccgcgaagtcgcgcagggccgcagcgccgcgggccttcacatcatcgagaatcggctgtacgagctcagtggcctcgttggtgcccatctcggcgcggggcatggcttccagcatttcagctcgagtcagcttcttgccgcgcaggtcaatgattcgcatatagttttcttcgctcataacgccccatggtaacaacgccaagtcacgagaacgtcccgtcgtctcacattcagccgcattgtgagacacgcagatccgccgttttccatgccatgccgatttccgcgaaaaatatatgccggtcgacgccattcagcatcggccggcaatcaaaaacctgttcaggtcaaaccgttcaagtcaaaccgctcaggccaacggaagcgagctcggtccgaagagaatcttgatttcggcgaacagcgacgtgtcgcgtttgacgcggaaccggtctccgaacgtcagcaccttggcgttgcctttgtcgtccatcaacgccagtttcacctcgcacgggccgggatggctggtcagaatctgcccgagccgccgcacatgcgactggtcgagcgcgatcggcggcagcacaatcgtcagcggacgttcatcctgcgcctccaacgtcggcacggtgaattcggtggcgcgcatgctcactgtctcatcgcgcttctccacctggccgcggatctgtaccacggtgtcgacggcaagctcgggcgcggcggcctcgtacaccttgccgaagaacatgcattggatggaactttccagatcctcgacggttacgatggcccacggattgccctttttcgacacgcggcggtccacgttcgtgatcaggcccgcgatcgtcacctgctggccgtccggcatgcttcccgcgcggtcgatcaggtgcgctatcgacatttcgcgcaacgacaccagaatcgactgcatgccgctcaacggatggtcggacacgtacaggccaagcatctcacgttcgaagttgagcttggttttcttgtcccactcctccacgtcgggcacctgcaccatggcgtctcccatggcggaatcgttctctttggaatcgtccaggtcggcgaacaggtcgaactggccttccgcctgcttgcgtttcaggccgacgaccgaattgatggccgtttcgtggatggtgaacagcgcacgacggttcgggtcgatcgagtcgaacgcgccggccttgatcagcgattccaccaatcgcctgttcagcgcctccaacggcacgcgtttgatgaaatcggtgaagttcacgtacttgccgtggccgttctcacgttccgcgatgatcgcatcgaccgcgttcttgccgacgttgcggatggcgccgaggccgaatcgcacgacgtcgccgactgccgaatactcgtacaccgactcgttcacgtccggagaaagcacctggatgcccatgcgtcgcgcctcgcccaggtacagcgcggtcttgtctttgttcgtgctggcgccttgcagcagggcggccatgaactccaccggataatgcgttttcagatacgcggtccagtaggagatcaaaccgtatgcggccgaatgcgccttgttgaacgcgtagccggagaacggcacgaggatgtcccacacggcctgcgcggcctcttcggaatatccatgctccttcatgccggcgaagaacggaatcttctccttggccagcacttccggcttcttcttgcccatcgctcgacgcagcacgtctgccttgcccagcgaatagccggcgaggattcgcgccgcggactgcacctgctcctggtagacgatcagaccgtaggtctcgtcgagcacttccttaagcggttcggccacttcggggtggattggcgtgatcttctgcagaccgttcttgcgcttcgcatagttggtgtgcgaatccatatccatcggacctggacggtacagcgcgatcagtgcggaaatatcgttgaagttgttcggcttcaacgttttcagcagcgagcgcatgccgtcggaatcgagctggaacacgccgagcgtgtcgccacgggacagcaggtcgtaggtggggcggtcgtccagcggaatcttcgtatggtcgatgcgttccttgccgttcgcctcgatgttgttcagggtgtctcggatcaccgtcaagttggaaagtccgaggaagtccatcttgaccagaccgagcgtttcgcacgtatggtattcgagcgtggtggtgacggtgccgtcggtacgttccagcagcggcgacgtgttggtgatcggctcgctgcccatgatggtggcgcaggcgtgcacaccggtctgacgaatcagaccttcgatgcccatcgcctcgtccgtgatgcgtttcgcgtccgggtcggaatcgtacagttcgcggaattcgcgtgcttccgcgtatcgtttcgcgcttgggtcgaagatgtcgtgcagcggaatgtccttgccgccggtctgtgcgggaggcagggctttggtgatcttgtctccgacggagaagtcgtatcccatgatgcgggcggagtccttcagcgcctgcttggttttgatggtgccgtagatcacgcactgcgccactttgtcacgtccgtatttctcacccacgtagtcgagcacgcgtccacgaccgtccgggtcgaagtcgacgtcgatatcaggcagtgagacacgttccggattgaggaatcgttcgaagatcagaccgtgttcaagcggatcaagttcggtgatgcccatcgcatacgcgaccatggcgcctgcggcggagccacggcccggccccaccatcacgccgtgggccttcgcccagttgatgtagtcggccacgacgaggaagtagccgcagaactgcatctggcagatcacgccgcattcgtagtcggcctgccgcagcacttcgagcgacggcttgccgttgtaccggcgttccaggccttcctcgaccttcttcaggaacagcgacgtctcgtcccagccttccggacagtcgaattgcggcatgaacgcgccgtcttcatgatcgtcgaacatgacgttgcagcgttcggcgatctccaacgtgttgtcgcacgcttcgggaaggtctttgaacagttcgcgcatttcctcggcggatttgatgtagtagccggtgccgtcgaatttgaatcggcccggctcgtccagcgtggagccggagttgatgcacagcatggcgtcctgcgcgccggcgtcttcggcacgcgtgtaatgggaatcgttggtggccagcagcggcgcgttgagcttttttgcgatgtcgagcagcccgtcggtcacttgcttttcgattttcaggccgtggtccatgaattcgatgtagaaattatcgcggccgaaaatgtcttggaattcgccggcggcacgcaacgcgtcatcgaactggcccaggcgcagacgagtctggatgatgcccgacgggcagccggacgaggcgatgatgcctttcgaatatttggcgaggatttccttatccatacgcggatagcgcatgactcggccttcaaggttcgcgtcggtggaggctttcatgaggttgacgaggccttcgtcgttttctgcccacatggtcaggtgggtgatgacaccgccgccggacacatcatccgggttacggcggcgatgcagcggatccagatccggattccagttggtgtcccagctcacacgggtggggtcctgacgtgcggtttccggcgtcacataggcttcgatgccgatgatcggcttgatgccggcgttgaccgcggcgctccacatctcatacgcgccatgcatgttgccgtggtcggtgatgccgacggccggcatgcccagttccttggcgcgcttgaccagatccggtattttcgatgcgccgtcgagcagcgaataatgcgtgtgattatgcagttgcacgaaatttgcggaagtagccatgcgttccaatttagctgggcttcatgacggcgtggagtcgtttctggccgtccggccacacttttatagggactggtcggcgtgccgtgcgcgcatcacgtcaagcgcatgctgcaggtcggcgggatagtgcgatttcaccgtggtccacacgtgcgtacgcggatggcggaattccaattgcatggcgtgcagccattgccgttcaaggccaagcgcctcgctcagctgcggattcgcgccgtacatggcgtcccccgccaacggatgcccgatggatgagaaatgcacgcggatctgatgggtgcggccggtttccaggttcacggatacgagcgtggcttcgccgaaacgttccatcacgtcccaatgcgtgatggcctctttgccggccggtgtcacgcagaagcggaagtcggagactttggcgcgtccgatcggcgcttcgatggtggctttgtcttctttgagattgccctgcacgagtgcgtgatatgttttgacgacctcatgttcggcgaactgccggcgcatctccacgtacgcaagatcggacttgcatacgagcatcagtcccgatgtgcccacgtcgagtcgtgacacgatgccttgacgacctgccgcgccatatgacgtgatgtgcactcccctgtcgatcaggctgccaagcaccgtcggaccggtccatccgacggatgcgtgcgcggcgacgccgaccggcttgtccaccacgaccacatcgtcgtcctcatagacgacggccatgtcatgggcgatcggttccggttcggaccgttcctcgacgatgtcgaattctacggtttcgcctgcctgcagggtcgacgatttggaaatgtccctgccgagcacgcgcgcctgtccgctttcgatgaggtcggccgccttggcccgggaaatgccaagcattttggcgaccgcgacgtcgaatcgtttgccgacgagcgcgtcgggagcgggtacgagacggctcatgctgctttcgccccgtcgtcggttgcgttcgcatcatcaccaagcgtcttgccgttggcctcgtcaaggtccttttggctgaacggttccccgaggaacagcagcagcaccgccgcaacgcccgcgagcatgaggaagatgtccgccacgttgccgatggaccatccgtagttcaggaaatccacgaccttgccgttgaggaacccttccgcgtagatgacgcggtcgatgaggttgccgaacgctcctgcgaaggcgaaggcgaacagcaccgtccatttcatggaaatggtgcggacggcaagtacgaccaacgccacgcaggccgccatcgccagcagggaaatcagccacgtcatgccggagcccatgccgagcgaggcgcctggattacgcaccaatgtcaacgaaagcaggccgggaatcacgcgtatggtacggccatcggccaatgcggacaaagcccacatcttggtgagctggtcaatcgcgatcgtcgcgatcgcaatacacgcaaagacggccacgcggtcgcgcagccgtctttgatcattcttcatgatgtcagacacaggctaatctcagtcgttgttgtcctgagggtcctggtcgtagttgttcgtatcggacacctggttgacgagctggccgaggaagtcggtgagtcgtgcacggtattcggtttcgaactgcttgaggcccttgatgttgccttcgatgaccttggtctgggtctcgaggttgtcgcggacctgctgggcgtagtcgtcggcagcggtacgggtcttcgaatcgtagtcgaaggcgcgcttctgcacttcggcttcgtagttgtcggcctcggtgtgcttgtcggagaagtacgtgtcggcgtcctgggtcttctgagccaggtagccgtcgccctcttcctgcttctgcgcgaagtaggcgtcgccttcctgctgcttctgctccagataagcgtcgccatcctgctgcttgccggccagataggcattgccttcctcggtcttctgcgcaaggtaggcgtcgccctcctcggtcttctggttcaggtacgcatcgccatcctgctgcttctgtgccagataggcatcgccatcctgggtcttgccggacaggtagttgtcggcgttggcgcgggtgtcggtggagtactggtcagcctcggaacgagtgcggttggagtagtcgttggcgctgccgatgatctcttcgtacttgcgctggctttcctcggtgatctccttggccttggccttgcccttgtcgacgtactggtcgtgcagctgcatggccagcgtcagcatggcggtggcgcgctccggctcggtattggcgcttgccgcggcacctgcgatcttctgcaggctgccggtttcggtgctcggctcggacttggcgacctgttcgcgcagctgtgcctcgcgaatctgggaatccttcagttgctgggcaagctgctggatctgcatggcctgctgcttcacctgggcatcctgctgctgggactgggcagcatgctcctgagtgagctgctgggcctgagcgacctggtcctgcgcttcctgaagctttgcggtgagctgatcgatctgctccttctgacgctgagccacgaccacctgctcctgggccgatgccagctgacgggacaggtcctcggtctgtgcgcggaacgtgtcacgctcgtgctgcacggcggtaagctgctcgccaaggtcggcctgaccggccgcttcggctgcctgggcggtgagctgatcgacctgcgcggacagacgatcgatctgccccttgagctgctcgttctgggaagacagcgcacgattgctttcctctgcctcggaaagcttggcggccgcggcctgagcggcctgagcggcctggtctcccgcaccagctgcctgctcggaggcggacttcagcgtcgcgttctcctgctgcagggactggatctgagcattcaactcggaaatcttggaattgagtcctgcgacatccgggccaagagactgcgtggcctgtccgccggcaactgcctgcttgccaagggcttccaccgtctcggttacctgatcgaggaagtcatcgacttcatcgacgtcatagccttccttgaaccttacggtctggaaagtatgctccctaatatctttcggcgtcaacagagccataaatccttacacctcgctttgggcttgatgccttactgttgttgctttcagtgttcgactctagcacgaaaccatagatattttgcggaaaaacggttttttagaggtgctaaataaggaaatcaatgaccacaagaacgaaataaagcacaagatacgcgacgtcaaaatagatcggtccgagcggaacgggacgaatatactgccgcaaccaccttaacggcggctccgtcagctggtagatggcgtcgaacaacgaggccacgattccgcttggccgccacgtcggcgacaatgccaacacccagtcgagaatcatgcggacgaacagcaccaggatataggcgttgaccagaaaatggacgacgctaccaattaccgagagaatcacgttgcaactgtatcaagcgcgcataacaagatgcccccgctttcggtgggggcataatcgtctgatttgtgcttgctctgtgctacacggctcagtcggcgaacaggtcgtgggccggacccttgtcttcaggctcctcgaccttgatgttcacttgggccgggctcagcaggaacacgcgcggagtgacacgttcgatggagccgcgcacgccgaacaccacaccggcggagaagtcgacgatgcggtatgccacggcttcggccacacctgtcaggttcagcaccaccggaatgccgtcacgaatggcgcgaccgaccatctgcgcatcgtcataggtcttcggatggatggtggtgatgcggctcactctacccccctggaacgggttggactgctcacgcggagcggacggcgtggaagcggaagccgaagaggaaggcatcggggtgacggaatgatccgaatcgaacgaggtctcgccggtgtcgacgtcatcctcgaaatcatcctcgccctcggcgacgtcggacattcccaagtacgacatcgcgttcttcatgaaacctgccatgtatgttcctttcgcgtctacgcgttgactttagcgcaggaaatccggaatatcgaggtcgcccggatcgttagccgaaaccacttcatgctcggtggtctggtcgaacgaggcgacgttctggtccggagtggacggaatgtagctggacagcggctgcacctgcggcaccgccggagtctgcaccggctgcggctgctgggcgggagcctgcacgccggcggacaacgcggacagcggtaccgtgttttccttggccgcggccggcttttcttcggccggctggtcgggcttcttagaattggcatcgaaacctgccgcgatgacggtgacacgcacctcgtcgccgtaggcgtcgtccagggacaggccccagatgatctgcgcttccggatggatggccttctgcaccagcgcgaccgcggctgcggcttcctgcagcttcaggtcggtcggaccggcgatgttgatcagtgcgccatgcgcaccctcgatgctttcctccagcagcggcgagctgatggcgatttccgcggcctgcgtggcgcggtcctctccccgagcggaaccgatgccgaacagcgcggtgccggcaccacgcagaatcgcgttgacatcgttgaaatcaacgtggatgtacgaattcgaggtaatcaggtcggtgatgccctgcacgccggccagcagtgcggtgtcggcggtcttgaacgcgtcgacgatgccaatggtgcggtcggacagttccagcagtcggtcgttcggaatgacaatcagcgcgtcgacttccttgcgcaggttctcgatgccaagcgccgcggaagcggaacgctgcgggccttcgaagctgaacggacgggtgaccacagcgatggtcaatgccccctgctgatgggcggcacgcgccacgatcgggctggcgccggttccggtgccaccgccctcaccacaggtgacgaacaccatgtcggatcccttaagcgcctcttcgatgtcggactgatgatcctgcgctgccttggcacccttctccgggtcggcgccagcgcccagaccacggctggaggcatcgttcagcgagattttgacatctgcgtcggaacgcagcagatcctttgcatcagtgttgatcgcaataaattcgacgctttgaagaccttcagtaatcatgcgattgacagcgttgccgccggctccaccgacaccgacgaccttgatgttggtcttgtcgttgaaattgtcagtctgggcaatctcgctcaccattgtctcctgttcactcacgtacatgcacaactctatcgcaatcgcgccgatgatacgcgcacttttccaggcgtgtaccaccgttttttcacttttttgctgtcagcatgttcattctgcctgcgttgaccccttcagtcatttgtacacggctcttcgaacatgcgtgacgggctttagtagctggcatccatcgggtcatccccgaacagcgcctcacgctcctcgtgcgtggtttcccgggattccaaccatccgtaaggcagatgcacctttttggcgaagcgcacgcgcccccttggcttgtcggcgatgcgttctgggaaccgaatgttcgggtcgagtctgcctatctcgcgccggacatcctcaagattttcacattccatgaacgcacggcgtgtggaaccgcccacggggaagcccttcagataccacgcgacgtgcttgcgcaggtcatgcacggccatccgctcgtcgccatcatagaattcggtcagcagttcggcatgccgttcgatcacgcggcacacgtcgcccagcgtggggtcgacgcgctcgtcactgccggcgaacgcgttcttgatgtcggcgaacaaccatggacggccttggcagccgcggccgatcgcaacacccgcgcaaccggtttcggcgaccatcgccaacgcgtcgttggcaccccaaatatccccgttgccgaagacgggaatatcaagctcggaaaccagctcgccgatgcgggaccaatcgaaatgcccaccgtaatattcggcggtggtgcgcgcgtgcagggtgacggccttgcagccttcctcctgcgcgatgtgcccggcttcgaggaacgtctcgtgttcatggtcgatgccgacgcggattttggccgtgaccggcacgttggccgcgtcgcacaccttgaccacgcgttggatgatctcacggaacaggtccgtcttccatggcagcgcggaaccgccgccacgacgcgtcaccttgggcaccgggcagccgaagttgaggtcgacatggtcggccatgttctcgtcgatgacgattttcgcggcctgctccacaatcgagggattgacgccgtacagctgcagcgagcgaatcttctcgctgggtgcgaaacggcataggcgcagggctttcggattgcgggccaccaatgcgcgcgcggtgatcatttccgccacgtacagaccgtcgggaccgtagctttcgcagatcacgcggaacggccagttggtgacgcccgccataggcgaaagcaccaccggcgtttcgacgtgcaccggacccaaatcaacgggctttataacgggaggaaccgacggccgttccgcgtcggtacgcgggtcgagcacgtcggattcctcgtaggcattcacaatgctatctggcataggtcagacttgttccgttcgatatgaccgattcggggcgatcagtacaggccaccggcttcggcgatcttgacggactcaggccaagcctcgccgcccatttcgaccggcatctgcggcacgctgacgcgcttctcgccgatacgctcggcgatgtagtcggccaccttgtcgaggctgacgcgctcctgctgcatggtatcgcgttcacggatggtgacggcctggtcgtcgagggtgtcgaagtcgacggtgacgcacagcggagtgccgatctcgtcttcacgacggtaacgacggccgatcgcgccggcctcgtcgtagtcgatcatccactcgttctggcgcaggtcggcggcgagcttctgcgccacgttctgcagatcgggcttcttgctcaacggcagcacggcggccttgaccggagccagacgcgggtcgaggtgcaggacggtgcgcttgtccacaccgcccttggtgttcggagcctcgtcaacgtcgtaggcgtcgacgaggaagcacatgagggaacgggtcaggccggcggccggctcaatgacgtacggcacgtacttttcgccggtggcctggttgaagtagctcaggtcctcgccggagtgctccgcgtgcgcggacaggtcgaagtcggtacggttggcgatgccttcgagctcgccccaatcggagccctggaagccgaacttgtattcgatgtcgacggtgcgcttcgaatagtgggccagcttctccttcggatgctcgtagtggcgcaggttctccggcttgacgccgaggtcgaggtaccactgggtacgggcgtcgatccagtactggtgccaggcttcgtcctcgccgggcttgacgaagaattccatttccatctgctcgaactcacgggtacggaagatgaagttgcccggggtgatctcgttacggaaggacttgcccatgttggcgatgccgaacggcggcttcttgcgggaagaggtcatcacgttcttgaagtccacgaagatgccctgcgcggtttccggacgcaggtagtgcagggagttctcgtcctcgaccgggccgaggtgggtgcgcagcatcatgttgaagtcgcgcggttcggtccacttgccgcgggtgccgcagtcggggcacacgatgtcggccatgccgttctccggcagcttgtctccatgcttctcggcgtaggattcctcaagcttgtcggaacgctggcgcttatggcagttgaggcactcgaccagcggatcgttgaagacggccacgtggccggaagccacccacacgggggtcggcaggatgatggaggtgtccacgcccaccacgtcgccacgggtgacgaccatggagcgccaccattcgcgcttgatattgtccttcagcgccacgccgagcggaccgtaatcccatgcggaacgggttccgccgtagatttcaccggcgggaaaaacaaagccacgacgcttggcaagggatacgacttcatcgagtttggatacagccacaatgcaccttctggattgaatggtttggggtctttacaagcgcaaagcctaccgtcacatgctgacagttttgcctgacagtttcacggcatggcaagttacgtgatttccgatggggatgaacggcaaattgatgcaagaaccgaatgaaaacacataagaatatgtgaagatacataaggggcttcccgcgaatgcggaaggccccatgtaatggataaggagagaatcgttctttatgtattgtttgtcactgcttggtaacgttctcgtcttcgacggtgtcattgttaagcagcagcgaccagattttacaattgatggtcacgttgttcttggtggcgtcgccgcccttatcaagggtgtacgtcacatcttcaggaacggcaatacggttgatgccctgcacggcctgaacgaagccacgcattgcatcatagctgccattcgcagtaatgctcaccggaacctgcacaagccggccggctttgatggttccctgcatttcggacggcacttcagcggtggtggcctcatcgaaggtcacagactggatggagacgcccgcaccatcagcagcggcattcaacgaatcgatgaattcgttttggttatagccgtcaggaatctggcgctgcagctgacgcaaacgatccttctgcaggccgatcgtctcgctcgccatacgcagcgtttcaatctggtcacgcgttttcttgttgctttcttcgatctgcgcagtctgcgcgtcggcttccttaatgtgtgtaagacgcggagatacgcctacaagccatgtcaacatcagcaccactacgatgccgacggccagtgcgatccatgcgattttatgcttgttcatgtttcctcctgcttatcagttggacgatccgctggcatcggatgaggtgtcagtcgactggttggcagaagcatcagactgtccggacgcagccttgtcgaggcttgcgcgcagcttggcgagcaaatcacggttggcctgggtcgcgcctgctgagttgtcgcttcgcgaagtggtgttgccgtccatcaccagtgaaatcgttccggtatacgtgtaggtggtgccaccttcactgtcattcttggtaatagagctcacataacccgtcttgtacgtggggatcgaggcgaaattgttgataaagtccttggccgagtagaaattcggcgattcgatggtgaagtccgcggaaatcacgccgttaccagaccacacagtggacgtattgtcggaggatgaggacgaattgttcgatgaagcgatctggaagcttttgagttccagattcgtatactggccgccttccggaagcgagctgttcagcgaatcggcgaccttcatccagtccatttcgtcatacagcatggcaatcttcgccttctgcgcatcgtccagcgaattcaacgtgtcttcgacatccttgaactgcgctttctccttttgcagggaaatggtcttctgttgagccacttccacacgatggtccgcccatgtggattgggcgaacatgaacacgctgaccaccaaagatacaatgagcacgccgatcagcacatacgttaacaggtatttgatggctcgatcgcgattcaatccgacgatggaacgcggaatcaggttagcgcgcatggtccagtcggctgggttttccggcgcggtgctacgcttgccgataccgcccgccttcaacgcattgctgatatcggagacgttcatggatagcagggtgcccttctgaccgtccgaagtgtccggataggcgatttccttgccacgtccacggtgggagttggccttgtttttcttggatttcatatcaagtttcataatcacactcacctcggcttctttccgatgaccagtcccagcaccccgcctaaatcgaccgcgtgcgccacaatgttctgacgttcgacttccttggacagcttgaagcggatgaacggatcgccaatgcgcaccatcttgttgatggagcttgccaacactgggggcagaccaatgagtcgcgcacccgtaccggtgaggatgatgccgctgatggtgctgtccgcatggtcgacgtcgtacatgttcaacgtattgcgaataccgacgatgagctgcgccgtggtttcacgaatgacttcctcggctttttcgagacgttcgtcaccggtcacattttgcagaccaatctggtttttgatgcgttccgcgtcttcgaaggagatgctcagcgcattggcgatggcgtcggacacgtcgtcggcaccggacggcacgacgcgcatataggcgggttttccgttattgagcacgatcacgtcggtgcagttgccgttgatgttgaccaccgcttcggtctgcgcctggttggtgtcgctgaacaggcgggccaacgcgaacggaccggcgtcgatggaggtgatcacgaaacccgcttcttctgcggtatacgcagttttttccagaccaccgcgcagagtggctacgagaatgccatgaagctgcttgccgttctgctcgtcatccactacagacaacggcacgaagtcaagttcggattcctcaatgggcaatggaatcatgcctttggcctggaatggcagggttgagcgtaaatcagctagggacatgtaggggaagtccgcctcacggaacaccatacgacggctcgaataaacgagtatggtgttctcacgcgggaacttgaagcgttgcaccaacgttttcagtagaccggtgaccacttcggcgtccaccacttcgccatccaccacagctccaacgggcagcggaagcgcctggaagtgtttgatggtcggcgaatccgtataggggtcggctatgaccgccgctcgtatggcgtcgctcgcaatcgacagcgccgttattgctctcatggtctctccttatatatatgggtcttgtatgcggatgcgttacgcaagtccggtgagttgcaggtatagtgtggcgattggtacgccggcgaaaatgccaagccatgcgccgagcagcatggatggcccaaaggggatgcctccatgaaggtcgacctttttgctggccagcaataccaagctgatggcaccgccgatgaagaacgcggcgaacgatccaatgatgaattgcggccagccaagccagccaagcagcaatccgagaatgaacgcgagtttgatgtcgccgtctcccatgccacctttccagatgagtgagagtacgaaatagaacacgaagagaatcagcgcgcagagcgctccgcgaccaagacgattccactcccctatgccaaacgatgccacaaccagcagcaacaccgttgcgataagcgtcggcagtagcactacgttgaggatgagatggtggtccaagtcgatgaacgctatgacgatggacacgcatgcgaacacgtacagcacgggtagtgcccataacgggtatgcgccgaacagtccacctgcggttacggcaaggaaggacagtccgccaagcgattcgaccagcggatatcgtgcggcaatcggttctttgcagtgtcggcatttcgcgccgagtgccaaccaggaaaagatgggaatattgtcataccaagcgattggcgattcgcatttcggacaaaagctacgtttcggattggtgatgcttatgtggttcggcacgcgccatatcactacattcaggaaagatccgaagatacagccgatgatcagcgaggccaccagcagtatcaccacggtaggaacatcattcactatatccatgccgttcaccactttctggatgtgacggtggagtccacaaccgctgagaaataggtactggtagggatagatacggtggtcgttgtcgttgtccaagtaatgctaccggccgatccggcatcaccataattcactgaagcgttccatgcctgcgatttcaccagtcgcccacgcacgtcacgatcggttccgcatgaaaccattttcagcatggaatgaccgtctgagcgattgtattgacggtctttcttcccattgctttccacatagtctcccggatagatttccgtcaggcacatgccttcgctggtttggaaagtgccagcccatggatactgcgtcttgccgccgtaactcaccgctttcgaggtgttgtgctcgttgtatcggcggaactttgtggcgtcacttggattgtcggtcaacgacaccttactgccggaaacatgcaggtacttcgcgttgccgttggtgtcgtgcagggctatggtggtgtcgatgccagtgccatcggcgctggcatcttcggtataggagacgcggtcggatgtgaagttgaagttctccttgtcggcggccgaacagtgagaggtcgagatgaaatcgctgccttgccctatgatcgtcttctggtagcatttcgcgtcgaagtccgcactatgcacgtcgcaggtgtcggcgtatacgtcgttgccgtccatcaccatgcagaatccggatgcggagttcaccatctgattggtgccgtatcccgcttcgcctgcttggctgaaggatgcggtggcatcctgcatgtcggcaccgttcgaaaagtaggaatcgctgaagttataggtccattgcgacaccatatacgcctgactgtagggggtggctttgatattgccgcccgcgaaatgtggatcgccactgtcttgtgggctaccgccgtaatgggtgacttccagacgctggaacttggtctttttgccgctctgcacgccggctacggcatatcccttgctttcaggcagagcggaatcatatgacgctgcttgcgcaccgacatcgcccgtcagctcgttccagtatccggcgttgatgaacccgttgtagaagttccatttctggtatttgttgagcagactgttcgggtcgttcttctccgtctgctgcgcaaccttattcggatccgtataataatcgccctggaagtggactccgtatgatgtgccgcatggctgcaaggtggtcggagtcttgccgtcggtgtcatcgatactcacaccggtgacgcacaatcccatattcgaggccagacggatggaattgtccttgtagtacacccacgtgttcaatgaggagtacgcaccgtcagcacggcattcctcagtatattggtaggtgtcacctcccgcgttgtatgcggcgggcagtaccaccagcccagaaccggcttgaggcgatttgcttaaatcgaggttctcggcaatgcttttcttctcgttggtaaccggaatggtggtggccagcatgcaggtgcggttcactggattcaacgtcgcagtgccatcggacagctggctggtattggtgcgtccggaatccaccgtgccggagaatttaacttcgccggttggatcggatccgatggacacgccatcataatccacgggtacccatacaaactgcgaatcgagcctgttgtagggcgccgcggcataaaaacccatgcccatgcggccgccaacacccaaggcacttgaatgattcgtggtagtggagtccgttttggcttcgatcctgcataccgcacgcttcatggcctgcgggcttttggtgttgcctgctgtacggccgtccttataccggttgatgaagcccgtggccaccacttcggcatactgtaggtttttcagatcggatggagagctgatcatctccgccgatgcgtcatccggattggtgtcatagaaattgatgcgcacacgataggacaggtcatccggcgtatatgaagccgtatccgatgtttttaccgtcttatttaaagcaacatgattcaacaacacggatgcgccatcatatttggcaaattcaccatccttggaactgtcgttcatatcagcatcaacggcaggcaacaccttctgcaaatcatcaagactcgtagaaccttgcaacttcgccagagtctcattgatatagctcaagccgacttcaaggccggattcggccgcatagttggcttgggaattttccttattgttcttgtaaggaatcgcctgggcaagcagggtagtcatgaccagagcggatgtggtgagcaccaccatcacgaacagaacggccagcatcatggcggcgccgcgctcccccatgcgttcgcgtaatgccgcacggtacctgcggttgagtctggaccacaatccgttctgcttcatgcttgctcctatatataaaggtatgtttcgctcgggtactcggatatcagatcaggcctgaccattgatggcgtcgaacatggagaacatcggcatatacaatgccaccaccatgaagccaaccaccacgccgaggaacagaatcatcagcggttccagcaacgaggtgagctgtttggccatggattgggcctcttcgtcatacgctcggcccgcgctggacagcattttgtcgatggcgccggagtcctcgccaatggccaccatctgcaccagcatgttcgggaagatcttttcggtgctcatgctgtcggccagacggtagccacgttccaccaaacggcccacacgcttcgaagacgaatcaatcacatagttgcccgacgtcgatccgacgatatcaagtgcctggagaatcggcacaccagaagcgagcatggaagagaaattattgcaaaagcgggccagggccacgttggtgtccagcttgccgaacaccggtgccttgagcgtgaacggatcccaccaggtgcggatgatgtctttgttacggttgcgcttccagaacatggccagcgccacgacggccacaatcagcaccggaagcacgtagggcatcactttgccgaggtccaccaggatctgggtcacgaatggcaactgggcattcatggaatcgtacatgctggcgaacatcggcacgatggtgagcagcatcaccatcaccaagatcagggcgatgcccaacaccacgataggataggccatggcacttttgatctgcccttggagtctcacatccgattcgaagctgtccgccacagtgagcagcgacttgtctagaaaaccgccggtctcgccggcacgaaccatattgaccatgatcggcgggaacagggaatcaggatccgcctccatggcttcggagaaggacgagccgccttccacttgcgccacgcaggcctgcaccgccttacggagtttcacgttctcgatttgttcggtgacgatgttcaaggctcgaatcagcgagacgcccgccgccaccatggtggcgagctgccgtgccgttactgcgaagtcttttttgcttggatatttctcgaacgccttgatgttgatttcagtattgagaccggtgccggcagccgtgtcagtcagatcggtcggatacagtccgagttttttaatgcgttcgatggcttggtcgcgcgtctgcgcttcgaccacacccttctctttacgctggccgtcgaacgagacgcccttataacgccactgcctggtgccgttatccattgaaacctgcgcgtcgttgccggccatgattccccttcggattgtcgaatactggtatttatttgatacgcgaaatgtcggggacgtttgtcgtccccgacattcaattcaggcgattagtaaatcattttttgacgccattatctgaaacaacgccgttgtcagatttatacgtatacgtgtgcgttccagcgttgtcgttagtacctgtaatttcataagtattatcggcattcagcttaatacttagcgtcacaccgtcagtgacggtaatcttattaccatcaatcgtgcacggggctttggcggtgcatgcggtcagtgttccggtagtcgtcagaccgctgacctttccgttatttgcagtagaagcagtttcaatgacaagactggcattcttgacatccgattgggtttgagagttccacgcggatttacgctgattcagataaatcgggacggaaatcgcggcgaggatgccgatgatgatgacgaccacgagcagttcgacgagggtgaagcccttttcgcccttggcacggcggttgagtgcgttacgtacgctcttcataatgaacccttctttccaattggaaggacataccgtgggaccgtccaacttcggatggtccacagcgattcttctttgcgttatttccccttgtgggggtggctggctcacataaccaacaactctcagcgtagtcgtattgacatcgtttgcagtaccagatgcagtgcaccaatcgcaccaatgatgtttcatccaccgttttcatcacaaccccgaatcaaactttttcaatacgattgcataacccctcttcacacaatcaccaccgtccgattccgtaacatgcgttgagtccgtcggtctaccggtgtatctcttcgtttgaaacgtttaccctggaatagttatattttcaatagtgtttcagaaaatattttcagcatgttttgacgaaaattcatcaaaaaaccatttccccccgggcgcgtcgggggtatttgaaagtatagaaaaagggctcccccacaagggagagcccttacagacacagtcattcaacgacattgactgaagtcgaccgaagcactcgaacccacattgcgagctgtaaacgatgtcaatgtgttcgaggtgaccggcttgccacccacatacgaacccgtcaccggcgaataccgcaccacgcgcgtaccgccatccatgctgaacagtttgtttttgaacagcgaatcatcggacgttgaagcggtactgttgttcatcaccgccgccaacaccgcatgctcgctccacgctccccccgcaccggttgcgtatggtctggtttttaccacgacggaaccataatcatcaactcgcccgccggaccacgtggcctctgtgtactcaatcacagcgcattgccgaatcccatcggcatcagtggtcaccaaagtcaacctgtcaccgctggcagcctcttccacaccttcggcattgcgaacatatcggtccagagcctgcaccgatgtagctatttccgtagccgatctggtgcggatagcatcggctgtggtggaatgcaaatattgtacgatcgacaccgtgaacatggtggaaacaatggcaaaaataaacaatgaaaccatcatctccaccagggtaacgccgccttcaccacgagcacgcctacggagcgcacgtaataatcggcgattcagactgaatccagagttcttctcttccataagccgtcccgctccttcaggccccgatcacattcagcagttcattggtggtatacacggccgttttgtctgcgccaatattgtccgaccaggtgacgcctaccaccacgcgtaccatcggcatatacgttttcgccataaaggtgaatcccttagtaggaatgttgtcctgactcaggatgctggatcgcagcgaggcgtcaggagtaccgtcaagaccgctaatggacgcatgcccgtcaatacccagttccgaagcggttctacaatccatggtgccgctttcccgatagcacttctcaatcacggtgttcaccgtatatgtagtatgtttggcgtctttgcccgtggtagtgcgcaccggctgaatgtacttgctcgtatcggcatccggagtggccgtagcctccaaatccgagaattgtgaggtgatggcccccactgccgtgagattcgcatgtgctttcttcacatcatccacacccatgccaggcagcaaatccgtgtaataggaggatggcgcagaagtatgatccgctatctgtgcgcgcatgcgttcgataccatcactacccaaagcaatggctgctgaacgctgctgctgggcataagaagtacgaatcgcagtaatcgcgaactgtgcggcggcaagacctgtgatgctcagcaccacaatcgccaccaatacctcaaccaatgtgaaacccgactcgccacgtttcggcaatcgtttgacgttatgtattgcaagccctgtcgcggcatcatttaccgccctacgccagctgtgctccatgagcagctccttcatgcagtatcaccccatcatcggaggcaacaggaaaaatcaccgcagaaaaggcggtgcatgaatatctgtactgtatcacgattccctgccaacgttttcacacccttccaaacaccacatgacaattggcgtttcagtcacaaagccgctaaactatgcgagtagtagtgcacaacactgcaatcgttagctcacatgaccatgaacaactgaacattctcaggcccgcaaacacctgtgttcgcaaagggccataagtcataccgtgcgttccggcgcatggtccaggaggtcattatgagcgacgccggttcgggaagccgtttccctttcctcaagcgcaatcgaaacgacgacacgccgagcgatttctcacagcgcatggatttgaattccccggtcacaggagaaatcaaccagattttcacgccgagccagccacgccatgccgctgcacccagcgacgccactagcgactttcccgccatgcccacatccaccgaaggcatggacgaaaacaccgaacgcgaatatgccatggcgctagctcaaggcatgagcctaccgttcgtagacctcaacgaataccaagtagacaaagaagtcatcagcatggtgccggacgacctgtgccgtcgcaaccagctgctgccattgtccattgtcaacggacgcatcaccgtggccatggccaacccgaaaaacttcgccgccatcgacgacgtgtccgccagcaccggcatgccggtcattcccatggtggcgatgccttctcaggtgaaggacgccatcaaccggtacctgcgcgccaacgcggagctgaccgagctgtcgcacgaaatcgcggcgaccgccaagaaggaagtggacctcgaatccgacagcggcgaggacgcctcccctgtggcacgcttcgtcagcctgctcatcaaccaggccatcgacgaccactgctccgatatccacatcgaaccgcaggaagacggtctgctcgtgcgctaccgtatcgacggtgtgctgcacgtgttccaaaaggcgccgaaagccatgacccaaggtgtgatcagccgcatcaaggtcatgtccgatatggatatcggcgagcgccgtaagccgcaggacggccgcatcaccgtcaagcacaatggtcagaaggtggatcttcgtgtggccgcactgccgacggtatggggcgagaagatcgtcatgcgaatcctgagcacgccttcgggcaatctcaaggtggaggatttgaatttcagccagcggaatttcgacgtgttctccaaggcgtacaaccgtccgtatggtctggtgttggtcaccggtcctaccggttcgggtaagtcgaccacgttgtatgccacgttgggcgatgtggcgaagccggaaatcaacatcattacggttgaggacccggtggaattccgtatgagaggcatcaatcaggttcaggtgaacaacaaggccggtatgacgttcgccgcggctctgcgttcgatccttcgtgcagaccctgatgtggtgctcatcggcgagattcgagatcaggagaccgccaacattgctattgaggcttcgttgaccggccatttggtgctttccaccctgcacaccaatgatgcgccaagcgcagtgacacgtttgacggaaatgggcgtggagccgttcctattgagctcgtcgcttgctgcggtgatggctcagcgactggctcgccgcctgtgcaagaagtgcaagcgtcaggatactgccaccgaagcggagcttcggacgttgggtgttccacacatgccagatacccctcttccgacgatatggcgtccggtaggatgccgagaatgcgccaacaccggctatagcggccgtgtggccatccagcaggtcatgggcgtggattcaacaatggaggatcttatagcccgtggcgccacgtcgattgatattgacaaggcggcgaaggagcaaggcatgaccacacttcgtaaggacggttggcagaaggcgcttcaaggcattacctccgtggaggaagtgcttcgcgtgacggtgtaggttccacctgacgttacatgcacctatgcacctctccgcacttataaaacacctataaaacgttcggttgcgtcggcgcgtcgaagcgccggcacgaccgacattttcagacagcaacccacctattaaaaggacaatgatgaccatcgagcaaacgtggaacaatggcggatatctttccggtctcaaaggcgtgaccattcccaacaacactccatcgttcaatgaggatccccgcaagggacgtcattggtcttccgacaatgcgattcaggcagatgatgaaagccttaagggcattttcgcttcgcttaattcaatgccgactgtaagccagcaggatgtgcaaattcccgacccgcagccagtttcacagtctcaaccatccgaacagtctgttgctcaacaacagactacgcaagccatacaacaatcgcaggaagcgcatgtttttccaacaacaagcgaccgtcaaccagtcggtaccggcagcctgcagtttgatgaggacactgacgcgacccagcaaaatcccgcatatgaggagcatggtccgatccagcagatcgatagcaatccaccgtccttcgtaccgggtgccacaccattcgctaagcgacagaccgacatcgccgaaaccgcagcgcagcagatgcctccgaccatcactcacattccgcaggacgcagctttccaaaggccgcagccacagcaacagcagatgtgtcagccccagccgcagaccaggccattcgcggatttcgtagtgcctgaaaccaacgacgccgacgaggatgccgttccggaagaacgtaagatcaaggccgagcaggtcgaacagacgctgcgcaccgaacatccggacgcggacgacgaattcgtgtcggccatccgccagctggttaagctcaatgcgtccgatttgcacttggtaatcaacgacccgccaatgctgcgcgtggatggcaagctgcgccccgccaagggattgagcgtgtggacgaaggatcacacgtacgaagcagtgaaagtcatgaccaacgaattagagatggaacgtttcaaagatgatctggaacttgatatctccttcgccattggcgatctgctgcgcttccgcgtgaacgtataccgcgaccgtatgggcgtatgcgccgcgttgcgtaccattcctacggaaatcaaaaccgcgcaggaactgggaattgacccgcgtatcgccgaccttgcgctgttgccacgtggtctggtgcttgtatgcggcccgaccggttccggtaagtcgaccacactggccgcaatcgtggacaaggcgaatgcggaacgtgccgaccatatcatcaccatcgaagacccgatcgaattcgtgcatcagcataagcgttgcgtgatgagccagcgtgaggtgggcaccgacacgaagagcttcgcggaagcactgaaacgcgcgctgcgtgaggatccggacatcatcgaagtcggcgagcttcgagacctggagaccatctccaccgcattgaccgcagtggagaccggccacttggtgttcgctaccttgcacacgcaggacgcaggttccaccgtggaccgtctgatcgacgtgtatccggaaaaccagcagcagcagattcgcgtgcaggtggcttccaccctgcgcgccgtaatcgtgcagacgctgattccgcgtgccagtggccatggtcgtgcgccggcaaccgaggtgatgatcaacaatcctgccgtcgccgcgctgattcgcagtggcaaggcgcatcagatccggaccgtgctgcagtctggcgagaaggaaggcatgcacacgctcgatcaggatctggcgcgactggtgaacaagggcgtgatcacattcgaggacgcgctggtgaaggtgcaggtacgcgaggagttcgagaagctctgcggcgcgcgcaagtcgttctaaggatggccggcacagctggcgcgatggtgtgcccatgcatccaatggcggttccgcaacatggaatatgacggaaccgccatggtccatgcgcggccacgcaataatcgcaaagtcacgcagcaatcgctcgtatttcgaacgcaacgggaaacaggaaacatgagttctgcaacagtagcagccacagacaacagaacacgatgcgacgcaatccggcattggctctcgccgcatcgtctgcactgcatcgtgctcgcggcgtacgtcatcgtggtggccacagtgatgtgcttccacgaaccatggttcgacgaggcacaagcctggctcatcgcgcgcgactgctcctggcgggagatgattctggagcgcccgcactatgaggggcatcctccactgtggtggatgatgcttgccatacccgccaagcttggcgtgccgtacgagatgggattgaagaccatcaacctcacatgcgccgcgcttatgatctggctgttggagttcaagaccaagctccctgaggttcttaagggcatcctccctttctcctattttctgtgctaccagtacggcgtcacgtcgcgtccctatgcgctgatggtcgcggccatgctgctggtggccatcaactggaaaaaccgtgacgagaaaccgtggcgcgaagtgctcagcatgatgctgttgtgtctgaccagctcatatggactggtcatcgcaggcatgttcgcggcgaattgggtggtgcggttcgtccggcaggaacactcgctgatacgtaaccggcaacggttcgccgcgctgctggcgctgctcgcggcggcggtggtcatactgatcgacgtgatgcccgcaaaagacgtgtattccggcaatttcgacatctccggcatgacgcagccggcaccactatggatgcaaatttgcaattcctggctgctgctgccggccgaagcattattcacctcgacggtgtcggatacgaatctggtattcatcggcctgtcgtcgacactgctgtacacgggaaccgtgtcatgcctcatgtgggccccgctcatccacatcagccgacgccggcacaacgcaatgctgctgctgagttcatacacagtgatgtgcttggtgttcgcgcagcatttctccatgcaccatctgggcatcctgctgggatttttcatcgcggtgctcgcgattgactgcgacgagcgacgtatcagcacggacgactggccggcctggtgcatcaccatggccgaccgattcatcggcaagcttggagcgaggaaagcgcgcaactatctcatcacgctgaaggccctcgctttaggtgccatgctcatcagcgtgtattggacgatcaacgccagcatatgcgacatacgatacgagtattcctcatcccggacggtggcctcgttcatcaagaccaatcatctggagcaataccgttggatggctggctggactcgcatcaattccacgaatgcgtccccggatgtcaaggaacgaatcaatcaaggcggctactgcgccgatggcaaggactgcatcgactacacatcgtgggtgagcggaacactggtcaccgccgacccgtacttcaagcgtacgctcatgtccaatgcctacaaagggcgcagctacatctcttgggaatggtgcatagacccctatgccggcaaacaagacatcgaaacctggagatcatggggcgaacccgaattctacgacaccatctatcagccgttcttcttcagcgccctcggctatgaccggaacgactacacgaaaatacgcatcgccgaaaccgtcacgccatggaaagaccagcgatcgcgcggttccgtggaaatctacgtacgcaacgacatctacaagaacgtcctgcactcccctgacaccggcatcgcatggccggatggagccaaacggcggtagatgggagcatcggtgcatcacacgagcaaggtagtctgagaatatgccgtaccacaacccgaattcacgcagccggcggaatgtcctacgcatcgtgggcgtgctcgtcgtgcttgccgtcatcgccggcgtcgccaatttcctgcacgccaccaccagtgaagcggccggcaatgtcaagccgcagatcgaaaccatgcaaggcatccggcagaccgcgcaggacagcatcacgttcgcgcagggcctggatgatccggaccgattcgccgcgcacatcgaaaccgtgcagcagtgcatggacgattacgaccggcttgccgacgccaagcagatcaagtatctgctgtcggacaatctgcaggaacgcatcatcggactgttgtaccgcaaccagcagcgcaccatcatcgacagcatgcgcgtggcggcacataatctcgacggacagaccaaagaactgctcagcgcggtcgacgcggccatggcggacgatttcagccagcatgcggcgcaatggctgctgcaggtggacgatccgacgcaggcgaacgagctcatcgaccgatacggcaaacagcgcgcgtatgcatcgatgagggagatgctcgccgacctacggtcgctgcacaaactacgctcggacgtgaaacagcaggtctcgactgcggtcagcaatctgcataacgcggaagccgcagcggctgcgatcgccgtgcccgaacgcaacggtgatctcgatccggccggatggtacacgctcgccacgaacgtggcatcgacgatgggcgtgcagatcgaacagaccatggaattcaactgcggcggccagtcaggtgagaatccgagtggattcgtggctgcgtattactgccagatgcccgaccgctcgcagaggaatgtcgtgcatatcctcaccacacacccggattggacgcagaccgcgcgaagcccctggctggtggacatggtcaagcacgaactttcgcaccgttcgatcatgatctcctgcggcaccacgcaaccgacaatcgcagccgaccgtacggaggcggtgacgaattcctattcggtgctgtttttcggggccgaccgcgaccgcatcacgaatcagcagcagggtgtcgccgaatacgcgatggatgcatccagcgatcagctggccaccgccatccacgatggcaattgcgggtgaggtaagccagttctcgcttggcgactattgcacatccttgaattcgatagtccagttcttcgcgtcgtcgccaagcacattgcgcacatactgctctagaatagtccgcgcgcgagcttcggcttgggcaagcaacgccgaatcggttttcgcctgcttcagcatgctttgctgggccttatcaaacatttccgttttctcttcggcggtaatcgaagtggcgaaaccagtgctcaccagcggtttgctgaacgacttctcatttacgtccggatcatccaacacgtgagctggaggcacggtaatgattactctatgaccgttggcatctggactaattgttactttatcggcatcaataccgtacttcacgatgccactgtattccatccacatacgtttgtagccattattgaagaaccacgatccctcatgactgagcttggccgtgttgtggtaataacattttaatgtggccatctgtgcgatatacgtggcattcgagaaagttgggatagcttctttcttttcctcgccgcaccctacagcagaacatgcaagcgtagcaacacataatgcggcaatcgcacgtttcatggaacgattattcgtcagcatgcgcggtctccttagtgagctttacggtctcggccttctgcaatttgtatccttttgcttccacgagatccttggtcaacgcatccacagtttgttcaagattactggcagcaatagaaataatgtctccgtttgtcttggtctcctgttgcgcatcctgcttgcaaagcttgatcacctcatcaatttcaacggacggattgttctcgaaaaagtcgaggctgccgctatcaaccacgacgtccccaatagtcggcttcggcagaatcggagtgacggtcttcgcggtatcgtccacttcgaacgtgatatcgctcatcttgacgccagcagtcaccgtcgcctcatatgcaacatgccacttgtccttaccagcattgtctttctttacagcaacaccgccataatggaatttcgcggtcgatagatcgtcgatattcacagccgcctgcaactggctttccacactgatggtagattcggtccttgcattgtcaaaaacaggtttaacgacaccgttccacacaaacaggacaactgcaacagtgacaattgccgcaacagcaccaaacaacaccttacgcaacttttttgcactgagatcgccgaacaacctatcgcaaagaccgccccgtctccttcgactcccgtcatttctcgccaacgcacattcctttcacggttctcttccgtcaacaattctatccccgcatgcaaatacataggggcgtcacaaacgtctcaggaaataatacggggaagcccatctcgtggaatgattatcggaaataatccgatatttgatgacgtttcatcataatgaaaatgcccgccatgtcttcctgcaaggcaggacagcacacataccacttactacttccacgcctgcttaaacattcggatgggatactcaaaagagcgtggaagaggcgacctgctattcagcacacgaaatgctgcagccgaacgtacaatggtcgccccatgtcttcgtattcggcgatgccgtttttggactaaatcagccaatcggtcacgtccttctcggaaacagattccgagaaacgatgcccggtaagccatgtaccactgcctgccattttctggagcgtggatgcactgttgccgatatcggagctggcggaagtgcagaacggaatgatcgtcttacctgcgaaatcgttggatttgacggaatcgttcaccagccaaacaggtgccatccaccaaatcgggaagcccagatacacagtgctgccggcaccgaccatgtcatgggccggaatcactcgcggccagcacgttccttgacataaccgacgaagcgatcgaccgcctcaggggtgtcgtggcgaaaaaacatgctggtcttggtgtcaaggcccgcgatggttgtcatctcgctgtcggagagccggaaatcgaagatgttcaggttttcttccatgcgctccttgtgcgtggacttgggcagagcgacgatgtcgcgctgagtgagccaacgcaggatcacctgcgcgacggacttgccatgtacctcgccaatcttggccagggtgggattggagaacatgttctgcatgccctccccgaacggagcccatgcttcctgagccacgccccgcttgaccatgttcttgcgagcttcgatctgctggttgagcggattagtctcgacctgatcggccatcggggcgatctcattgaaggcgaccatgtcggccagacggtccggatagaagttgctcacgccgatggcgcggatcacgccgtccttgtagagcttttcgagcgcacgccacgcgccgtaggtatcggaaaacggctggtgcagtaacaccagatcgagatagtcggtgccaagcttcttcaaggacacatcgacggacctcagcgtgttctcatagccgtaattgctgatccagatcttggtagtgaggaacagatccttacgatcgataccggaatccttgattccttggccgacttcggcctcgttgaagtacgactgtgcggtgtcgatatggcggtacccggtctcgatggcctcgcgcacgcagcgaggagcatcgtccttgctgatctggaagacgccgtatccgatcttcggaatctcaacaccgttggcaagtttcacgtattccactgtttttccttccataaattcgtcggtattcagtgccggcatgtatgccgttctgaccctcaagataaaatccggtagccgctaccggtcaaattacggcacgccggtactatctaccggtattaataaccggaaatgtgacatgataggtacaaacaaaaagaacaatgcgcctcaagcccgaccccatccggcggcacccgccgaacgtcctgccgcgcagcgtccgaaaggagccacgtatggcaatcacggcagtgccactccataagaacatgaaaacctatacgatgaagcaggcctgcaaactaaccggcatgaattacgaagcattgaagttctattgcaattcaggactcgtgcccggtctcaaacgagaccagaacaaccgacgcgtcttcgacgagcgatgcatcgcatggatcaacgacctgacatgtctcaaacgctgcggtctgggcatcaaggagatgcggcactacacgcaactctgtcttgaaggtgagtcatcgataccggaacgtcaggaaatccttgccgaaaaacgcgagcatctggagacgcaactggaggaactgcgtaaagccatcgcctacatcgatgaaaaacagcgcttctacgccgacgtgactgccggcaggacggcatactgcagcaacgtcatcgacacgacgcaaagcgactgactgcgttccgtaggtgatttttgcgttccgtaggcggtcagcttcgaatccggacacgagcaaacgcctaattccaggcatctcgccgatgcttatccggcagcaaccacctacggaagcccaaaatcacctacggaatcgcgcctgtcaagggacgcagatagattaagcactgttgtaaacatgcgggggtgcttgatgtccaagtccatcaagctgagataggcatgaacgcctgaccctttgaacctgttggttaggaccaacgtagggagcagatcatgagcgatgactcatccgccaatgacgcactcggcgcattgcgtgccgccatcaaacaagccgtcatggacgtacgcgagcagacgccgctggcgcagtcgttcaccaatttcgtgaccatcaatctcgttgccaacgcacagcttgcggcgggcggcaccgcggccatgagctatctgccggatgatgtgatcgccaccgccgaaatcgccggatcgaactacatcaacgtgggcacgttgctgccgttcttcaaggacgcgctgccggaaatcgcgcgcaaactgcacgaaaacggcaagacgtgggtgctagacccggttgctgcgggcattggcgaaacacgcacgttcattcttgaatcgttccgtgacgcgcctccgaccattgtgcgcggcaatgcgagcgaggtcatcgcgcttgatgcgatgtgggggctggccgacgccgacagcactgatccgaccacgcgtccggctggagtggaggccgttgacgaggtcgacgcggccatcgacgcggccaaacgtgtggcccgccatttggcgaagcactcccccgtcggcaagggcgcggttgcggtgtccggcgcggttgatctggtgaccgacggcgagcgcacgttccgcctgcccggaggcagcgcgatgatgacgaagatcaccggcgccggctgttcgctcggcggcgtgaccgcaacgtatcttgccgtggccgagccgctggtcgccgcccttgccgcgtcgctgctgtatgatcgtgcgtccgaaatcgccgaagtcaaatccgatggccccggttcgttccaggtggcgctgctcgacgcgctgcggaacgtcaccgccgaccaggtggccgcgtccgacatcatcgaaaccaactgaccgcaacgttccgtggatggtttcgcaccatcgcaatcgtatatacggaatatatacgttcagtgcggtgcgacggaaaataaacggaaaataacaagacttcttctggagcacttacccaaagaacaacaaaggggaaaccaatgaataattatccattcgcctcgatgcgcgactgctttgatatgagcgcgtatttcgtggtcggtccgcaggattgcaagggccggccggtgacggatgtggtggatgacgcgttgcgtgggggcgcgacgttcatccaattgcgcgccaagaacgcggatgcgaaggatatcaccgaaatggcccgcgatatcgcgcaggtcatcaagaacagcggcaagtccgattccgtggcgtttgtgatcgacgaccgcgtggatgtggtgtggcaggcgcgcgacaagggcatcaaggtggatggcgtgcatatcggccagaccgatatggaaccgcaggaggctcgcgcgctgctcggcgaggatgccatcgtgggcctgtccgccgagaccgaaagtctggtgaagcttatcaacgagctgccgagcggctgcatcgactacatcggcgccggcccgctacatgtgtccaccaccaagccggaggcttccgtgggcggcaacgacggttccgggcacacgcttgacgaggaacagatcaacgcgatttgcgcggcgagcgagttcccggtagtggtcggcggcggcgtacatgccgacgatatggagatgctggcccgttcgaaggcggccggctggttcgtggtgtccgcgatcgccggtgccgacgatccggaagcggccacccgcgaaatggtgacgcgctggaaggcggtgcgcggcgacgcgaagcacggctatgcgccgcgtgtgaagtagtccgtcgtacagggaatcgacaagcccgctgagatgagcgagaagttccgcaagggtggttctacactgtatcagtgagctcagtgaagataatcaatgaatcagtgagcctaataaggagagttaccatgactagcacattgccaccggtattgagcatcgcaggatcggattcgtccggcggtgccggcattcaggcggatttgaagaccatgctcgccaacggcgtgttcggcatgaccgcgatcgcggcgctgaccgcgcagaacaccaccggcgtgacgatggtcaccaacactcccccggaaatgcttgcggcgcagatcgacgcggtgttcgaagacattccgccggtggcggtgaagatcggcatggtgtccagcgccgagctcatcaccgtgatcgccgaccgtctgaccgcgcacaacgcgaagaacgtggtgctcgacccggtgatggtggccacgtccggcgcgaagctcatcgaggatgatgccatcgcggcgctgacgtccaaactgttcccgctggccactgtgatcacgccgaacatgccggagacccaggtactgtgcgacttggccgtagagcagggtgcgggcgcaatcgactatgagaacggcgaatccatctccaccgagaacgacatggtgaccgcaggtcatctgctcgccggccatttcggctgcgcggtgctcgtcaagggcggccacggcacgcatgacgcgagtgacgtgcttgtcgagccggatggcaagatcacctggttccgttcccgtcgcatcaacaacccgaacacgcacggcaccggctgcacgctgtcttccgccatcgccagccatttggctcttggcgaggcgctgccgacggccgtcgaccatgccaagctgtacctgaccggcgctttggaagcgcagctcgatcttggacatggttccggtccgatggaccacgcgtggaagtggcgttgaaccaagccacgcaaaccacgcgaaccacggcagccgttggaacagtacaacaagtaatcgcacgaaaacacacgagacaacgctgagaaaggtaatcatgacgctcgatcgcaacgcagaaaagcaggaagtgcccgtcaatccggaaaccggcaaaccgtatatcaacacgcttgccgcagtagccatctcccccgccggcgccagcccggagaagtccacgtacgtggcgcaggccgtggacgtaatccgtgaatccggcctgccgaacgagacgaacgccatgttcaccaacatcgaaggagacatcgacgatgtgctcaaggtgatccgcgacgctaccatgaagctcgccggccagggataccgcaccgacgtggtgatccgtctcgacatccgccccggtttcgaaggacagatccatgccaagcaggaactggtaaacgagattctgtcgaaataaccccctttacagtggtgaaacgaaaccattccatgtaaaaaagcgcgctttttcttggcaaaagcgcgcttttcgcgtttatttgggtatagtgttgcgattatgacgacaatgaaggaaatcgccgaacaaacgggggtatccatctccactgtatccctggtgctcaacggacgcgacgaaggcagggtaaatcccgcgctcgccaaactcgtacgcaacaaagcgaccgagctcgggtacaagatcaacccgttggcgcgaagcctacgcaccaacaaaacccgcattctcggcttcatcagcgaggaagtcgccaccacaccgtacgcgggcggcatcattctgggcgcgcaggacgcggccagcgcctacggctacatgctgttcaccgtcagcaccgacggcaaggcgagcgaggaaaacgagatcgccacactgaaaaggtacggcgtggacggattcttctattcgaagatgtcgaaccgcatcgcacatgttcccgaatcgttgaacgaataccccgtggtgatggtggacgccaccgaccacgagaacaaagtgcccagcatcgagccggacgagttcatgatcggctacgacgccacgaatcggctgatccaggccggatgcaaacgcatcgcatacgtgggttgcgcggaaaacatgatcgcgcaggacggtcgtcttgccggctaccgcaccgcgttgcaggaggccggacgtgcgttcaacccatcgctggtatgcaacgtaatgaacaacggtccagctttacgcgccgtgaacaagttgttcgacgacgagcatccggacggcttcttctgcttcaatgatgcgcgcgcctggtatgtgtacgaatgcgcggcaagaagagggcttacggtaggcaaagatatttccgtggtcggcgtggacaaccaccgcgtgttcgcagagacacttgaaccgcagctgaccaccgtcgaactgccacattacgaaatgggctattggtcagcctgcaagctgatttccatgattgaaggcaaggatgtggataccagttcatgtccatccgccagagcttccctgccgccgcttgatgcgccgattccggcgaagatccactgcgcattgttggaaaaagattccgtcatatcctgatttttctgtttttacaacgattcaaatgcttacgattgttcgcacagccattttctatacatgaaaattgtgcgtttgttcacgacacgccgaataaagcaatcgtgccaacagtccgccagcagttgattcaggcttaatttcaactatccgcaaatccttacaaacgtttgacgaagcagttgccatatgctatcttgaagccatgttcgcttttcggcacggcagctgaaatccgagcaggcgcaagccaaaacaacatcggaagcaatcgatgccgcgcggcagcggcaccgcgaagagaaaaagagaatcaaaatggcaagtaaaacacgttctgtatggaagaatccttcctatctgcagagctccttcggcattttcatgttcttctgttcctggggcatctggtggtccttcttctcccgctggctcactgacccgacccacggtctgggcatgagctccgcggaacagggccagatctactccatcaactccttggccaccctggtcatcatgttcgtttacggcaccattcaggaccagctgggcatcaagcgcaagctcgtgatcttcatctctgcggtcgctgcatgcgttggcccgttcgtgcagttcgtgtaccagccgatgctgaccgccggcggcaccacccgattcatcggcgtgcttctcggctccatcgtgctgtccgcaggcttcatggccggctgctccctgttcgaagccgtcaccgaacgttactcccgtaagttcggcttcgaatacggtcagtcccgcgcttggggctccttcggctacgctgtcgtggcactgtgcgcaggcttcctgttcaacatcaacccgctgctgaacttctgggttggttccatctgcggcctcggcatgctgtgcgtctacgccttctgggttccggccgagcaaaaggaagaactcaagaaggaggccgatccgaacgcggctccgaccaacccgtccttcaaggaaatggtctccgtcctgaagatgccgaccctgtgggtgctcatcgtcttcatgctgttcaccaacaccttctacaccgtgttcgatcagcagatgttcccgaactactacgcctcccttttcccgaccaccgaaatcggcaacgccacctacggcaccctgaactccttccaggtgttccttgagtccgccatgatgggcgtcgtcccgatcatcatgaagaagatcggcgtgcgtaactccctgctgctcggcgccaccgtgatgttcgcccgtatcggtctgtgcggcgtgttccatgacccggtctccgtctccatcgtcaagctgttccactccatcgaggtaccgctgttctgcctgccggcgttccgttacttcaccctgcacttcgacacgaagctgtctgccaccctgtacatggttggtttccagatcgcttcccaggtcggccaggtgattttctccaccccgatgggtgctctgcatgatgccatgggcgaccgtccgaccttcttcaccatctctgccatcgtgtttgcggctctggtctacggcttcttcgtcatcaagaaggatgatcaggaagtcggcggcgatccgttctacactgacaagcagctcaaggccatgaaggccgctggtgcggaagtgaaggcctgagtctcagcccgtactaagtcggcgtacggcgtcgatggtggtcgcaacctacatcccttctcccgcgatcatcatcggtaccgtacgcgtcataacaacaatcgtggtgtccgaagcgtttccctttttccgctttgggcaccatcttcaaaaagctttttatccaacaattcataacccagattcagaaaggcattcaacgatgactggctttactccggacgcacctgtccttcacgaaatcaagaaccacagcgaggaactcaccaaggcagaggccggtgtcgcggccttcgcagccaagcgtaacaaccgctggtatccgaagttccacatcgcatccaatggcggttggatcaacgatccgaacggcctgtgcttctacaagggccgttggcacgtcttctaccagctgcacccgtatggcacccagtggggtccgatgcattggggtcacgtctcctccaccgacatggtcaattggaagcgtgagccgattatgttcgccccgtctctggaagaggaaaaggacggcgtcttctctggctccgcagtgatcggcgacgatggcaagctcaggttctactacaccggccaccgttgggccaacggcaaggacaacaccggcggcgactggcaggtgcagatgctcgccgaaccagacaacgatgagctgaccagcgccactaagcgcggtatgatcatcgactgcccgaccgacaaggtcaaccaccactaccgcgatccgaaggtctggaagaccggcgacaagtggtacatgaccttcggtgtctcctccgcggagaagcgcggccagatgtggctgttctcctccgacgacatggtcaagtggacctatgagcaggtgctgttcgagcatccggatccggacgtgttcatgcttgagtgcccggacttcttcccgatcaaggacgtcgaaggcaacgagaagtgggttatcggcttctccgccatgggtgccaaggcttccggctttatgaaccgcaacgtttccaacgccggctacatgattggcacgtggactccgggagaggcattccagccggaaaccgagttccgtctgtgggattgcggccacaactattatgctccgcaatcgttcaatgacggcgagcgtcagattgtatacggctggatgagcccgttcgttgagccgattccgatgcaggatgacggctggtgcggcaatctcactctgccgcgtgagatcacgctgggcgccgacggcgatctgcacaccgctccggttgccgagatggatggcttgcgcgaaaacactaccgatttcggcgcaatctcacttggtgtcaatggcgagcagaccattgctgatgatgctgaagccgtggaaatcgaaatgaccatcgatctcaacgcctccactgcggaacgtgctggtctgaagattcatgcgactgaagatggcgcttacacgtacgtggcgttcgacgatcagatcggtcgtgtggtaatcgaccgtcaagccgcagcacagggtgatcgcggctaccgtaccgccccgctttccgccgaggaactggcttccggcgaactcaagctgcgcgtgtttgtggatcgcggctgcgtggaagtgtatgtgaacgacggacgccaggccatgagctctttcagctacgcttccgaaggcccgcgcgccatcaagcttgttgccgaatccggcacgctcaaggtcaagtccctggtgcttcaccacatgaagtccatcggtctggaataaataaaacgtctgtcatggttgacaggcaaacaaccataagacagtagcaaggggtatatgggaaggcctccgcatcggaagggtgcggaggcctttctatatctgtctctctatatctaaagtgatatctgggatggtatccaacgcacgttatctctcgttactgccgtacttgctgtgcgggtttgcctacgttccgccccaccgtctatactggcgagccggtaacaatcttttctggccgattggcgggcaggctcctcaccttactgatttcccgcagtcggtcacgtgcgcgtccactttgacgcagaaagcaaggtgaacgatggcggaatcgcacgttcaacgcaaactgcttgacatgatgaaacgtcgtattccgacagtgatcgccatcgtgttgctgctggcggtatgggaggcatgggtacgaatagggcatgtgccgtccacgatgatcgcctcccccagtgagattgctcaggcgaccgtcgaaacctggccgacactctggcccgcgacacaggtcacattgctggaaggtaccgtcggtttcctgcttgccgtagcatgcggcatcttgatcgggattctgctgtattgctcccgtgttgcgaacgcggcgctgttcccactgctgtccgccgcgcagacgatgccgctgatttcgatcgcgccgttgttcctgatctggttcggtttcgaaatttccggcaaaatcgtgatcgtggccgtcttcggcctgttcccaatcgcggtgcagacgattcgtggtcttgaggcggtcccccagttctattcggatgtcgcgctgacatgcggcgcgactcgcgcgtggacattatggcatgtgaagctgcgcgtggccgcacggcaaatctacggcggtatccgcgtatccgccgcctatatcttcgccaccgccgccaccgcggaatacctgggcgcacgcaagggcctcggcatctggctgcaggcggcttacaattcgttccgcacgccgctgatcttctcggccacgctggtgatcatcgccatcacctgcgtgctcatgtgcctagtgaacctgagcgagcgtatgctgctcggccctgccagcgatgacgaggatccagacgccggacagtgagcagaccgctctcctccctctacccatcgtgcgtgacgcgatccgcccgcgcagcttgccgttcgattccgacgattcgtcacttggctgccgattcggacgaaatcagggtcgatttcgtccgaatcggcagccatgtgcaccacaacagacaaacgaaccaccaagttcgccatgcgacgtttaccctgacttttctgacgtttacatgaactcgtccggcaataccgcgctttcttacaagaatggaatgcacaagagcaaacgctgctatacgccaggattccggagaaaaccaatatgttatttttgaggcttctgctgttttcgtgggttaggttctcggctgtggtaggcgtatgtcgagtccaccgcatcgggagcatctgagcatgcccctgcgcggacgcacgcggatctcgagcacgggttcgggacgcaatggggagtcggcgatgcgcacgccctcgaccaccgtgcctttgacgttgagaagctggttgaacatgctgttcatcaggcgctttttggctgtgtttttcttggtcgttaaacatcctactcaaaaagcgctctttcttactcccacaacggttcaacaacgaacccgcacccacgaaaacagcaatagcgccgcttttctactccagattcgcgtggtactcccacagggaatcgaggtcgatatcgcgtttgcgcaccatggacatggcgatggcgtcgccgaccagcagcagcgactgctcgaacaggctggtcatcggctgctggctgggcttggtgccactgccgggcttgcctgcggccggcacatggacgaacagatcggtgtactgcttcatcgggcagtcttcaacgatgccgatacgtgccactttggcaccgaaagatttggctttgccggcgatgaacagcgggaatccggttttgcctgaaccggagccgacgatgagcagatccttctcgcaaatggccggttcggtgatctggccgaccatcaccgtgtctacgccgagatgggcgagacgcttggcgatggcttccagcgcgagtttcacgcggccgacgccgacgaagaagaccttgcgggcgttggcgatgagatccacaagtgcgtcgatttgtgcctcatccacgtgatcgagtacgtcggcgagctcttgcacgatgatttgttcgcagtagcggaaagaggtgggggattggatagtgttttcggtaacggttgcggtggtcatgatggtttttccttgcaatatttatatgtgattaacgtcgttggagattagcgcggattggtcgtagtctctccggtggagtgctcgtaggcgtccatggtcagtcgccatgcttcacggatatcgggggagcgcttgaaaatgccagtgttgccgagcacaaaggtgttggcgccgacttcgcgcatggtcttgaaattcttttcgttgcaggagccgtcgatctgaatttcatagttcagaccgtgctcgtcgcggaagcgagccagctgctcgattttcttcagggtctccggaatcagcggctcgccactgtagccgatctcgacggtcatcacggtgataaggtcgatgcgctccaatagattctccacatccgcaaacggggtaagcgggttgatggccacgcccgcaccgcatccgttttcgcggatgatgcgcagtgtgcggaaggcgtgtgcgcccaacgattcgacatgcggggtgagcattgtagcgccggctgcgaccaactggtcaatccaatggtcggggtcagtaaccatcatgtgcacctcgttgcgtagcgtgctcagcggcagcatctgctcgatccaggacgtgcataggcccatgctgggggagaagtgtccgtccatgatgtccacatggtaggagtcggccacggtgttgaggtattcgacttgcggggcggggttgcggaagtcgctgcagtagagcgagatcgcgaaatgggggttagggaatggagccgtcattagtattccttatataaaaagacgatgaatgtgtttttggatgtgttcggccaagggtgcggcgcaattatctttcgctcaccctgttgctgaggaatggaatcgctactgtcggctagtgcgcacggccacgcccatggcggtgagtgcgtcgatgcaatccggcgtgccctcggtcacgatgacgtccagtgcgttgcagtcagcgattctgtaggtggagatgcgtccgaatttctctggtgtgatgaggctcatgaccttggtgcccgccttgatgattgcgcgtttggtttcggcggattccagatacggggtggtgatgccgtgctccgggtcaatagaggagatgccgagcagcactaagtcgcaatgcaattgctgcaaagcggtcagggctgttgaacccacggtctctttggacttgtggttcatggtgccgggcagcatattcacctcgacatggtcgtagtcggacatccacaacgccgcggccggactattggtgatcaccgtgccctcccaatcgtgtgggaaggattgggcggccagatagttggtcgaaccgccgtcaaggaagatcacgcggttttcgcagatctcgtccattgccagtgcggcaagtcgctttttggtgtccgccccgagatcgacgcggttttcgaaacggctgagttccgtatccggtttaatcgcgccgccatgtacgcgctgtacagcgcccctgtcgtccagttcctgaaggtccttgcgcagggtggcctcggtgactcccatttttttggcgaagtcagtgacgaccacacggccgttgtcggcgatgtgcttgaggatgagttcctgtcgttctgccttcatcatgtgggtctcctttggctgggcgtatatggggccgaatcatgctcggcgtgtcgtgttttatgtcccataataacagaggattttcgttatgtatcggttgtgattaaaaattcatttcgactcctttcgtttttgtgttgacaactatcgtaaccttgtgttataactttgtcaacaagcaaaacgaaagacttcgtaagataaaacgaaagctttcaaaatgcttggatgtttcgccgacacaccgcacgcgtagaaacgaaacatcgtatgacaacccataatgaaaacagccgaacgcagtagttcagacaaggaagtacatcatgaagcgctctgagatcaatgccaccatcaagcagttcgaagaactcctggacaagtacaagttccgcatcccgccctacctgtccttcactccggaagagtgggccgagaaggaccatgaatgggatgagattcgcgacaacatgctcggctgggacatcaccgattacggagagggtgacttcgagcacaagggcttggccctcatcaccctgcgcaacggcaatgtgaaggacccgaagtataccaaggtatacgccgagaagatcatgatgagcatgcccggtcaggtctcgcctatgcatttccactggaacaagatggaagacatcatcgtgcgcggtggtggcactgccgtattccacctgtacaatgccgatccggaaactgaagagcgtctcgataccccggtgcttgtgtgccgtgacggtcgccgttactacgtgcccgccggcgaagacatcgaactcaatgaaggcgaatccctgactttctatccgtacacctaccacgagtactacatcaaggaggactccgtgccgacccttgtcggcgaggtgtccatgtgcaacgacgacaacatcgacaaccgcttctacgagccggtcggccgcttccctgaaatcgaggaagacgagcccgcctaccgtctgctgtgcaacgaatacccggcggccaaggaagactgaatctcgataagcgcaactgattgcgcgataagtggcccaacccaatgtgctcctgcaggcgggagccggctcgcgcaacgaggctgagggtggtctggtaatgattgccaagactgccctcggcgcttcgcgtcacctcccgccggtgggaggatgcttccgtagtcgttcgaccgttgccttccgtcaggggaagcattacttttcctttctccatttttctttctggtcttagccccgctatgcccgaaaccatcttcaacctaggattcaccatgcccaacaccaccaaaccatccgtagtcgccgtcggagaactgctgtgggatatgctccctgacggcagaaaaccgggaggcgcacccgccaacttcatctatcacgtcgcgcaaaacggtgtccaaggaaccgccgttaccgccgtcggcaacgatgacctcggacgggaccttgtttccatcctcgccgacaacggcgtcaacgtcgccgctcaagtcaacgactatcccaccggggtcactgctgtcagacttgatgacaatgggattcccgagtacgacgtcgtcaaaggtgtcgcgtgggatcatatcgaatttactgacaatgtacgcgccctggtgcgtgccgccgacgcgatctgctatggcaccattgctgcccgtgaggcatggggcacacgcgacaccatctatcagatgattgacgctgcacgccccgatgccattcggttgtttgacatcaacatccgctccggattcgtcaacaaagaagtcatcacccgattcctcgaaggtgccaccgttctcaagatcaacgacgaggagctgcccatagtggctaacctgttcggtcttgactcgccgggcaaagatatcagatcgcagcagcgagcaatgaggacactctgcgaaatgttcaatttggatgtggcgattttaaccgctggagacgcctacagcattgtgatggggcatgacgaaatctcgattctgcccaccccgcaggttgaagtggcagatactgtcggtgcgggtgactcgttttccggggcgttccttgcctacttgctgcgcggattcgcaatccctgccgctcatcgtcgtgccgttgacgtctctgcgtttgtgtgcagccagtccggcgcttggcctcgctacccgcaggagctaagagagcagcagcctcacggcctgtcgtcgatcggatccggcaatccacttcagtaatcggcctctcgccatccgaggcatcctctcatccggcacatctttaatgaagaaggattcaccatgtcacaacacaacattgttccccgccttgccatcagcgctgcgctcggtgggctgctgtacggctacgacaccgcagttatcaacggcgcaaccacagtcatcaaagaacacttccataccggcgatgccgtgctcggccttgccgtaggatcggcgctcatcaccggatgcgtcggcgcactgctgtcagggcgcatcgcggacaagatcggccgcgtgccgatgatgaaaatcgccgctgtctgcttcctggtctgcggtgtcggctgcgcgttcgcgccgaacatcgaaatcctcgtcgcattccgtgtgttcggcggtttcgcggcgggcatcgcctccgtggtcgcgcccatgtacattactgaaatctccccggctcgggagcgcggcgtgcttggctctctgcaacagctcggtattgtgctcggcattttcgtctctctgttggtcaacgcattgctcgtgcatatcagtggtggtgccggcgcgatgatgggaccaatgatgacctggcagtggatgttcctgtgcatgtgcgtgcctgctttgatttacggggtgctggcattcacgattcccgaatcgccgcgctaccttgttgcgcagggtcgcatggaagaggcggccgtggtgttgaagaagattggggatgccgaaatcaacgtggacgagcaactcgcatccatccgcgcgtctctcagtgctgaccgcaagccttcattccgtgaccttatcggggcaaacggccggctgaaaccagtggtttgggcggctatcggcttcatgattctcaatcagttcactggcatcaacgtcattttctactattcgaactcgctgtggagcgccgtaggcttcagcgaaaagaactcgtttaccatcaccgccatcacttcgctggtcaacatcgctgcaacgcttattggcatgatgcttattgatcgcgttgggcgtaaaccgctgttgctcgcgggatccatcggcatggtcgtggctcaaggagggcttgcaatattgtttggtacggctccgatggctaacggctctcctgtaatgggttcggtgactggccctctggctctggtgtgcgccaatctgttcgtggtggcgttcggcgtgacttggggcaccgtctcgtgggtgatgctctctgagatgttcccgaattcgatgcgcggtgctggcatggccgttgggactgccacccaatggctgtccaactttgtggtcaccgtttccttccctgtattgcttggcgtcaatgtcgggcttgtgtatggtctgttcgctttcttcgcgatggtttcgttcttctttgcgctcaagtgcatgaaggagaccaaaggtgtagcactggaagatatgcaagcttgattgtgccgacggtatggaaagtacttaccctttggcgcaacagggtgtttggcaagggtgcggcgcaatcgcgtagccgacttacggagctcaggctgttgatgattggcgttgacagcctagtgccggattgaaatatcaataatcgttaaggagtaatgaaccgatgagtgtcaataaaaatcaagtaatcaactcaaccagcacacgagccgacatgttggcccacatgggcagccttcagcaggccgcctacgtgcgcccgatcgagtaccaggagggccgtgcccacggccttaaggccatcgaggtgaagaacggcccgctacgcttcgtatccatggccgaccgcgccctcgacatctgccagttcgaataccgcggcgagaacctcaccttcctgtccaagccgggcctgaacggccgcaaccagttcgacaccaacgggctggaggcgcagcgctccatcatgggcggcctgttcttcacctgcggcttcgagaacatctgcgcgccgtacgccacgcctgagggcggcaagtacccggccggcagcttcccgatgcacggccgcatccgcaccacgccggccgagcatgtgggctccgacgcccactggaccgccgaaggcgactacgtgctcgaagtctccggcgaaatgcgcgaggccgaactgttcggcgagaatctggtgatgcgccgcaagatcaccagcgtgtacggccagccgtcgatcacggtcgaggatgaggtgaccaacgaatccttccgcgacgagccgctgatgtggatgtaccactgcaacttcggctggccgttgctcgccgaaggcgccgaagtcgtgatccccagccgcaaggccaccccgcgtgacgagaccaccgcagccgacaccacgccgtggaacgaaatccaagcacccgaggcgaaccgccccgaaagcgtgtacctgcacgagctcgccgccgacgaccacggccgcagcttcgccgccgtggtcaaccgcaagctcggacttggagtcgtcatcgacttcgacgccagcctcttcccatacttcatggaatggaagtcgatgggtgcgggcgactacgtggtcggcctcgaaccctcgaactccagcgtccaaggccgcggctggcacgagcagcgcggcgacctgcatacgctggccccgcagggcaccgagcgcaaatcgctgaccttcaccgtcatcgaaggcgccgaggcgatcgacgcgctgatcgcgcgccgcgacaccctgctcggctgacgccagagccggcgccgatgccgtgacgttcgtttcttaggtattttccgaggcttctgctgttttcgtggattagatcgtgggttgtggtagtcggatgtcgagtccatcgcatctgagcatgaccagggcaatgaggttgttcacgtggcggaagccgtaggccatgcggatggtgaccttgatcctgttgtcgaacgcctcgagcctcgcgctcgaatagcccagctcgatggtcctgaggatgtccggtcggcgccgccggatcctcttcgccagttcgacgatctcgggcatgcgtgaatgcgaggccaggaacacccagtgtctcaactcgcccctggcctgttcgagcgggtgcttgagcagggtcctcaatagttccttgagttgccatgaacggtagagccggccctcgggtccgtgttcctgatgccgtcgagcgcatcggtcatccaagagacgatgtggaacccgtcgagcacgcgttcggcggccgggcaccaccggccggtgcacgggtcgatccagtgggtcccgtcgccggtgacgaccctgatggattcgcgctgtccgggcgtcaacgccttgaagaacaggtcgaacacgtccccgccgtacccgccgtgagcccagatgaccctatgccgctcgtggtcgacgaccacggtcaggtacgtgtggcccttgcggtggctggtctcgtccacgccgatcgcgtgcaggccgtcgaacggcgggggcatcgccgttccgagccgttcggcgaccctatgggcgatgtctcccgcgatcctccacgcgatatgcagaaatctggtgaataagcttttgctcaggcgttcttcgtgattcatttctttggtcggaaaacagaatacgcgggaacgccccttacgcttacggaaccaacggctcgacgacgaactgacatccacgaaaacagcaatagcgccaaaacttgccgttccgctcgtcgatcaagccgtcataactgttccgcacctgaatcatgcagacgcccggaaccttgccgatccgcaaatccgcatatcgttcgcctgcgcaacaccctgcggcctgaaccgcgttctccagcaggttgccaagaacaaccgtcagatcgaccgacttggcaaagtggtccactggagtctcgattcgtgacgtgaaccggaccccagcgcgttccgcctcatacgcgtaatactgcaacagtgcatccaattccggattactggcaagacggtaccgcgtacttggaggaacggttcgtaccatcttggcgatgtaatcacgcaattcgccaagctcgttcttctcagccagcaccgacagcaccgcaagctcatgacgaaaatcatgccgtagccgccgttcggcatcactatgctcccggtagatacggtaagcgcgttcatgcaattcatattggcgattgacgatactcagctcattccgttgacgttggacgagaatgattttggcaatgataagatacgttccaagtttcgttatgaacaacagcatcagcatcataaaattagccggcttcgcagtgctgatgtattcaggttcaggcgtgccgaatcgcatccacaatgcgatggcgctgaatccagccggaaccaaccacaagtaccgccagatataatccgcatcctcaacatcgaacaaatccagcaacgttcttccgaagaatacgaatagtacgcagatcagtgcaatcccaaccagcaagaccgtgagcaaatatcgccaatcatatacccccccaggaaacagatgacgatcgacggcgttgcccatgacagtaaccgtgcccgacaggttcatgaacaacatcagaacaaacacaatcttgcgccaagaatcacgaatcaaaccgatcacaggaaatccccataacaccggcaacagtatcgccatcaacgccatgtacgcgttgtcatcgacatggcgatagcgcaatgagccggctaccacctgaatcaccacaagcaatgcgcatacagcaacggtggcgcgtacgcctaagcggaggcgtttgcggaacagcgtcagcgtgaatgccatgccgggcagacaatcgagcaacgcgaatatcccggccccgcatacgcccacattcatttacctgatccccttacctcaatccatgtcgaatctcttccggcgctctcaaacctccatcactttacatgcacccttcgtctcctccgtccggcaaatatccgcaaaaccatcgtgcacaccatctttgaaaaacatgacccgcacgtcaggccgacccgtataataagatgcgctgtcaagccaatgtgtggcaaaccggcaatgttccacgtctcggcgtcgtatgggaagtcatacgaacgataggacaccacaaggaacgtcgggggcattggacgaacgggggctgggcccttcgtatcgttttctgcccgaactccgtccgcagcatcaatccctagaaaacggtaaagcaacaggattcaagggaaatcgcaaggaatgaagaagacagtcctccacaaagcaatcgcacttctcggcgcaatcaccatgcttgccggcgtcgccgcatgtgggcacagcaacaatgccgacgaatcgggaaatggtctaaaaaaagtgacgttcatgctgtcatgggcgccagacaccaaccacatcggcgtctacgtggcgaagaacaaggggtacttcaagcaggtcggccttgatgtggacatcgtggcggtggcacaggccggcgccgaacaggcggtgaacaacggccaggccgatttcgcgctgtcgaatctgaccaacgtgggcatgtacaccaccaagggtgccacgatcaaacaggttatgcaggtgcagcagaagccaagcgccatctggtgttcgctcgcctcgaacaaggcgatcgaatccccgaaggatttcgatggcaagaccttcgccacgttcggctcgaacgaatccgacgcggtgatccgccgcatgatccagacggacggcggcaaaggcacgttcgacaaagtgaccgtgggcacatccacattccagacgctgtccagcggcaaagccgattttggcgggttctacgccacatgggaaggggtgcaggccgatatgtacggcccgaagctcaactgcttcaccgagccggattatggcgtgccaggcaacgccgacaccatcggcattatcaccagcaacaagaccatatcctccaatccgactctcgtaaggaagttcgtgcaggccaccaagaaggggtatgaatacgcctactcgcatcccgatgatgcggccgcaatcctcgtcaaagaagcccccgacgcgaatctcaagctcgctttcgtcaagaagagcatgaagaccatcgtaaacggccagtactggggtgatccaacgaagatcaaggatggctcgttcgtgttcggcacgaacgacaccaagggcgcgcaacagtatttcgatttcctcgccaaagaggacgcctacaccgattcgcatggcaagacagtacacaccgtgccggtggccaagaacatctcgaccgacgaattcctgaagtgagtctgatgtccgtcaaacgcaagctgattctcgatgtcgataccggcatcgacgacgcgctggctctggcgtatgtctccacgttcgacgacgtcgagttgctgggagccatcggcacctatggcaacgtgacagccgatacagccgtgcggaacacgcgatatgtgctggattggctgggattgcggcatgtgccggttctcgcgggctccacgcatccatcatgggccgattccttcatcgcggacgcgggatgcgcgcaattccatggaacggacggcctgggtggattcgggccggcagcggacccgtctacatccgattcggcgggagcgttcacgctaacatcgcgtaggctgatttccgtaggcggctacaacgtgcacgaccgccatgcgaatccttccaccgattcgctcacgctttcattcaccgcatgcgaccgtacagaaagcacgcctgcctcgccggaaggcgtacgattcatcatcgacatggtccgccggtacggcaggtacgtcacagtggtggcgaccggaccgctgagcgacatcgacgcggcgctcaccgcagcgccggatatcgcggacggattacggctggtgatgatgggagggacgctcacccaagagggaaactgctgggatgcgaccgccgaaacgaacatcatccaggatccggaagcggcggatcgtgtgttccattccggcgcggacgtgaccatggtaggactggacgtcacacaccagtgtctgctgggaagcgacgcgaccgcacagtggcgccagcaggctgcgccgaccggcgtacggacgttccttgccgatatcgccgatttctcgatcgcagcgaatcttcatgcggatgcgcgtctcttctcggcaggcatgccattgcatgatccccttgccgcggccgtcgcattggatccaagtttggtggaatgcttcgatctgccgatgaaggtcgagacgcaaacgggcgatttccacggcacacgcggccgcaccgtcggcgatccggccggcctcatcgacccggccgtgccccgcgtacacgtcgcactgaccgtcgatcataaccgtttcgtggccgacttcacccgtagaatcgccggcatccggcgttgatgtgtgttgttttggacgaaatccggtttgatttcgtccaaaacaacacacatcaacgccgcggcacacgtgcctgctccaatcgatatgccaaaacctgggcgttgtccaaatccctgtagaacatgcgcaccatatctacaccgcgcctacttaggcactgctgtcgatcgcgttcatcatcgacgacctgccgaatggtccgccccgcagtcatcaacggatccacgtacttctgaaccccgtcgaactcccccgcgatcagggtgccgtcatctcgttcccagagaaaatccacccgatgcacacggcctggatggctcaggcaggggaactcgacctgaaccctatgcacaggaaaccccaattcgtccaaaacggcacggcactccgactcaccaccgttttcaacccttccatcaccttgggcaagtacggcacgaatgcgttccctgtcccgaagcatgggaatcgcatccacatattccaacatctgctccacggtggttttcccctgccgcaaagcggaatcaatcggcgccatcgcatagcgacgcggcatcatcgcagcgcaatcgacaagcgtacgaaggatagaggtcacgcgcgcaccatccacagccaccgtttccgcatcatccaacacatggaacctcacatacctctgattcctcggacggctgtttctgccaaccgcgacatgaatcggatgcaactgccggtacgagcaatccaaaccatgcatgaccgccgcgctcgcgccgcagaacgcccatcgctcatgccattgggatagcgaacggagaatgtgccgaagccgctcatgcgggtcgagccgatcccaatattccttgcctgcatacagaccacgatgcacccggacaatgctcccctgcttgactcgacgtacgaccaccttgatgtccgtatcccagaaaggacgcatgcaacaccgatcccgctgcgccttcgcaatcaggagattcagagaacaatgagtttccttttcgcccatccgtgcagtttagcggatgttggggaaaaaggaaaatgtgtgcttattcggacgaaaaccggtctgttttcgtccgaataagcacacattgacgggaacaaataccccctacttcttcacgccaccgaaacgacgatcgcggtggatgtagtggtcgatggagcgccacagcacatcacggccgcaatccgggaacagttccggcacgaagtcgagttccgcgtaggcggcttcccacggcaggaagttggacgtgcgctgctcgccggacgtgcggatcaccagatcgcagtcgggaatatccgggttgtacaggtgctcagcaatcatcttctccgtcacgcgatcgccagagatcttgccgtcacgaacctcgcgtgcaatcgctgcgcacgcgtccgcgatttcggcgcgaccaccatagttcaggcagaacaccacgtcgatggtcttgttgttcttggttttctcctgcgccacttccagctcgtcgatgacggatttccacagcttcggacggcggccggaccagcgcacgcgcacgccccactcgttcatctgatcgacacgacggtggatgatgtcacgcgagaagcccataaggaaacgcacttcctgcggcgaacgcttccaattctccgtggagaacgtgtacagagacaggtaacgcacgcccgcttcgatggcgccggcgatggtgtcgaacaccaccggttcggccgcctgatggccgtcggtgcggatgagtccgcgctgctgggcccaacggccgttgccgtccatgatcacgccgacgtggcgcggaaccttgttctttggaaaatcgggaatgatcgacggatcagaaaacggtgccgccggaatgtcaagggatttgtaatccacgttctcaaaagccatacccgctaatctagcaagcgcatggaacgaatcggccgttccaaatagtattcgccccattcttccactatttggtgggtttcccgttgaatcgacgcggccgccggaacaccgtccagctccccccaatcgccatcgacaagcgccgaaagccggcaaatcgcatcccacgacaccgcttccgattcgggggtgtggtcggcgacgcacatcaggccgccggcgggaatcgaaaaataccaggacagcgtggacgaaatcggctcgccgcacaccacgcagacgcgcagacggggtgtccaaccagcgatcgccagtgcgcgcagcacgtacgaatcgccaatcgtggacggctcgtgcgcatgtttggcaagcgcgttcaacgcgcccaataccagccggtattgtgcgaccgcaggctccttttccgtggcgaccagcttgtcggcggtttcgcagatcacgttcgccgccgtatacgcttgaaaatcggcgcaaatcggccctgcatacgcggcgatcgattcggcttgggacacgacgtcgagcgaacggccttccgcaatgagcagcgccacgcgcatgaacggttcgagtcggcctccgaaacgcgatttggtacggcgcacgcctttcgcgacggcgcgtactttgccatggtcacgtgtgagcaaggtgagtatgcggtcggcttcgccgagtttggcggtgcgcagcaccacgccttcgtcttgatacagcggcatcgcacctccttttcttgccgttcatcgcatcctgttatgcatacgctcgccgcacgtgcgcgttccgaaatacattcgccccgtcagtagatgaacagcccccagaacgcgaacaccagcaatacgcagaacatggcggccacggtcagccagaacatcacgcgtccgaaccgcgtggaagccagcaccggctgccgtccgctgacgatttcgccgatagcacccttacgtggcggccactgcgcgatgcctcgatgggttgcctcttcgatcagccgcatgaacacgcgggaccatgcccacaccacggcgacgcacacgatctggatcaccggccagctccaatacatcacgcccggattctccactggggcactgccccatgccagtttgaccacacccatgatcacatcgccaaggccggcgcagaacagcacgaacgtggccatagtggcgatagtcaacgtgaccagcgagtttttgaacccttgcgcaagccccagccgataccgtcgtccgtgggcacgcgcccagatcttacgcatcagcacggcgagccacagcacgcctgcggcaagcagcagcaccagcatgctggcatgcaacgcgaccaggtagatggtcaggccgcgattggctttgaggtccaatggcactgcgattgactggtacattctggtgccggccacgcgttcgctggtctgtttgagtccgtgcgtggtgccgacggcccagtcgaccacatcgtccacgtacgcgtcggcgaacggggttccggaattggcttcgtcgccgagcctcagcacatggttggcgatggggtacgtgcgtatggtgacgtcccagttgccggcctggtgagccagatcgacgattttctccgtgccttccacctgcgcggtcatgacgtctttcgtgccatatgccaccaatgtcggaatggcatacgctttcggcgtcaacgtgtcgatgtcgaggttggtgagtccgaacagggacgcgtcgatattgaatacgcggcggacgatcgactggtagccgtcatgcgcgccgacgagcgcgaagtcctgtgcggcgaggaagcccagcgaataccgcggctcgtagaccatcggactgagcagcacctgaaaagcgacgtccggatcgcgctgcagcagatacgatgagatccatgtgctttcggaagtggcgtagatgcccactttggaggcgtccaccgtatccattttccgcaggaggttgatgacctggtcgtagatggcggcggaacccgggtagtcgcgattggcgtcgttggtggaccagaccggcttgtcaagcaccgccgtcacgaatcccgccgaagacaggtcggaggccatgtcgccgaaggaattgtcgcaggtgccatagccggcgccgtgcatgaaaaccacgccgggacgtccgttcccagcccctttcggtttgcggatcagcactttgatgttctgtatctcaccggtggaaggccgtttcgctttgatggtgacgtaccgtttcgtcacctcgtaatcgccttttttcgccagtttttcgccggatggattggcgaaggtcacggcggtgttggcgtcaagcgtttcgatggtctgctcggtcggctcgtagttccatgtggatgccgtcagattggccacggacaccagaatgcccagcagcatgatgaaaataggcaggttgaccatgagccgccgcccgcgcgtccacggttgatgttgcggttgcggacgcgcgggcgatgaagccgattcttgccgtaatgattggctggcggctgatgattgacgttcctgctctgacacgccgctcattctaccggcctttgctgagaagcctgcgattgcatgctaccgacggcacgctggaacatggctttcagcagttgccgttttgcgtcaccggcacgaccaccggaccggtggcggtggcaggcacctggccgtcggcctccatctgcgcggcgatctcctgcgccttggcgagcagggtttccacgatctggtcttccggcacggtctggatgaccttgcccttgatgaaaatctgccccttgccgttgccggaggccacgcccaaatcggcttcgcgagcttcgcccggaccgttgacgatgcagcccatgacggccacgcgaatcggcgcggtcacgtccttcaacccttcggtcaccgcgttggccagctgaatcacgtccacctgggaacggccgcaggacgggcaggagatgatgtcgaacttacgcgggcgcaatcccatgtattccagcagcttgcagcccaccttcacttcctccacgggaggcgcggacagtgaaacgcggatcgtatcgccgatgccttcggccagcagcgcgccgaatgccaggcagcttttgattgtgccttgccaggtcgggccggcttcggtgacgcccaaatgcagcggccaatcgcccttggaagccaacagacggtacgtctgcaccatggtgaccacatcatggtgcttgacggaaatcttgaaatcgtggaagccgacgtcttcgaacatgcgcgcttccttcatcgcggacgccaccagcgcctccggtgtcgggccgccgtatttggcgtacagctccttatcgagcgaaccggcgttcacgccgatgcgtagggaaatgcccgcatccgtggcggccttgcagatcgaagggccgacctcgtcgaatttgcgaatgttgccggggttcacgcgcacggccgcgcagccggcgtcaatggcctggaacacgtacttgctttggaagtggatgtcggcaatcaccggaatcggcgattttttgacgatttccggcaatgcgtcggcatcatcctggcttggcacggccacgcgcacgatgtcgcagccggccgcggtcagttccgcgatctgctgcagggtggccggtacgtcagccgtcagcgtattggtcatggattgcactgaaatcggcgctcccccgccgaccggcaccgggccgaccatgatgcggtgggacttgcggcgcggatgcagcgggctttcgctgatggccgcgtcaccggttttgcggaacggtttttcgatttctggcatacgtgatccttgcatgtgcgaggcgcgttatgcgtcccgcgatggttcttacggcttgtgctctttacttgtttatcagcttgtcggcgcgggcgcgagcctcctgctcgagtcggctcatttcctccacggaagcgaacagcgggttgccgcgcagttcggcgtccatctcgtcaagcacttcgcgcacggtgtcgacgatgccgaggtatggcagacggtgttcgaggaacgcgtggacggcctgctcgttggccgcgttgagcacggccgtatgcttttcggacgattcgaggcagtgccgggccaggttcactgcggggaacgcctcgttgtcgagcggctcgaacgtccacgtagccgccttcgtccaatcgcatgcggcggcgacgtttccgagacgttccggcgcggacaggccgagggcgatcggcaggcgcatgtccggcggcgaagcctgcgcgatggtggcgccgtcgcggaattccaccatggaatgcacgatggattgcgggtgcacggtcacgtcgatgcggctcggtggcacgtcgaacagtcggcttgcttcgatgacttcaaggcctttgttcatcagcgtggacgagttgatggtcacgaccggccccatgttccatgtggggtggttcaaggcctgttccggcgtgatgtcggtcatttggtcgcgcttccagccgcggaacggaccgccggaagcggtgacgacgagcttggacacttcgccgtgcgtgccggaacgcaacgactgccagatggcggaatgttcggaatcgaccggattgatctgcttgtcgcgtacctgcgcgctaaacagcaggtgtccgccggccaccacggattccttgttggccaatgccagctgggagcctgcctgcagtgccgcgatggacggttcgaggccgatggagccggtgatgccgttaagcaccacgtcggcgccggagcctgccatggcgatcaccgcgtcagggccggctgtgatgttgacgttgcctgcgccggcctgttccaacgcctcacgtagcgcggggacggcttccttgtagaagatcgcgacggttggcacatggaatttcgccgcctgctgcgcaagcagttcgacatgtgctccgcccgcggcgagacccgtcacggtgaagcggtcgagatgacgtgagatgacgtcaaggccttgggtgccgatggatccggtggagcccagaattactacggttgatggttgcatgggttatgcgctgctctccgtatgatatgccgatgttccggcattggtttggactatgtaagttgggactgtgtagtcgaggctgtgtagtcgaggctgtgtagttgggattgtgtaaacgcgagaacaggctgacgattccgccagcctgtttattaccgttggttcactcgaaggacgggaacgacagatccggaatatcgagattgtcgtcgttgcccgacgccgggaaaatcgacctgaaagccgggcttggttccggctttttgtcctcctgctgcttgtccgcatcggattcggcggacggttcagttgccggggcaactgccggttctacggcaggttcagccggagcggccggctcggccggagcctgttcaacaaccggagccggagtgacaattgggttcgaatccggaaccggagcggccggttcaggcgtgaaggatggcggcaccgaggctgcgagggagctcaggctcgtcgaaccggtggtgacctgaggcaagtcggacgcggacaggctcggaacctgcggcgtgaacgtgttttccgtctggttcgtctcattgatggtgtgggccagatgcgccaacgcggccaaagacggatcctgctgcggctcgggttcaaccggagccggcgggaatgccggagcggctggagcctgcgaatcggtcgcggtcggagccggagcctttggcgcggcatcttccatcgcatcatcggcaagcggatcgaacgcctgggtctcttcaacggcgctcggcgcggaagaagcggaatcggtctgcggctggaacaccggaggaaccaccggaaccgcaggcggagtgttcgtcggcgtggcaggcacgctcaccggggaggtgaccgcggacgtgaagatctcatgctcggccttgttcagcgcatcgaaggaatcctcttcgctcggcgtgacggttggcacagtaggaggaaccggagcagccggaaccgtggcggaaggagctgcgaacagcggtgcgatcatctgggtttcgccagctgcggaatcactggaagccggggcaacggacggtgcggccgcggccatcgcctcttcggagggttcgccgacgaaatccgcgacgcgcgcatacgattcgagtcgggtcagcaactgcgcgcaggcggccagatagtaatccacctgacgttcgtcgtatcccctcttgcctttgcgctgagtgaagatcacgttgctcaaggtctgggaattcgtgtcggcgatcgccttggcgtccgcttcactgacttcctcgacacccagctcgccggcggctttcgtcaggcacttgtcgatcacgctgtcgacctgcttgcggtcgtagctcggattcttgccctcgcccggcttgaaccgttggccgtgctcgcgttcggcatgcgcgtcgagcttcttgaacaggtcctcggtctgcgccttccatgccacacggccatgctgggagatttcccacgtggtctgcttgtcgaccacggcacgttccagacgggcaagcgcggcatccacttgggcgatcacatagccgcccttgaccagttcgaaggagacgttctgaatatcatgctgggtgagttgcgcgccctcaccttcatacagcatgtgcgcacgttcaaggaaagcatccacctgttccgcatcgtagccccactttcgcttcgcggcatgagcgattcccgatgcgttcttctcggtttcaggttcctgtgccattggcgttcgacctcctgctacacgtattaacgccactactttacgtgattgattcgacgcagacgccgcaaaagatgaaaattcagtgaatcgacacgtgcggctcatcgcccacacggcggtttcgtaccgatcaagcggcatcatatccgccatgccgacacacgagtgcggctcatcgcgcggatacggtacagtagttcgttgcgggcgattagctcagttggttagagcgccacctttacacggtggatgtcgggggttcgaatccctcatcgcccacttttcgcaacgccgtgaaaaatcaaggaatcgcatatcatcccgcgtaatatcaacgcgcgcacccgtgttttgcccacattccgcccacgttttgtttgtgttttgccggaaagtccacgtaatagcgaaatcccccaaacccaatgggctcgggggattttcgtatacgcgagaaaaatcgcgaaaagtcttggtttacttgcccttgccgaacgcgcgcaggtgaataccgttccaatcggagctgacggtcagcggagtggcggcattcatgccggcggtcttggccgcggactgcacggtgctggagcttgcggcacccggacgtcccggcttcggggtgagcacccacagcgggccgtcatcgccgagaaccgcataggcgtcgacaatggtgtcggccagttcgtcctcatcatcgccatcacgccaccagatgatcacaccatcgactgcggagtcataatcctcgtcgaccagctcctcaccggtcagttcctcgatcttggcgcggatcgagtcatccacatcatcgtcccacagccattcctgtaccaggtcgccggcgtggaaaccgaattcttcagcgttatcagatgccgtttgattcacgttcgtcaatataccaacactgctcgaacatatacgttacgaacgccggaatcgcccacttttcgagatgaaacggcgatttccgcctgtatcacgcctatctccttccgccgcacgctcattgcttgacggtgcattgcggcagtgaaccgcctttaccatcgcggatggcgaccagcgcgtcgtacgcctcgtccaacgtgcccaccttcaccacgtggaggccctgtggcacgtgcccgaccacgtcggagcagttggattccggggcaaggaaccacgtggccccgtcacgcttcgcgccgatcatcttcaaccggatgccgccgatcgcgccaaccttgcctttggcgttcatcgtgccggtacccgcgatggtcttcccgccggaaagctgctctccggtcaccttgtcgatcagaccgagcgtgtacatcatgcccgcggacgggccgccgatgtcgtcgacgtgcatggacaccttcataccggacacgtcataaccgtgcgccttgaggaaccgcttcgcggccgtggccgcggcgctctgcgatgaggacatctccttgttgctttccttcgcatagtccttggcgctttgtccgacggggaacacggcctcctgcggaatcaccgtggccttcggattggcccatgccagcaacgcctgcgcgttggtcacaggatatccgggaacgcctgaggcgttgacggtgacgagcagtagtttgccggagtccttatgcgtcttcacgccggacacgtcgatgacctgcttgccttcgacttttccgagcacgtcctgggtcggtcccggctcctgcaccacgtacgcgctgggcgcaataagcaccagcacgcagagcacggccacaatcggtccggcgagatatcgccaagggcgaacatcgaaccaccgtccgacctgacgccaacgtcgtctgatacgtggcagaaggccttgagacgacccgttacgtgtgcttttggcgtgaactcgctgtgtttcctgcatatcggccatgcctcccatactatggaaggcaacgaacttaacaatcgcgtggaacaaaggcaggaaacggtatggatgagaatgcgatccgccagtggcttatcgattgcttcggaccgattcagggcgagatggcatggaaccagctttccaacatgccggaagccgtacgcgaccagctgatgagtcaggatccgagcacgctgcccaagcccgaagaggtcaagtccatgatgcaggcgttcaccgccggcggactcaacaccatgggagatatgcagcaggccgtggaacaggggccgatcaacatcaaactggcgaaatcgctcgcgttgcagcaggcgaatggtgccggatcggacagcagcgtgaacgccgaaaccggcgaaatcgcaagacgtgccatcagcgaggcgaacctgtggcttgataccgcttgcgagttcaacccggcgcaaggcgagacgcagctgctcacccgcgccggctgggtggaggacacaatcgacgcgtgggcgcagttcgcctcccccgtggccgaatcgatgaacgacgctctggcttcgattctgtcgcagcgtttcggcgacggcgaaatacagaccgagatttccggggttttcgcaggccccatcgaaattccgattccggacgagatgaagaatccggcgaagctgatgcgattcgtcggcaacacgtcgttcgccatgcagttggggcgtgccgccggcgacctgtcccatgaggtgcgcggcagcttcgatcagggcatcgcgctgctgaagaatcccgccggcggactgatcgtgcagaacgtgaccgaatacgcgaagtcgctggatatcgacgtgaacgaagtgatgggctatcttgcgctgcaggagcttgcgcatgccaggctgttcgcctccgtgccgtggctaatgccccgcttcgaggcgctgctgggcaaatacgcgcgtggcatcaccatcgacatggatgccatggaggagcagatccgtgaggcggagtccatcgatccggattccatggccagcgcggtgaacatcaccaaggtggcgttcccggacactccggagcagaagcaggccatgaaggcgttggagaatctgcttgccttggtggagggctgggtggatgccgtcgtgtggcgtgcgggcatggcgcatattccgcatatcgaacagcttcgtgagatgttgcgccgcgaacgcgccatcggaggccctgcggaacgcacgttcgaaagcctgatgggcatgcaattgcgccccaagcgcatgcgtgaggcggccgcgctgtgggaaagcatcggcgcgcaggaaggccccgaggcgcgcgacgcgaaatggtcgcatccggatctgctgccgcaactgccggacgagcagtccgaggatagctccaacgaagagaacggcgccgcatccgccactaccggtacggaacagaccacggcgcaacaggatattccggacagcatcgattgggatgccgaactgtccaagctgctcgacgaggaagagcacaagggcgatgacgccgacagcacgaacgacgccgacggcacagatgacgccggcgatacgaacgcttccggcgacccgcagtcaccggaagaagcgtgatttcctgcgcccgcgatcggacccatcgtcctcgcgggcgcgcgcataggacacgtcgagcgtgtcttcggcacgcgtgaccgccacgtacatcaatcgccgttcctcttccagaaggtcgccttcgggcggtgaaccgtatggaatcagcccttcggagcacccgatcaggaacacgtgtttgaattccaggcccttggaggcatggatggtggagatggtcacgcctttaacgtcgccgcctgcgccaagtgcttccaacatggccaagcgggtctgagcgtcatccgcgagcccggagttctgccatccgctgtctcgtttgacgcggtagcgcaggtgttgttcgtccagtgcccggcagaggattttctgctgcgcgttgactcgggtgaggatggcgcagtcgcccggagatgctccctcgtccacgagtctgcggatgcgtgcagccacgccccgggcttcttcgagatcgctgttgtagacggtttgcgcgactcggcggccttggtctcgcttggagttgagtttgagatagtcggcgcgttgcggtgagacttcgagcacgcggttggcgtagttgacgatctgcggggtggaacggtagtcgttgttgagtctgacgtcggcggtgaggggtccgaattcggaggcgaagttgagcaggttgtagctgctggctccggcgaacgagtagatggtctgtgccgggtcgccgaccacgcagatgttgcggttgtcaccgagccatcgggtgagcagccgatgctgcaggggcgagacgtcttggtattcgtcgacggtgagccatgtgatgccggagcggatgttggccgccacgtcttcgtcgctttcgatgaggtggcaggtgatgagcaggatgtcgtcgaagtcgatttcgttgcgattggttttttcggtttcgtatgctctgtagacgtccacgaattggcttggttccagtcctgccggcggctggtggtggatggccgcgcagacgcgttcatagtcttccggcgcgatgagcgagattttgcaccagttgatttcggcttgcaggttgcgcacggtgtcgtcgtccacctgctgggtggtgactcggcgtagggaatgttccacgatttcgcgcggattgcgtgagatgaacggcatgggcccttcgcatacgtctggccagatccgacggagttggtgtagtgccgcggagtggaaggtggcggctttgacgtcggatgcgacgtcgagttgggatagtctgttgcgcatttccgcggccgctttgacggagaaggtcacggcgagcgtggcgcgcggatcccatgccttggtggcgcatgcgtaggcgattcttcgggtgacggtccgcgttttgccggcacctgcgccggcgatgatacagacgggaccgcgcacggcggtcgccgccatgcgctgcgcatcgtccagtccgtcgagaatcgcttccgctgttgcatccatatgctccattgtggcagattgcgtgacgagacggacgccatcggcgcgattaaccgtgaattcgtggcaagtcgcgcccttattagccttcagtgtgtattaaggttggaattgtgaccgaacgaagcagatttatgatggccgccttggcgagcgcggcgatgccgaacgccaccatcgctggcacgcgtgacagcgagcaggtcaacgccaccgacaaggggtatggcattgatcatgccgtggtgcaggacgccgcgggcaagttgtatgacacgttcgcttcgaacacaccgaagggacgcaagcgtctcgttggtcgcgtgcgtgccgcgcagacgttgatgggcaaccgcgagttgggcggattggggttcgacgtcgatcgcgttctggcgttctccaacggcgaacaggagaggtccgtcacaggagacgtttccgtaatggtcgccacgcatcatgatggtcaggcgcgtccgctgacgctgctgacgttggacgactgtgccagcgtgggcaccgcgttgggcgcgatacaccgtcttcgtccggattttctgcaggaggccggctatccggtgttctccacggggcagattcgcgcgcagctgaccgcatggatcaagcgtttgcgtcaggctggccatgtgccgcaggagatcacgacgagctggtccgacgttcttgaaacggacggtctgtggtcgttcgccacttgtccggtgcatggtggcctgtccgacggcgatgtgctgttctcgggctcgtcgatcaccgccatcacgaactggcaggatatgcaggtcaatgatccggcgcgtgatttggcgtggattttctccaagcttgacgagaaccaccgtaatgcgctgctcagcgcgtatggacgcatgctgggcaatcgtctggatgatctgatcatgctgcgtgccaacctgtggctgcagatggaacaggtgggcgatttcatcagcgcgttgaatcaggccgatagcgtcaagatcatgcagttcaaggcgcaggtggagcgtttggctcaccagttgggtatgctcaccgcgaagaaccacaggccgagcgagacgcgtcaggacgagcagaaggccggcaaccgtccgccgagcaccatcaccgtgggcacgctgctggacgaatcggaacgccgcaggcaggcggcggcgcagcagaataacgatgccgacgcgaccggcgaacgtcatatcgacgcgaccgatatggatgatgacaggaccggcgatttcgatgtcaccggctcccagcccgtccgtaagacgaagcaggtcgtcgatgacgccacggaagcgttcgatgtgaccgccgccgaacatatcacctccgccggcatggtttccggcaatgccgattcggacgatacgagcgaacgtgaggaatcccccgtcagcacgttcgttccggagcagtccgcgagggagcgtcacgagtcgttgccgtccagttcaaccattgtgatcagcacgttgcagaccgccgatggcagcgatgacacgaacgaggaggaaattcctcaagcccatagcgaagcggcgaccatgctcattccgctgctcgaacgcgatgaggccactatgcagaaggccaaagcggaggtcgaccggctgcaggccgaggacgccaccgatgagaaaccgcgcgtagaataagcgcatacattgcaaacgaatttgcacacgaacacccttacaaggagcatcatggatatcgaactgggcattcagaacgtggcgcgcaccgtcaccttcagcaccgagcagagcgccgacgaagtgaacaacgtcatcgccgaggccgtggagaatggcaagaccatcaacctgaccgacgacaagggccgtcgcatcgtggtgccggccggttctctcggctatgccatcatcggttccgaaaccaagcacgccgtcggcttcggcaatctctgatcgccaccaacaaacgcgttggacacgttccatatgaaaaagacgtcggaccatatcaggttcggcgcctttttcatattcgattcatgtatccggttcacgcttggaaattccatatccggatttcatgcggcatgtgagctgccgacgcgaccgatcaaatccacaccccggcacaagatttcgcgtacggtgtcgtcgtcggtaaggttctcgcccagaccgttcggcttgcctttgccatgccagtccgagccgccggtcaccagcagatcgtgccgtgccgcaatcgtcagcaatcgttcccgctgttccggaggattgccgcgatgccatacttccaagccgtccaagccgtcggcgatcatcgcgtcaagctgctcgtcggacagcagccggcggttgcgttgcggatcgcccgcatgcgcggcgaccaccacaccgcccgcccccttgacggcggcgatgacctcgtgcgtcgacggcgacggcgtgggaatgtaatacttggatttggcgctcaccgcgtcggcgaacgcgtcggaacgcgtctcgtacacgcccgccgcgaccagcgcgtcggcaatgtgcggacggccgattgtggtgcgttccccttccttcacttgggcgagcacatcgtcccacgtaatcggaaaatcctgcgacagccgctcaaccatgcgtttcgtacgccgcaatcgcgccgcacgcgtgttggcgaacatgctggaaatatgctcgttggacggatcgtattggaaggcgagcatgtgcacggacacatcttcgtcgacggcagtgatttccgtgcccagcagtaacggcaaaccgatttcctccgaggcttccgtcgcctcgccccagccggcggtggtgtcatggtcggcaatcgccacaccatgcaagccaagcttccttgcctgctccaccagcgtgcgcggcgtctccgtaccgtcggaaaagacggtatggcaatgaatatcccaaccttgtgcgggtggttccgcgtaactcacgtgactcatatgactatcgtaagctcgaatccgcggtttttcgcgtagactgagacatgacaacgtttgtattttgattttccaaggattgacgatgagcgattttgaaagccaggccgctgtggacgcagccgatgacgaaacgagcgtcggcacagccgtcgccatggacgacgactacacgaagccgcgcggatggcgtcacggcgcaacgtggacgtatctgatcatgctgctcgcttcggcggtggcattgctcgtatcgttcattctgtcggcggacacgctgaaaatggcacgcaatcccgggcagaagctcaactgcgatgtgaacgccgtgctgtcctgttccacggtggccgaatcctggcaggcggaaatcgtgaagttcgccggattgagcttcccgaacgcgttcttcggcattgccgccgaatcggtgttcgtgacgatcgcggtgatcggactggccaagatggccgtgccacgttggttcgcgctgtgcacgtggcttggaggccttgccgcgttggcgtattcgtattggctgaccacgcagtcgctgttcgtcatcaacgcgatgtgcccgtggtgcctggtgctgatgttctccaccaccgtgcagttcatggcgttgtcgcatgccacggtggccgtgcaggatatgccgtccggccatgctggattgcgcaagtattaccggctgaatttcgatctgatggtcgatgtggtgtggattgtggcgttgatcgtggtcattctcgtcaaggacggcccgatgctgttcgcctgatacggtttgcatcgaaccttttacgatgaaggccgaccctgcgtggccggccttttgcctatccgcttttcgtttgctgccgcagcggttacagcagttcgattttgcccacgatggtggcgctgccggtaagcttcacgtcttcgtcggtcacgtcaacacgcaaggtgccgccacgtacggtgatggtccaatggtcgatgccggttttggcacgcaacgtgatggcggtggcgcataggcccgtgccgcacgacagggtttcgccgcaaccgcgttcgttgacgcgcatggtggcctcgcccgcatcgtcgccttcgctttgctcgtcgatgcgcacgaactccacgttctggtccgacggaatctcgggcgcgacgaccggcttggtgaccagatcaaggtcttcgacgttcggcaggctggcgaacgcgtcttcaagtacggccacgacgtgcggattgcccatgtccacgaacgtgccacgtgcggaaccggacgtgcccggaatggtcacttcgtaaccgtcgacgtcgccacgcttccatgcgcccatctccacctggaacacgtccttgccaagccctggcacatcgccgagcgacgtcaggaccttcacgccggcgcgggtgccgagacggaacggcttgccgcccggctggtcggcgatgccctgccgctgcgcgaacaaggtgatcgcacgtgtgccgttgccgcacatctcggccagcgagccgtccgcgttgcggtagtccatgaaccagtccgcatcgcccgccgcgcaatcggcgatctgcctttcgttcacatcggacaccgcctgcagatgcgccagacggatcaggccgtcgccgccgatgccgaaatggcggtcgcacaggaatcgcacttcatcggcggtcggctcgtgcgtaccgtcttcgtcgagatacaccacgaaatcgttgccggtggcgtgcgctttgtaaacaatgcttggaatgctcataccagttcactctacacgcggtaggctattgaaagcgtttggcgtatgcgcctgcgggcgtatgcgcgatggcaaaggaggacgtatggcttcaacggcacctatcggcgttttcgattccggtttggggggcatttccgtggcgcgtgagatccgccgcgacatgccgaacgagcatgtgctgtatttcggcgactccgcgaacgctccatacggcacgaaatcgcccgaacaggtgcgcgaactgtccgacgtcattgtgaaacgattcgtggaacaaggcgtgaaagcggtcgtgatcgcctgcaataccgccacttccgccgcagccaacgaactgcgcgacacatacgacattccgatcatcggcatggagccggcattgaaggtggcttgcgaccgtggtcacggcaagcgtcagcgcgtcatcgtggccgccactcccctgacgttgcgtgaacgcaagttcgccgtgctgatggaccgtttcaaggccgaccatacgatttttccggagccctgccccggtctggtggagatcgtggagcatgggcagcttgacgaccatgatgtggtgatgcgcacgctgcaccagtatttcgaccaatacgatctgtccacgatcgactccgttgtgctcggctgcacgcatttcgtgttctaccgcgattatttccgcgaactgctgcctgatacggcggcgatcatcgacggcaatgaaggcaccgtacgtcaccttggcgtggtgctcgaatcgttgggcaagctcgctccggaagacgcggaaggcagcatcgatctggccaattccgacacttccgcacgaatcgcgcagttggcgcagtcgctgcttgatcgctgagcgcgaatgtcccgacagaccgcgtaaagtcgaatgaaacccggcaaaagggacggacttgcgaaaggacgggcgcatatggccaacaggacagcgatgatcgacgtcggcggcggtttccgcgcgatttacggcgcgggtgtgatggaccgcatgctggaggacggcatacatgtcgaccattgctatggtgtttccgccggcagcgccaatatggtttcctacatttccggacagcacgggcgaaaccacacgttctacacgcagtacgcgttccgtaaggaatacgcgagcttcgacagctatgtgaagaaccacaattacgcgaacctcgattatgtgtacagcacgctgagcaaccacgatggcgagaatccggtggattacgaggcgtttgcggcgaatccgaccgaattcaccgtggtggcctgcaatgcggacgatggttccacgaagtatttcgacaagtcggacgtcggctacgacaattacgacatcatgaaggcgtcatcggcggtgccggtggcgtgcgaaccgtatgtgatcgacggcgtcccgtattacgacgggggcatcgctgatccgattccggtgcagaaggccatcgatgacggctatgaccgcatcgtggtgattctcacccgtccgaaagacaccgtacgcgaacagaagaaggacatcggcccggccacgatcctgaagcgcacgcacccggaggccgcggaaaagctgatgaaccgctatcagacgtacaacgacgaggtggcgttggccaaggaatacgagaaggatggccgtgtgctcatcctcgcgccggaaagcatgtacggcttgaacacgctgagcaagtcgttcgaaggtctggaacgcatgtaccgcgccggctatgcggcggcggccgcgattccagcgttcctgggaagctgaaatccgttcttccgcagcgctgtcatgcgtttccaacggccctaacggcaaccgtatgacagtgatcgcatgacagcaatcgcacatacgacgattacatggcagccgtcatatgtgcgttacggcatcgcaacacgcgtaaccggggcggcggctatgctggaacgcatggaaaagcagaatcgtattttttccggctttgatgccgatgccatcgatcgcaccaccgccgcagatctggccgaagtcggttccgacaagtggacccgctaccccggctgtatcggcgcgttcatcgcggaaatggactacggactggcgccgtgcatccagcaggccatcgacagcgcctgcgaccattgcaaactcggttacattcccgaaccgtggaagcgccgcgtggccgaggcgtgcgccggctggcagaaaagccactatggctgggacgtggatccggacatcatccgcgtggtgccggacgtgttggaagcgtacgagatcttcctgcgcgagctggtcggcgccggcaatgccgtggtcgtgccgacgcccgcgtacatgccgttcctgagcgtgccgaagctgtacggcgtcgacgtgatcgaaatcgaaatgcttcagggaaccgacgaaacgaccggcgagcgcgaatggctgttcgatttcgacgccatcgaacacgcgttcgcggctggctgccatgcgttcgtgctgtgcaatccgcacaatccgatcggcaaggtgcttacgttggccgaggagcagcggctgtgcgagctggcggaacggtacgacgtgcgtattttcaatgatgagattcacgcgccgttcgtgttcgaggggcgtcatattccgtatccgaccatcagcgaggcggccgctcagcagtctatgaccgctaccagcgcgtcgaagtcgttcaatattccgggtacgaagtgcgcgcaggtgctgctgacgaatccggcggaccgtgagatgtgggcggaacgtgcggagtggagcgagcatcagaccgccacgatcggtgcgatcgccaccaccaccgcctacaacgagggcgatccgtggttccaggacgcgctttcctacgtgcgacgcaatcttgggttgttcgatgagcagatgagcacgcggttctcgggcgttggctatattcgcccgcgcggcacgtatatcgcatggctggatttcggcccgcttggcattgacgatccggccgcgtatttccttgagaaggcgaaggtggcgctgaccgacggccgttcgtgcggccgcgcgggagccggctgcgtgcgcgtgaacatggcgatgccgtatccgctgctggtggattgcctcaaccgtatgcatgacgcgttgcaggcggacggtttgctttaaagttttccgtctttcgtgtgtgaccgacgctatgggcggccacacacgccatattgcgggaaaatccgccgaatcattgcgattgcaacggttgcgctatgggcgaatagcagcatgttacgatggccgcacaccaccgtcggtggacgcgcgacgcgaatccagcgtatgcgtttcattgagaagaaggctttacgaatatgcgattcccctacagcggcaacggcacatggacgcccgactaccactgcggtttcattgatgccgtcaaacgttttttcatcggctacatggagtttcgggggcgttccagcagacgcgagttctggctcgccatgctgttcttcattccggtcagcgtgctgatattccttattccggctgccggaacggtgtccggaatactgtggatgctggccaccatggtaccgatcatggccatctccttcagaaggctgcatgatgccaaccgcaccggctggtggtttctgcttgggcacgtcggcaccattctggcccttgcgatgctggtcgtcattgcgttcggcctggtcatcatcgaaatcggcatgatcatggtcatcccccacgagccaccgaaactcgactttcatgacccgaacagcttcccgggaatgctgctcacgctgttctatgtcagcctcggcatggccggcatctcgctgatcatccaagcattcctgtactcgctgcccagcaagcccgagggcgtccgcttcgactgatgttctcagcggcatcccgcccctcttccctccctgcattaccctcttagcccttttgtatggaaacgttccatctcacattgagacagagcagtgagctcggttaacaaaactcctataatcacgtctattgtctttccgccgtcataagcgacggaatgtcaacatcagaggagaaaacaatgaagagaaacatgctccaccgcctggtcgccatggccgcggcgggaaccatgctgatgtcggtcgccgcgtgcggctcgtcatccgatgacaacgccgccaccagcaattccagcgacacctcgctgatttccgtgaacaacagcgagccgcagaacggtctgattccgagcgacaccaacgaaatgggcggcggcaaggtcatccgctacctgttcgaaggtctggtgagcttcgacgcgaagggcaggcaacatctcgaagtcgccgagagtatcaccccgaacgaggatgccaccaagtacacgatcaaactgaagaagggttggaagttcaccaacggcgaggcagtaaccgcccattccttcgccgacacctggagtttcgccgccaatgtgaagaacgcgcagaagacctcgagccgcttctccaccatcaagggctatgacgagctgcaggatccgaacgtcgatccgaaggccacactttccggtctttccaccccggacgactacacgctggtcgtcgagctgaacaagcctgattccgtgttcccgaccaagctcgcgcaccaatccatgttcccgctgccgagcgtggcatttaaggacatcaagaagttcggtcaggctccgattggcaatggcccgtacaagttcaagtcctggtcgcatgacaagaacatcatcatcgtgccgaacaaggattataagggcagccgcaaggtatccaacaacggcatcgaataccgcgtctatacgaatgaggattccgcttactccgacgtgctgtccggcaacctcgacgtgatggatcagattccacagtccgcggtgaagaccttccgtcaggattccagcgtgatcgcctacagccaggcaggatcctcattccagtccttcgtcattccggaacgtcttgagcatttcggcaacgacgaggaaggccaattgcgtcgtcaggccatttccatggccatcaaccgcgaccagatcgtcaagaaggtttacaacaacacgaagaccccggccaccgatttcacttcaccgctcgtccccgaatatgtgaagaagctggagaagaacggcgacaacctgaagtacaacgcttccaaggccaaggaactgtggaagaaagccaatgccatcaagccatggtccggcaacttccgaatcgcctataatgccgatggcggccataaggaatgggtcgatgccgtgtgcaaccagatcaagaacacactcgacatcgacgccgctggcgagccgtacgccacgttcagcgacgtgcgtaaccaggtgaccaaccgcaccatcaaaaccgcgttccgtgccggctggatgctggattacccgtccgctgaagattatctcaatccgctatatgcctccagctccgctgacggtcatggttcgaacgatggtgattacaagagcgcggaattcgacaagctcctgaacgccgcgctcgcccagaccgacgtaaagaaacgaaccgaggacttcaccaaggcgcaggaagtgctggccaaggatcttccggtgattccgctgtggaacgacaacgtcgccgccgcgtccgcgacgaacgtgaagaacgtgtcgttcgactacaccaacctgcctacctacaacaccatcaccaagtgacggcttcgttgtgacgtttcgctgccaatcggcaacgaaaaacgagtgggggttcgaatccttaatggattcgaacccccactcggcgttttgcagccgtttcgtttatttgcttacggcgtcaaacctatggcgtcagctctgcacgtagctgcccttcggggacttccaaccgcagttcatcatctcgctgttgaacaccatcgcaccgtcgccatgggcggggacgacgatcatgccaccgtcgccgtggtgacgggccacaccgtccagcgcggccttcgcagcctcgaccggatcttccttggcatacagcacacggtcagaaacctggtgcgcggcgacttccttgacgaacgcctcaccgatgccggtgcaggagatcgcaacggaatcgttgttggcgtaagtgccgcaacccggcagtggcgaatcgccaacacggcccggcatctggttggtgatgccgccagtggaggtgccggctgcgatattgccggacgcgtcacgtgcgacggcgccgatggtgccatgcttctcccattcgtcgccattggactgcgcctcacgcagggattcctgacgggccggggtgatgaagtactcgctgtcgcacagttcgatgccccactccttgagcaggttatcgcccggcttggcgaacatgacgtgcttggtcttctccttgatggcgcgcgccacattgatcgggttcttggacgtggtcagaccgcatgcggagccgacttcgccgtcaacgccggtcatcaggcaggaatccatggacacgatgccttcgctcgtcaacgcggcgccacggccagcattgaattcgggagcatcctccatgacacgaatggccgcgcagacggcatcttcggccggagcgccctgttccagcagcgcatagccggcttcaagggccctgttcagatcctgctccacctgggcgcgacgttccggcgtgtccttcttgccgcgattgccagcgcctgcgtggatcaccagaaggattccatccggatcagcctgggcaacccggaccgtcgactgcggcaatgctgcttcgtttgttgacatcttctctccttcagatatctcgcttatgtttgacattcgcagatatcttacgccggttgcggcaacgaagcgcccgacatgcgcaaaagcgatgccgtcgcgccgttacgcaatcaaaaacatatcgaagcgcgactgcgtcctttcttacgtttcatacttttgcaaatcgcaatctcgtatttcatggtgctcctccgttggtagtgccagtatgtgtcaagcgcatcgttccccggacaaaatcacgttcttaagcaaagccacgcttgtaaatcggaaacacaagtcgtcgtggcccctacggattcatgtatatcgaaatggctgaaattattatccatcgcaaaaactctcgtaagcaacacttatcgagataaatgtagcttattttaacgttagctacacttatgcggataagtgtagctaacgcacatgcgatgcgactgatagattggcaataaatggatattcgtatacttattcgtatacttttttatgcgttttcaaatctcgcagaggagaaacatgtcagccgcatcgatccttgacagcatggtctccgtcaccagccttaaccacggcggagcaagcaaagcattaagtcaggtgggcgacaaccatccagtcgtcgtactcaaaaacaatcagcccagcgcggtcataatcacgcccgccgactatcgccggctcactcaggctgaagaaaatttcgcgctataccgcaaagccgtggaacgcctacgcaacgatgacagcacactgctaaccgatgcagacgtattcggcgaagattatgagccgattgatgacggttttgaaccagaattcgaataaggtccatcaacaaccggcaagtggacaattttgtatattttgatatggcgatgcaggttatatgaaatcaagaaatcgacgtcttgcacagccggattgaatatagtggatggcattgcgatacgtacaggtttcacttttggtcggagcagtatccatgtacaaaggcgatttatcaatcacacgaggagctgactgaaatggcagcgttcggcaggccggaatatgaccgttatgtacgtcttgcggaaatgatgatttcatttctaagagaccatggatacaactacgacgccaatctcgatcaagacatccttgaccatgatggaccgggagtgccagtcgaaaatggcgttgacgccatcatcgagttcaacctcactcctccgaaggatatgatcaccttgtttggacaagttcatgatgaaaatccttggtgcgacgaggaatacgaacaatttcgcgattacctgcgagaacgcgaagatgagcaccaatcgggtaaattgattccgccatccgcagattagaacgccgacccccacacacacaagtaataatcgtttgcactgttcatcgtagcgggcgcggaactcattctcacttcccgcagtgacaccgtatgccagataaaaaaaccgggaacggacgcgacgtttgaattacgacgaacccgactcccggcatcgcgactgcttctcaaaagatgtgtgcttgactcacatggatggtactgagaaccattcgcttgcgatctgcttccgcacacatgctggcgcgatgtaaatacaacgcaggcacacggcagatacaaatcaagtctgtgcaaaacttccagccagcaaagaagccgaccggaaagccacaggccactctagtcgtatggtcgaatattcacaaattaactgaccaaaccgacatatgtcatgtgaagtgagcgataaatcaaaaaacggcagttcaaaagcggaccatctcaatacacgtatcccatatgggatacgaccggtagtgaaggtccggtcgtacacgcttatcgtatttcaatccacgcatcccgtatgggatgcgacttgccacgattaaacatacatcctcctttcgtgttttgcttcaatttttcttaagcaatttctgcactgtttttccgcagcataggctgctggtttccagcggaaactgcaccatatgaccgcccagacgaaaacaggcaccagcccgccgtgcctgtatattcccgagacgtaacccaaaaacgaatccgccggctgcaaccggcggcgctcgggaaggaaaggacgatggcgataccgatgcccaaacagcaagatatcaggagactggaccgtcagggagtgtccaggtcggagatcgcgaggaggctgaacgtggaccgcgccactgtcgcgaaatacgccgacatggacgacatgacgccgaaaccgcccgcggacaggcgccgcggctccaagatcgacccgtacgcggcgttggtcgacggatggctcgaggccgaccgcatgctgccccgcaagcagcgccacaccgccaaacgcgtgcacgacaggctccgcgcggagaccgagtacgacggcgagtatacgacgacgctgaggtacgtgagacgctggcgcgaggcgaaccggagcggttccgacggatacggcgagctcgtctgggcgcccggcatcgcgcagatcgatttcggcgtggcgaaggcccgcatcgccggcgagctcgtggacgaccactgcctggtcgtcacgttcccccattcgaacatgcggtatgtgacgagcctgcccggggagaacgcggaatgcctgtgccacgggctgatcgaggtgttcgagcacatcggcggagtcccgccagtgatcgtcatggacaacgccaccggcgcggggcgcaggaacgcgaggggcgaggtgacgcccgccgcggtgctcgacgtgttcgacatcaaaaaatcgctgtcacacaagggcaacccctacgacaacgccgtggtcgaatcgacgaacaggccgctgaagaaggagctcgtgtaccggaaccactacaccacgatcgagcagctgaggcatgaccccgacgactacgtgtggtggtccgacaaccagcggctccactccaccctcggataccggagcccgaaggaattcaccgaacagggactcgtcctctaagaaaccgtccaacacgctgttgccaatccagcggtcagccagccatccacgatggccgcgtacccgtcgtcgaccagcgagctgcccgcgcgggcgccgtctgacgattcgggcgaataatcgctgcggtcggcgtacttgaccacggtcgtgcgcgatacgccaagccttcgtgatatctccttgtggctcaggccttggcggtcgagctgcctgatacgctgtcggacacacaccggtgtcgtcatttcctttcctcccgagaaccatcagtttggttgacaggcactcgggaatccatcaaggaaccagacggtgccggtgttcttattccaccggcaccgtcaccgccggcaatgtccaaattgaacgctcacggtgtacagaaacaagtgccgacgccgaacacctttattcgatcacatacaccgcgacaggtctctgatgcctagtcctttctgacccatttcggttttcatcgcctcatacagctccatcgttgtgacacagtccgcgatggctcgatgttcattgttcgtcagattcagatactcggacaaatctgaaagccggtgatgaggcaaatcaggatacagttttctggcaaactgcatcgtatccatgtactcgttattgatgttctcttggaatcccgcggcgaggaatcggacatcaaaggacgtgttatgaccgacgatgatgtcgtttcccaaaaacgcgaggacatctcccttcacatcttcgataggcggcttgtccgccaccatttcgtttgtgatgccagtcaggctggtgatgaatccgtctattccatacttcggtctgatcagctgttcatacctgtcgatcacatctccactgcgcaccttcagaattccaatctcaatcacctcgtcataataggcggaaagacctgtggtctccgtgtcaagcacgcagtaatctgacactatcctttttaacgtagttgctcattgcttttcctcctgattctctgatttcccgttcaagccttcgtagccgttcctcgcggtcagcctttctggaaagttcgcattcccatacgactatcacgttccatccgtcagctttcagctgattctgtacatccctgtctcttggatgtattccggtcgaatttcctctgccagaattcacggttgtggacggtgtagttgcatatctgcatccgggatgacggtgccagaagcagccgtgcacgaaaatcaccgtatggtatttcggaagaacgagatccggtttgccgggctagctgctgtcattcttgcgatacctgtatcctttcgagaacagatactttctgacgattccctccggtctggtgtcctttcctcgtatatgcgacatattgaaatgccgctgttccttcgtcaaaacgtctgacaccggcatcacctccgtatgtcacacttccctgaatatcttcttgaagataagctgtgtcatcacttcgtcaagctgcttcgccgtgttttccgattcaatcagtgccccgagttcgatgttgccctgctgcccgtggtatgacaggtttgccgatgttatcagcgtctgtttcatgtccacggatatgaccttggcgtgcagcgcagccatcttgtcttcgtcgttgctgtagtcgtatatctggagaaagcgtcccttgtaccggagaagcttgtctgcgtccggctgcttctcaatgttattgatgaagaacttgacgaacacgcctctctggctcttgtcgatgatggtgtccgtcagttctgcgaaatacgaggaaagcgagtagccggttatcaggatgttccttttcgatccctcgatcattgaccgcacaacggtcatcgtaggctttgcattgattctgaacgatggcggggctgtcacgaccaacgagactttatcatttcttttcatggtcatggcagaccggattgtcccggctaattccacgtaatccgtcggagacaatcccggatatcgtctgcgcaggatgtctgtggcattatcggtgccattggcagcatctgcccttacagtattcagaagtatttcttgttttaaatctccacctgacacagttcgttcaccagctctctgaaatacgatgtctcttcgcgtcccgaaagaggaaccacgagcccccggtcaagcattcgattcccgttctcgcatgcggtttctgaaatcatgcagcaggaatggcaggcagctccattcgagttcttgccggccgggagcgtgttcatgcattcaggatcgttcgtgcagaccagggcttcctgaaacgcatcccgcatgagattcgtcatctggtctgccgtaccgagttccacaagacctccgagagatccttccttgtcagagcttcccgtgtagagcagaatgccggccatcttgtctccgaagtagattctctccctgattgccgaagaggaatagcccgatgacatggacatctgcttgatgagaagatgggagaaggtatgcatgaggacatagacggcgttgcgatccgcctttatcgtccatccctttgattcacagtactccctgtaggaggcggcatatttctctgaaatttctctggtcttcggctcggtcagccactttgcaagcgtctgcctgttgaattcgatgaagattccttcgccgtttacctccactgcaggaaaccatcgttcatccctgccttttgtaaggtagacgttgttcggctggtcatccgcatcaggatctggcgaatcaactcttgtgaatcccagaagcacgcgcacttcacgcagcctcgttatgcggatgatccgcttgaagtaccggctgaagtatcccggcaacggatcctcttcagccttgaaatgcttcttgttggactgataggtcggatcatcgtgatgcgttatggcttcatactccatccgcttgatttccgtgaattcccggatgttgttcatgcgccgctcgtaggcttcatcgaattcctctcgggtataagtggagaagtattcttcataaatctgttgaagaccatcctcttcggtcttgccgaatcttaccgccatcttttttgcctgttcgatgtcccggaggtgctcatctatcaagttgtacagggggttgatccatggcggaatagaaatggcgcttctcgtcacggcaaaatacacatttgatgcaccgcgctgagacggaatgaccggtttctcgcagtgttcacgtctggtgtgtggtctgaacggatgcatgccgctgcacgacagtccctcgaagttccgggcctgcgtggctccgctcatgcttcttctcgcaccgcaggagcactccacccacatatctgacagcgtggatgtgtttcctgttgagtacatcctcatttcccctttgcagtctgtatctccgcgatgaacccaccatctccaggggaaatcagacatgtgtccgttttcgcaaattgtgatgaaacgggcaggataagcacgccagtggcagtcagggcagttaacgctaaacttcagatacttgtcgagatcatcgttgatgatccctcttgcatcaaaaagcctcccgcactttgagcagacatgccagtaaggaaaagtcacaaccggtatgtcatgagcaaaggatgtcctcggcatatagaaggcatccacattcagataggacgcaagccgtccgtctatgattttctttcccctgtccttccagtacgggatatccagaatggtcacagagtctttcactgcatccacgactgcccccggtccaaaagtcgtgatgatttgattcgggcgcagctcgccaagtttgttaatgtcgtatccggccatatcattcctccgtgtaatagtacatatttgcagcgctttccacgtcacgcattgaccgcagggtaggcttctcattctcgatatgaggctgctcatatccgttcataagcctgttgtacttttccgttcccacaacgtaatagcgaagaggcttgtcctgtgatgccagcaacttccattcgtcgatgaatttgtcaatctcttcgctcgcatcagctattgcggaaggcttaacgatttttacccgttcaagaatcatttccttcactgcatcgatttgattctgtgacagagaatttattgccacagcatccttattatcagccatttccgggtacagaagccttatcgcagaaatgacaagtgcatgcagaacacggtcgcgcgcccttgcagagaacggagtggccgttgttccttccacgaatctgtagagctgtgcgtggtatccggtgaaattctcgtaatgagacaagtcgcgcggccggtatgcgttgtacagcgtcacgacaagacccggatgagcacgcccgatacggcttgtcgcctggatgtattcggagttctgttttggctgacccgacacgaccataagaccaagacgatccacatccatgccgaccgcaatcatattcgttgcaactgccgtgtccatatggtcctttgcggtatagggcagctcaagctggttgagtttttccggtattttccaggacgacatacgcgatgttatctcatcgttcttattcagatatctgagcttttcgagatggtacctcttccgaatgcgctttattctggcgggaatatcatcctgcagaaggcgtaccgcaccaccgagttcacgtatgctgttgaaatatccgatcagggtgtagtacggatcgatgacatccttgtattcatcctgcagggaatatgtatagaccgcttgcagaataatggcataagttctcagcaaggctgttttcacagactgcccgggagcacagattccgacatactttctgaacgggtcttcctcaaccggaatctcgcgtatgaagaagctgtcgccgatctcaaagccgttcggcgggaactgcttcgttgtctttctggcatacaggcacttcgcctggttgtctgcattcttgattgtggccgtggagaccacgtacttcggtttgattccatcatgcgtgcacatgtcctcgatgatggtctcatatgcaccatagacggtcccaagaggccctgtgatcagatgaagctcatcctgaataataagctccggcgggagaaacggcttcacctgcgtaatctctgcagcaggaagaccggatgttctcctgtgtttcggatgttgttctgcaccaatcgcaacatatccgtcacggctgcacttgcgatcaattcttccgaacagagcgttcgtgctcacgtcccacggcagtctcgcgaacttgtcaactgttgacaggatgatggtcgggcatttagcgtagatttcctcgtccaccaagtataccggaatcgggatgcgttccccggtctttgcatatttatagaacatgcagtgttcgtccgagcagtagatttccacggacttcctgtccgagtcaatataaaactcttcctttgtaagcggttttccgcagaacggacaggtaagaagctgcttataaagcaggttcttctgatttcctgcccggtaaggtctttccggattttccttcagatcatcaaatctgttcggagtcacactgcctccgacccagaaaccgatgctgattggctctgttccgtaccgaggataatttctcggatctcgtctgacgttctccgcagcaacaaccatctttgtgatacggtcgcgctgctgcgttgtcagaagacgaagtgtgtaccggaggatgatggtcacgccgccgtcacggttatatttgtcagattcggaggaacgaaggcgtctgttggcgatggtgaatgccatgagtccgaggtaggcctctgtctttccgccaccggtcgggaagtagagcaggtcgacaatatctcgttccgggtcttccggatgcacaatccccttgagattcatcagtatgaatgcaatctggaacggtctccaggcgaattcattctttgggttcctcgggtcgacaaaatccctgaagttgcattcgattccctgaccatgcttctttgcgtagttcttgatgctgttctgcatgtagattacgctgttcatgaagctgaacgcctcgaaggagatgtcatccgtctcgatgatatggatgccttcgcggattctgcgaagagcatccctgcagcgaccgatgacggtgtttccgaccttctctgcgaactccggattgatcattctcgagcttccggcaagagtgtcgttgatccacttctcatatgaatcggcgagcgtgttgagcttctgtatggtttccgctttcttacccttcgctgccatctgccaggttgagaaatacgtgggcgagaagcctttgagagcggcactgacgcctggatactcatattcagggataaatgaggcttccacataatccgtgcgtccgttttcagtcttaccccatacggcggcacaacctctgccacgtcccatgatcggacgctgctcgaagtagaactcgtcggcagcaagaacattcctgcagatatgctccgcgatgaagaccgcagagccatcctcggcatgggccttgattccgacctgaaacatcaggccttcgatgtcacttgagagattgttccgcttgttcacgacataggcggtgacgagggagtatccattcgtcagcggaattctcgacacatgaacgtgtacgttcgaatccttgatgagcgggtagtcctttgtgcgtccgaagtcgctgaacttcacatggacggtttcgctctccgggattctcttgtagaccgcgcggctgcgttccttttcttccttgtcgatgtacttttcagttgatttcgtataatcgccccaggtcacgtcaagacagatgccgtcgagactgctttccacgtagaagctgatgccgatggatgacggcagctggaacttcgtggtggatatcggctcgttgtcgtcgtcctcgctggctgtgaagtcctcgttcttttcgtagtcgacgtcggcttcgatttcctgctcgttctcgtccgacgcattttcgtcacgctgcggttcgagcatgccgactatgtaggcgtagcgcggattctcgttcagcacttcctcagcttcgagaggaccgatcaggtcggttcggattgcgtctatgattttctgccgtacctcggcatacttgaatctgtctgccattagtcctcctcctttatcggatgcgctgttccgagcgtgtatttgcaggtgtttccgggatgaatgttgtcatcagagataagccggtactcccaggtcttgtggtctggatctgcggttgtggcaaagctgcaccagcggatgccctcgcgtgccttggagacgacctcttcattgttcacttcattgagggccttgacttcgaccatgtatttcccggtcgtcgtctccacgaggaagtccgggttgtattgctggccggctttccagaacaggccgagctggttaagtggtggcttgatccagcggataacgtccgggtcctcctcaaggatgatggagaactgccgctcggtgtcgctgtcgaaggcgtttgccggatagtatgatttcttgtatcccgtgaagagatacttcttgatgttgctcttgtccgtgaacggcttgtcgtaacgaacctgaccgtctttcttcacgttcttcacgaacttgcggaagacaatcagatccttctggacgatgtggacatcctgcgtctttctgtccatgtgtgcgtagatctgtttttttatatcattcacgatcagccccgcgtagcggcggacgattttcttctcctcctcgtcgccgggaatctgggcaagatactgttccacgacgtcgatgatgaagtcggcgtcgtcgtaggaaagctcactgatggagtcgagcagtatgcatgccagggtgttccgggcatcctccacctcgagtgcctgcgcatcgacgacagtgagaaggtgctggtttatggcgtcgaagcgctcgatcttcgctgtggcgatttcaaagtcctgtatggtgcgtttcacctcgaaccggttgaacttcacctcggaggtcgtctgtacgaggatcttcggcacggagatggctttcgccgaatactcggttaccgttttcgtgaactcttcctgcgtcatcggacgtttgcctaccgccttgtttcctagtgcgggtggtgttgctgaatccggagtcgttgtggcagccggtgcttctccaatctgcatggcttccggtgctacgtcaaaaagactcagctggttcggatcgtcggacttcctgttcttctgctgcgaagccatgaagttcttcacgtatgcctggtagatttcaagctgtgtctgcggattgcgcacctggtcgaaggacttgattccggctgatgtgatcgcctcgtcgatgaacgagagctgcccgtcctcgaaggtgctggacacgtccacggactccgagtcctcgactcctgtcttgtccaagtcacggtagcggaagacgtcgctgttcctgatctcgtccaccagctcgcggtagtggtcgtgcgccacgatgtcgagcgtatccagatcctcgtttccggtctgctctccgaacggcaaacgcagtccgcgtccgatagtctgcatggcaaggatgtcgcttttcgcggcattcagcgggatgattgtgaacaggttgttcacgtcccatccttctttcagcttgtagacatgaagaacgatttctatcgggttcgccgcactctcgatggagagaagcaggcggacattctcctcggattcctcgccggtctgcttcgaatgaatctcgatgaccttgcccttgtatttcccgtgcatgaaatcgtcgctgtctatcagggcgcgaatcttcttcgcgcgctctgtgtctttgcaggctataagtacgatcggtttcacatagtcgagctcattgttggcacagtattcccgcagaacggtcttccggtgctcgtgcagggtgagtccgtcacggatcttcatctcctcaatatcgtcctggctgtatccggcgatattggaccgtcccatgacgacgggaatcttcagatacccctcagccgctcctcgcgccacgtcatacgaatagatgacgtttgacggagacttcggagtggccgtgaattccagtccgagaatcggccgcagatagttgatggctttcatggacgcgggagcatagtagtggtgcgcctcgtccatgcagatcacaaggtcgtcgaactgcgccagcacgtccgcgaaggaagcaccgagggtttccttgaacttgtgaaaattgaactgtgtgtcggtcttgctgttgaaaatcttaccaatgttgaatatgaaaagctgtatctccgacgtgtggtcgacgaacagggagccctgctcgtacttgaccgggtactggtcgtagttctcgccgtcccagacgtgcggtctgcccatctcggcttcgagtcccttgaaaatgtacttcggatgcgcaggattggattccttgcgcagcttgtcgtagatggtgtttccaggcgcgaggatgaagaaatgcttgtatcccttcgtcttgtacagatagtagatgcaggctcccatcaggcgtgtcttgccgatgccggtggccatggcatagcagaaggacgggaagtcgaacttcgtcctgaccttccgattgttctcgctgtattctgacgcagccgcctcgacggtttccttgtcgtcacgcctgtagtcacagtgcgtgctgatggcatcgaagtaaaagagtgcttcctcctgcggcgttctcagactcatggcgtatttgatctttgatacagttcctgacatttaccgcacctcgctttcaaagtcgcacttgtccaggagatccttcgggatcttcttcacctcgatgttgtccggtagcatcatgtcggactggatcttcgtcgcgtagatcaggagagactgctcctcatccaagtgctgcgacagggaacggatgtactccgcgttgacgaactccgtggtcacatggatgaaccgcttctccgaggaatgtccgtggaagacatcctgcggcttgtacttaaatccctcgatcttgcaaatcgcctcgcacagcatctcgaacgtgtaggtcgggttgatctggtaaactggcagcttgtcgttcttcacgagcaggctcggtgcaagctcatagaagtggtatccgccgccaccccgccagttaaccttctgtgagataccggtcttatctccgtttatgacattatccatacgaaccttgcaaagggtgtatgcatgatcacccatctcaattcctatccatcgacgattcattttatgcgctgttgcagtagtagaaccgctccctaagaatgaatcaagcacccaatcatttctgttagagaagtaacgaatgatcatttcaattagcgcttctggcttttttccgcttctaaattcgacgcctccttcatgtctgcaatttccaaagctccctgccaagtcgtaaaaaccacctattggtttttttcgctcaatcttttcagcctctaatttatctatcggcacaccttgataatattttcccttcgttgccccttgccttttgggccctgtaaaataacgatagtcatatcggtcatcgccaattccatagactttataaagaaccccatagccatcttcttcataacgaccgttgagataatctctgaaaaacctaccagacgaattaccgtctaaaatcgtacctgtagcccatatttcttttaagccatattcatcgccatcgggtttttttattatcttgtactcgtttttctcgaaaaccgtaaccgtcttcccgcctaaggtgatttcttttcctgtaccaagttcttctattgcatagatgaacttgtcgtatccaacctcgtcataatcaaaattaggagttgcctcagaagacttccgatatacgagcacttgctcaatttctttatggaaatccatatcggactttaacgtcttatctggataacgaacacggatataaaggctcgtgagatagttcgaccttccaaaaatctcgtcgagcaccaccttcaaataatgactttcagagtcatcaatatggcagcagagaaatccatcatcttccaacagactatgcagcagcaggagtctttttctcattagtgaaagccatatactgtgctctacatcatcgtcataatattcaaatgcgcttcccgtgttgtacggcggatcgatgtaaatgcacttgatcttcccagcaaagtcctgctgcagtgcctggagcgcaatcaggttgtcgccgtggatcagcatgttctcactgtcagggtcgccgtaggatttctccgtatcctccaggagaatacgcggttcaaccggcttctcctcgtcgtacttgcctacccatgtcaactcgagttttccttttttctgcatatctgtatctcctaaaacttcagtacaacgctgatcagaaggatgggattgtcaatctcgaggcttctgttgaactcagcaatttccctctcgccgtccgctctgaagcgactgcctcgctcatggaaggaagcctggaataactcgagcttcttctgtttctggtccgcctttctcctgatgtctatcttttcatagaaattattcgaggccttctcctctttacggagttcctcgatttccgcgttcatttcctggtactgcacgacgagttgctcgttctggatgcgtatccagttctcaatctttcgcctgttatattccctgacgggttccgtctgtctgtcgagtttgtcaagcatttcgatgacaagattcccgtaggttttcctgaacattgtgttttcattgtcggtcggtttgaagtaccgcactgctgaatcgtcgattttttcgagttccggcacaaggttgtcctcctcgaaatcgacgtattttccttcctgatcgcagagaagcagcacggggaacaggatgtcggcattattgcacattgcgccgaggaacagatatccgtgtgcgccgatggtctgttcaccccagtcgtcgaccttccagtactgaacatcgccgaatacctccggctcggcaaccttgtcccagtagtcggcttcctgaaggtagtggtctatatccttccttgtgccttcgagtgcctgtttcttcgcgccgctgctttccgtaatcaggatggaacggagcttgcgcgcgtttctgtcgcgtttcgcgttcagcttcctgtccagcttgtcgaacgcctttctgaattcagtggacgtgttgcaggactggtagatgtcaagcaccattttctcaaagctcgtaccggattccagtgcgccaagtgcgatgtcggaagcgccgaacacgccctcgaacagttcgaacttcttcgacagtatctcgtagacgcgcttgtcggcctcgttctgcgtattcagcaggttgatggcgaccacgtcgttctgctgcccgtagcggtggcagcgaccgatccgctgctcgatcttcatcgggttccaaggcaggtcgtagttaatgaccgtgttgcagaactggagattcaggccttccgagccggcgtccgtgcagatcaatatcttcgcgtgctccttgaaatagtcgacgatggcgtgcttgtattcgacgctcctgccatagttcgcgttcccgaagttcttcacctgccatgcccggtagatttcccttgtcatcgtgtcatcgaaatctccattgaacagaaggatatcatcctcgctgtatccggattttctgagctccgcggcaatgtatttctgcgtccgctttgactcggtgaacacgacagccttctgagctatgccgttatccctctggtatgagaacccgatctcaagcgcctgtttcagcgcggtcaccttggaattcgtctttatacgctttgcaacatcaatgatggcattgaccttgtccagttccgcctgaatgtatgccttctgcgcggcggtgtcctcgtcctcggtttcctcaaagccggattcatcaatctcgtcctcgacaaagctccagaacaggtcaaatccctcctgcgcatcagccgacctcatgccctcatacagtttctcgagccgcttcttcagcacttcgaaggtctcgaccaaggcgaagctggatgaggccatgagcttgcggatgacgaggataatcagcccacggttggaagccggtatggagtaaagggcatcccccttgaggaacaggttgacccgttcatatagttcgatctcatcaggcgacagcttaaagtcaacagttctgcagatcctcttcacgaaatgcatgtagtccgccacgtcttttcgcagggtcctgtaaagcacaggcgtgagttcgcgcttgaggccgtcgtagtcttcatccttcatatatcgttgccggaacacctgctcagatccgaagatcctcggatcgatgaaggaaatcagcccgtacagatccatgagtgagttctgcagcggcgttgctgtcagaaggatcttcggtatcccacctgaaagagcgtacagccgcttcgcacgctttgtgctgttaaggttgcgcagattgtgggcctcatcgatgatgaggaagtcccatttcacatccgggaaccgcttcatcagtttcgatgagtagtcataggaggtaatcacaatcatgacaccttgtctgtctgcgagcttcctatgccagttcttcgcatcatgctcgaccgtgagcctgtccagaatcgcagaactcaggtcgaatttatcctcaagttccagctcccactgcttgcggagggatacaggaagcgctatcagtacctttttcgctccggattccagcatgtagcgcaggacgaggcccgcctcgattgtctttccaagtcctacttcgtcggcaatcaccatgccgcccgtcttcatcgcgtcgacggcggcgcagaatgcgttgatctggtgagggttcggatcgatgtgggactcggacgcaagaaggaaatgaaacggcgactttttcagttccattcgtttgaatcttccatactgctcgaggagcaggtttccgttttcactgctgtccatcggcatcctccccgtgaagctgtgcaaaaataccctcggcgatgccccttgccatcagaggaggcacagcgttcccgatctgtacgaactgtgacgtgcgtggtccctcgaagtaatagctgtcggggaatgactgtatgcgcgccgcttcccgcacagtgatggaacgatgctggctgatgtccggatggatgaagtagtggccgtccttggaaagatgagccagtatcgtgtggcagcattgttcatcgccctcgacgaccttgaagcggtcggtgaaggaatggcggttcttgtgcgtcttcagctcctcgggcaggtcgttgtagttaagacgcctgtgaccgtcgttccacagttctatggctctctcgtatatccttatgtcacgctcgatgttcggccggcagttctgcagggtcaggacatcgtccttcgtgcgtataccggtttcgatcacgtatctgctcggctttttcttcgagtaggtgttgttgctttcccccggatgaagttcagggagatctgtgaacaggtcgttcaccacggcattcgcttccttttcgatgaaatccggatatgctaggccgctgttcttgagccagccgacgataatcatcctccgtctgttctggagcacaccgaatgtatgcgcgttctgctcccgacactcaatcttgtatccgacccgcttgagatatttctgcaggttcttccagattgcgccgccctgtgcggattcgatgcctgtcacattctcgaacacgaacatacgcggctggtatttcttgaggaatcgcgcgtaaagcttgtacaggtagttgcgcgggtcgtcctccatcggagtctccatgtggctgctctgggctctgccgacgagggagtatgcctggcacggcgggccgccaacaatcacgtctatcttcctgattccgcgtatcttcattatgccgtcgatggtcttgaaaacagcggggagcgtttcgtccgacagcgtctcgttgatgactgtctttgtcacggatgcaggaatcatcttcatgagctcatcacggctgatatctccagagaggtatttcccgtatagtgccaggttgcccgagttcttcaggtagtagtatgcgctgcgggtttcgagcgtcttcgcagcgtactcgttcatctcgacatgcgcaaccggacggaagcccgcctgaatgaacccctcggacaggcctcccgcccctgcaaaaaggtctatgaaattgtagctgctctgcttatccgcctttgccatgcttcttcctcacaatcttcgtttcccgtacccatacggcatgggcaggacggcagtcctgacaggaccgacggtctggcttcactggcgcaaccgtgtcctgctccgtcccgcatcgcttctcacttcggcagaaacctcctcgcacggcacggtttccgctatttcattcagttctacatccagagagtcacatatccggaggagcacgtcggtcgtaacgttctcgtccttgccgagcttggcgagggaagacgagctgatgcctgcgttcttccggagatccgtgcgtttcatatccctgtctatcaacagtttccacagtttcttgtagctcatttttcttttcattcgctttcctctttgttccatgactccccgtacagctcggaattttcatcggagagtttcagcaccgaattgtccgccagtatctttcttgtgctctcacggtaggaatcctgcttgtcgaaggcgatgaacacctgtttttccgtccccgtgtagatcttcatgattccgtcgatggctccgtcgcttatgttcttctgaatcagagaatcgtgcgcgatggccggtagcgccgtcaggtagaggacagccaggtcgtacagcactatgcccttgtagttcgtcccggttcctgtgtcgtccggtgtttcaaacgtgtagctgttgtagttgttgaaatgcagcctcggagccttgcgggcgtccgcgtaaaaagaatcattgaactccttcatcttcgcgttgacgtcatgctctatatccgcaaggatgcttgttatcgccgatttaagcatgttatccgccttcttccttgcgtcctgcagatcaaggagcgtcagataggcctcgttctgcagcttgagtgcgtcgattcttcccttgagttcggaatgacggtcaaggaactccttcgacacgctcccgacaaagccgagttccctgatctggccgcgaaccgcctgcagctgctcctgcagggcggcaatctctccctgcacctgttccttttcaacagaaaactggccgtccagtatcttcgccagcttgcgatggtagcgttccacctcatacagtttcctgacatactaccccatccacacactgtcaaattcctactgaaatagacaagtaacctttacctccgctcccacacaaacaacaggtggggggtgtggtttcctcgttgaagttcaacgaggaaaccacaccccctgctacaagcggccagccacccagccaaccacctcaggccttggcgacttccacggccagctcggagccttcggcgccggcttccacgctcacgctgtcggcggaggtgtcgtttgccaccagatccttgaactgttcgatcttcgccacgtcgccggccggaacggtcagcttcagcgtgatgcggtcggagatctccaggccggcggccttacgggattcctgcacggcgcggatcacgtcgcgggcgtagccttcggccagcaggtcgtcgttcagttcggtgtcgaggatcacgaagccaccggtcggcagtgcggcggatacggagttcgcggcttcctgcgcgtccttctcctctacacggttgatcagttcgtattcgccttcctcaagcgcgatatcgccgttcggggtctcgcacaccggcacgccggcggcgtccacatgccaggcaccgctcttggaggccttgatggcgaactgcacgtccttacgcaggcgcttacccgccacgcgtgcgttcacgcgcagctcgttcacgatcttcagaccctgggagccggcgtcctccagcgtgcagaactcgatgtccttcacgttgagctcgcccttcagcacgtcgctgtatgcagcgaccgcatccgggttctcgaccaccacggtcagcttggcgagcggctggcgcacgcggatctgcttggccttacgcatcgacagcgtgccggacacgacctcgcgcaccttctccatcgcgtccaccagcttggcgtcgtcctgcagcacggcacccagctcagtggtctcgccggtcttctcgtcggcaaggaacggccagtcggccagatgcacggattcaccgccggtcaggccgcgccacacggcttcggcctccatcggagccagcggagccaacacgcgcatgaaggtttccagcacggtgtacagcgtgttgaacgcgttctcatcaccggcaccgaaacgctcacggttgttgcggatgtaccagttggtcagcacgtcgatgaagtcgttcgccgcatcgcacgcgtcggagatgtagaagttgtccagcgcatgctggatcttctccaccaagcggcgcaggcgggccagcagatagcggtccatttccggcagccccgccacttcgtcggcgcgaagcttgcgcgcgtcgtacccggccgcgttcgcgtacagggtgaagaagtagtaggagctccacaccggcagcatcacctggcgcacggtgtcgcggatgccatcggcggtgacgatgaggttgccgccgcgcaggatcggcgagctcatgaggaaccagcgcatggcgtcggagccgaagtcgttgaacacgccgttcacgtccggatagttgcgcagatgcttcgacatcttctgtccgtcggagccgagcacgatgccatggcagatcacgttcttgaacgccggcctgtcgaacagggcggtggccatgacgtgctgcacgtagaaccagccacgggtctggccgatgtattccacgatgtagtcgcacgggaagtgctgttcgaaggtttccttgttctcaaacgggtaatggtactgggcgaagctcatggagccggattcgaaccagcagtccatcacgtcgctgatgcggtgcatgtggctcttgccggtcggatcgtccgggttgacgcgggtcagctcgtcgatgtacgggcggtgcatgttgatgttgccctcatgatcgcgcgggtagtcaccgaagtcggccttcagctcgtcgagcgagccgtacacgtccacgcgcggatacttcggatcgtccgaaacccataccggaatcggagaaccccagaaacggttgcgggagatggaccaatcgcgtgcgttcgccagccacttgccgaactggccgtccttcacgttgtccggaatccagttgatctgctggttgagttcaagcagacgatccttgatcttggtcacggacacgaaccaggagctcaccggcttgtagatcagcggggtggcgcaacgccagcagtgcgggtaggagtgcacgtagctcttctcctggaagaggatggcgcgctgctcctcaggaatgcgggccagcgggccgtcaccggcgcgcaggttgcgcagaatcggcttgttggcgtcgaacacgtacaggccttcgtaatccgggcacagcgacgtgaacttgcagcccgcgtcgagtacgtccacgctcttgatgcccttggcgttgagcgtgttcatatcgtcctcaccgtacggtgcctgatgcaccaagccggtaccctcaacggtgtcgacataatcggcggtgaagatctgataaccttccggccccggcaccttgccttccacggcgttctcatcgcccgcgaagtacgggaacaccgggtagtagcgccagccttccatctcggagcccttgagttcgcgcacgatctcatagttctcgccgagttccttctcgtaggagccgagcagcggcttgccgaggtagaacttcttgccggcgaacttgccttcggtcgggcgcacctcgacatagtcgatgtcggcaccgaccacgatggcgaagttggtcggcacggtccacggagtggtggtccagaagacggcgtaggcatcctcctcgtcgcgcagcttcacggccacggacacagtggtgtcctgacgatcctggtacacgtccgcatccatgcgcagctcgtgcgcgctcagcggagtctggtccttcgggcagtacggcagcacgcggtagccctggtatgccagtcccttgtcgtacagctgcttgaaggcccacatcacggattccatgtaggaaatgttcagggtcttgtagccgtgctcgaaatcgacccaacgggcctgacggtggacgtacgccttccactcgttggtgtacttgagcacggacgcgcggcaggcgtcgttgaacttgtcgatgcccatctccttgacctgatccaccgagtcgatgcccagttccttctgcgcctcgagttcggcaggcagaccgtgggtgtcccagccgaacacgcggttgaccttatggcccttcatggtctggtagcgcgggatgacgtccttggcatagccggtcagcaggtggccatagtgcggcaggccgttcgcaaacggcgggccgtcgaagaacacgaattcgttctggctgtggtcgccggacggacggcggtcgatggacttctggaaagtgtcgtccttatcccagtagtcgagcacggactcctccagcttggggaagctggggttcggcgcgacgttggcgctctgctcgccggcagcagccttcggatacacatgattggtggattcgctcaccgtatgctcctcgtttggcggtttcattacttaccttacgaggacgatggcttccgtgcgatcgcgcacgtccggcaccgcggtaccacctcgcttgccgcacttccctgttgttctcacgcaggttgtccgcctgcgcaggtttcgtacgaccgcttgacattcggctgttcgggccgaccccgccggttctactaagcctcgccagaaagcgtcggccgttcttccggaagctccccgctgatgacggatcatcgcttttcgtttcaaatcgtcagcctagcacgccgtacgaacgtagaaacgcgaaaagccgcacggtgtccaccatgcggctttcgtaatcgcaaaacaatcgaaatacaatcggcaggccgaccacgaatcgaccgaagacgatcgcgctcggcggcgaatcagccttcgttcagctgagcctcgagctgcctgacgatatcgtcgtgcatcttctcggtgatcttcaccttgagcaggaacacgaccgcgctcaggatgatgaccgcgagcggcacatagaaggcgcagatctcgaaggtccggatgttcgcggcggtcatgtcggctgcggtggcgttgccgatcatgccggcggcgatggccacggctccgacgatgccgttcgagcacgcgcccgcgatcttgtcgagcatcggacggacggacagggtgacggcctcgttgcgcttgccgttcttcagctggccgtactcgatggaatcggtcagggaaaggatggccgtcatctggatgaaggtctgcggcagatagaagaagacaagaccgacggtgacgaccggcaggctggtggggttgatgatgaacagcagatagccgatgaccataagcaccatgccgccgaggtacaggtggcggcgcggaatgcgcttgttcagaatcgggtacagcggagccataacgatgcccgcgacgacggagacgacgccgacgatggaataggctgcagagttgttcagaatgaacttgaacagatacatgagcacgccggtggtggccacgttggcgatggcgtacagcaggtaggacagggcgacccacagcagctggtcgttctgggcgagagccttgaacgcggcgagcgggccgccgttgtcctcggccttggtgcgcagggtgctggagctttccttggtgccgaacgcgacggagcacacggtgaggacgccgagaatagccacgatgatggcgaagcaggtccagccgctctggctctcctgatgcttgccggtgaagatgtagctgaagtaagtgacgatcggaatgaccacgatggtcaggccgttgtagccgatggagccgccgaaggaaccgagggcggtgtaggtggagcgctcatgggagtcggaggacagcgccgggatcatgccccagtaggaaatgtcacgcagggaatagaacacgtcaagcacgatgaacgtgatgacgaacaacacgatgaacagtgtggtgttgacgtttaccagaccgaacagaccggtatagacgagcacaagtagaacggcggaaacggtgccgccgatgagctgccatggcttgaaacgaccccacttggtcttggtgttatcgatgatgttgcccagcagcggatcgatgaagatctccgcgatacggatgacaaccacaaggccggtgataacgccgatgagcttggtagcgagcgccttgtcaacgccggagaacagcgagctggtgacgtagacgatgaagtaggtgctcagcgcgttgtagaaggcggattggccgacgttgccgaatgaataggccacgcgggacagcagactgcctttcctggttggcttcgcagactgctgcgtctccttcggtgcggctgcgacattggattctgccatcgtacttctccttagaagttgtgattgaagctgtaatcggaaatcatcatttgatttcgcatgagttaagtatatccctttacccctgtttagtaaaatttaacatctgcgttgtgcactattgggcgtgtcgcattttgtgcgattctgcacatatacatgtcatattgtgtgcgattcgcggtatttcgccgacagtagacaaacaaaaggcgattgatgacgcagcatcatcaatcgcctttcatatttttccgcacatacgtacgctaggcagcccgtttcgaccgggcagatcgcttcgatcgggtctgcaattttggccgcgattcacgtttcggctgcgccggcacgaaactatctcgcacttccagcgtcgtcgacaggtacgcatgctgccgtactgtgcgcttgctggcaatcgcatcggccaaggtgagaatcgcaacgcgcgcaagctcgttctggtcgattgagaacgtgctcaacggtggcgacgtaagctgtgcgatcgcctggttgttgatgctgatgacgctgatgtcgcggggcacgatcacaccaaccgcgttgaacgcctgcagcacgccgaccgcgatgatgtccgccgaaacaataactgcgtcaggcagtgcgccgttgtggtcacggataaactgctcccccagcttgcgaccattctccacggtgaacaagccgtcagaatacaccagtccacgcaggtcgagaccataacggcccatttcacgccgaaaatatgtggcacgcccctcttcgtccacctcataaaaattcgtcagcctccccttgccgccgatgaatccgacacgcttcatgccagccttcgcacatgcttcgaccgcgtcatgcatggtctgctgtaggtcgggctgcacggaatcgaacaggttcggtgcgggattcacatcgatgaacacaccgtatggcatgacctcatgcaacttctcaaggtcgctttcggctatgacattggcgccgatagccatgaaaccatcgaatttccccttctgattcaacatctcgtcaagactgtggaaaacagtgagctccatacgctgctgtttggcgttatgttccagcgccgaacgcaaatcggcaaaatacgaatcacgcagcgtttcgtcggactcctcgttgtccaacaaggctacttcgtgcggaatgacgatacgcttggcttgggcgctgtaccccagatcctcgctggcacggataatcgcacggcgagtctcctcacgcaccgacagcgtcggatcgccattcaacagacgcgacaccgtggcctgcgaatatcccgtgcgtttcgcaatctccttgatggtcgccatcgctccctcgccctcccatggatgcctcatcagattttagtaaaagcattactaaatccatcatattacattaccaaacgtattcttatagccatgacacagccagagcaatcacggaaaccgcgaatcgcgcatcagtccacggaacggatgaacgaactgcgtgcacaacaaaaatcctttgccctgcagaacatgcggagcaaaggactcggcaacgccggtctgcctttcaaagcgaccggtcataaaggtggcatcagtcggcagggttccaaacgcggctgacaccgcggagaaacgcggtcaccgtcagccccacgggcctgcggctggaagcgcccgcccttctgcgtggccgacttgccatgtgagccgcccctcgatgacgccacgctccgcatcggttctaccggacgcgtatacatcaggcctctccccggtgatgctgcggatggaaccatacacatatccacatttttcacggagacggttgcggggctgccggctttccatataccgtcagcgcatggaaagctttggacacaatacatttttcacattggagcaggcacgggaggaggcggcgagacggcatcttgaatgcaggcaggtgttgtcgcggataaggtcacgctcctcgcttccactctatgtaagccacggcacagcgctggagctgcatggcatgattgccaccatgaattatttacccggatatggttcggagctcgttcacgtttcagtgtgccggcaacgtgacctgcggaaaatccaggggatgaaattccattacgcaaggcatggcgtagacgtggtgcacgccgacgaattggtgtcaagcgtctccgcgatgcaggcggtctgccagattgcgccctatgtcgacgaacggagtctggtgatcgccatggattggcttacttgcgccaatcccgatttacgcgtctgcactcacgatgagctctccgactacatccggagtgcgccgcgattcattgggagcgccaaatgcagaaaggccttgcgcctgtccaaaccaggtaccgattccccgcaggaaacggtgcttcgtttggagagcgatgcctacgggctgcctgaggcacatgtcaattatgagatcattgaccacatacgcggctcgggcacgatgaaggtggatatcgcctacccggatgaccgcgtctgcatagaatacgacggaaattaccactacacccacggccgctggatgtatgacctcgataagcgcaaccggctgagggatcttggattcacgccttttgtcgccacccgcgagcatttggcatccaaacagaagctgaacgaactgttcggcatggtcgcccgagcgatagccagtcaccgttacggcttggactagttccgtaggtggtttttcgcttccgtaggtggttgggtctgaatacccagcatgaaaacggccagaataaagcctttctccaaccccgatactctgaccaaccacctacggaacacccaaaccgcctacggaaccgcatgagtagtccccgcaatggatttttcgccattgattcggggaatccatgaaaagccacagcgggcgcaccctgcgtaaaaggtcatgcccgccgattcatgggagccatatgcgcaagggccgtgcggaagccacatatgtggcttccgcacggcccttgcattcgttgaacactaccgttcagcctgtccaattcaccaagaacgggacaggaacgaagcagaaggagccttactccagttccacggcgcccgtgtacagctggtagtactcgcccttctgcgcgatgagctcgtcgtgcgagccgcgctcgatgatgcggccatggtcgagcaccatgatcacgtcggagttgcgcacggtggacaggcggtgcgcgatcacgaacacggtgcgtcccttcatgaggttgtccatgccggcctgcaccacttcctcggtgcgggtgtcgatggatgaggtggcctcatcaaggatcatggccggcgggtctgccactgcggcgcgtgcgatggagatcagctggcgctggccttgggacagaccggagccgtcgccttcgagcacggtctggtagccgttgggcagcatgcggatgaagctgtccgcgttggtgagcttagcggcggcgatgcactcctcgtcggtggcgtcgagcttgccatagcggatgttgtccatcacggtgccggtgaacaggttcacgtcctgcagcacgatgccgagcgacttgcgcaggtcgggcttgcggatgcccttgacggagatgccgtcatacaggatcatgccttcctggatgtcgtagaaacggttgatcaggttggtcaccgtggtcttgccggcaccggtggcgccgacgagcgcgaccttctggccgggcttggcgaaccaggtgatgtcgtgcagcacgggcttgtccgggttgtagccgaaggtcacgtcggtgaagcgcacgtcgccctgcagcagggtcaggcgcccgtccggcgaggtgatcgcgttctcgcgcgccttcctcgccacttccgcggccttcgggctcagcgactgcgcggccttcagggaacgggtgccgtcgtcgccttcctcacgcttccaggcccaatggccggtttcgtggtccacttcggtcatggtgcggccgtcttcgccgagctcgacgttgacgagtgtgacggagccgccgtcgtcctcgggcttctcatccatcagctggaagatgcgggacgcgccggcgagcgccatcatcaccatgttgaactgcatggagacctggccgagcgggttgacgaaggagcgcgacagggtgagcagggagatgagggcgccgagggtaagcttgcctgcgccggcgagaccgaagttgcccatgccggagagcgccatgaatccaccgacgatggcaagcagaatgtagaggatgtagcccatgttgcccacgactggcatggtcacgttgccccaggtgttcgcttcggcggaagcgtggaacagttcctcgttcttctcgtcgaaggtcttctgggtggcgtcctcatggttgaagaccttgatgaccttctgaccgttgacggattcctcgacgaaggcgttcacatcgccgatccacatctgctgcttgacgaagtagcggccggagcgggagacgatggcgcgtacgaccacgaacaggatcgcggcgaacacgagcacgaagatcgtgaccggcaccgacagccacagcatggagaccagtgcggccagtgcggaaatcgcggacgagaacatctgcgggaaggactggctgatggcctggcgcagggtgtcggtgtcgttggtgtagcggctcatgatgtcgccgtgctcgttggtgtcgaagtagcggatcggcagcgtctgctggtgtgcgaacatgtcgtcgcggatcttcttcagggtgccttgctcgacggtgacgatgagccactgccatagccagctgcagaaggtgccggcggcgtagaggcagcccatcagcgtcagcgcacgcagcagcgggctccagtcggggttcttcacgccgaccaacggcagaatgtagctgtcgatcagcgactgtaggaacagcgcggaaccggcttgtgcggccgcaccgatcaggatgcacagtacgattgccacgacatgccatttgtattggaaaatgtagccgaagatgcgcttagtggttcccggcgcggctttctgcggtaccttcggtccaccgtgcggcacggcatcggggcgcttggctttgtttccctcctgcgggtgcatgccctgcgcggttttcttattggttgttgcactcatgtctgttcctcctttcacttcagttcctcaggctgggcctggttcttggtctgcgattcgtagatggaacggtattcgtcgcaggtccgcagcagttcctcatgggtaccggatgcggtgatgcggccttcctccataacgagaatcatgtcggattcctgcacggatgcgatgcgctgggcgatgatgatcttggtggtgtcgggaatctcgttgtggaacgcctcgcggatcagcttgtcggttttggtgtcaacggccgaggtggaatcgtcgagaatcaggatcttcggcttcttcagcagtgcgcgtgcgatgcacaggcgctggcgctggccgccggagacgttggtgccgccctgttcgatgtacgtgtcgtacttgtccgggaactcctggatgaagccgtcggcctgcgcgagctggcaggcgtggcggatctcctcgtcggtggcgttcgggttgccccagcgcaggttctcggcgatggttccggagaacagcacgttcttctgcagcaccatggcgacttggtcgcgcagcacttccatgtcgtagtcgcgcacgtcgacgccgccgaccttgagcgagccggaggtcacgtcgtacaggcgcggcacgagctgcaccagactggacttcgccgaaccggtgccgccgacgatgccgacggtcatgccggaacggatcttcaggttgatattgtcgagcaccggcttttcggagttatcagagtagcggaagtcgacgttgtcgaattcgatggacccgtcggccacttccttgatggggttggccgggttggtcaccgtgctttcctcgttgagcacctggcagatacgttccgcggacgcctgggaaatgatgcacatgacgaagaccatggacagcatcatcatggccatgaggatctgcatggcgtaggtgaccagtgcggtcaggtcgccggtggtgagccccagcgcggcattattgcccgaggccacgatctgcttggagcccatccatgcaatgaggatcatcgagacgtatacgcagaccatcatgagcgggttgttgaagctcatcacacggtcggccttgctgaagtccttgtagatgcgctgggagatgcggccgaatttggcgatttcatgcgattcgcgggtgtaggacttgaccacgcggatgccttgaaggttctcgtcgaccacgttgttgagcttgtcgtaggtgtggaacacgcgctcgaacaccgggtgcacgtacaccgccagaccgcacagaccgaaggcgagaacagggatgcacgccaggaacaccaaggaaatggacgggctgatgcggaacgagaagatccacgccacgatcatcatgatcggggctcgcacacccagacgaatgatcatggaataggcgttctgcaggttggtcacatcggtggtgagcctggtgatgatcgagccggtggagaacttgtcaatattggtgaagctgaagccctgcaccttctcgaattcgtcatgacgcaggttcttggcgaatccagcgccggcgatcgcggcgaacttaccggcaaggaagccagccgcgagcgaacatagcgagcacgccagaagaatcagaccgaatttgacgatggcgggcatgcttttgccggtgatgccttcatcaatcaacgacgccatcaccgtggggatgaggatttccagaacaccttcgaccaccacaaatatcggggtgagaatgctgggcttcctatattcacgcagcgatttgccaagcgtgcgtacgagatgccgcttttgttttggctgcgattgcaccgcagccgttgtcacgtttgttccgctcacttactcttcctttcctgtttcgtcttcctgtgatgttttccgtacagttggttgcgattcgcattcccgcgattgccgttcccgcgattccgcctcgcacaatgccaggctggagtagcgactttcgtcgccgatcagcccggtggagaccagattggtttgcatcacgtcgagcacgtgcatgaattcgcggatctcgtcgtcgctcaggccctgcagcagaatgccttccatggcgattgcgctggtgcgcagcgcttcggcgatgtcgcgcgatttgtcggtaagcacgattttcttcaaccgcgcgtccctcggcacggattcgcgcacgataagccctttgcgttccatcaatgcgagcactctgctcgacgtcgaccgggtgatgccgaagcggcgttccacatcctgcgggaagatctctcgttccgaatggcgtgcgaggaaggtgatgatgtcgatgttgccaccgctcagactctccacttccatggggcgcgtcaccgcaagataccggttgatgacgttgtgcagcgatcggatggcgacgctcggcggcttgcatgcgcctcggtcccacgcttcggtgaacgcggggttcaccgaagccgttccatcgttctgtatatcgttcacggaacatacgataacacgttgtacatacaacagttgcatatgcaacattcagcgtgtcgtgtgtgacggaaccggatcgcagcacaccgagcgcaatattgtaatcgcaaaatcgcttaaaaatagccaaaaataagctcggaacaagccgaaaccaagtatgaaaaagccgaggatgtggtccgtaccggttcattcgcgggccacatcctcggcctaaatccttgaaactccttttgcttacgtcttgtttacgtcaatccgtcttattcggcggtttcggcgattttggcgtattcgtcgagcatgaaggcggtgatggccttgccgccgtcgctcatcagcatcggcatggagttgatcggcatggacttgaggaacatgcgcatcatgtcgttgtcgggcagctgcggcagattgccggcctcgccttccgcatacacggatgcgacgattttggagccgaccggatcgtcggcccattcgccgaacgtggaccattcgtcgagcggcagggccttgccgtcgccgtcgagcgtgacgacggccacggcggcgatgtcgcggctggacgtgccgacttcgacggtgtattcgccggcttcgacatgccagtcgttgaacttctcggaccagtaggcgaaggcgcgctcgtccagatcgaaggagatctcagccgattcgccggccttgaggaacacctttcggaagcccttgagctcatgcttcgggcgggccacggaggccttgcctggagccacgtagacctgcacggtttcggcggcgtccacgtcggacgtgttggtgacggtcgcggtgacgtgtgcggtgttggcgccggtcttggcgacgttcacgccgtcgatcgcaaaggtcgcgtagctcaggccgaagccgaacgggtagtcgacggccttgtcgtacgtgtcgtagtagcggtagccgacgaacacgccctcaccatagtcgacgtgcccctcctcacccggccagttgatcatgctcggatcgtcgttgatatccatcggaatggtctgtgccagcttgccggatgggctgaccttgccgaagatcacgtcggcaagcgccggaccgccggactggccgagcagccaggattcgaggatgcccttggcgttgcccgcccatggtgccacggagacgacggagccgttggacagcaccacgacgatgttcttgttttcggcggcgacggcgttgagcagttcgacctgcttggctggaatgtcgagggtttcacggtcgaagccttcggattcggcggcttccggaaggccgaggaacatgaggacgacgtcggcgtttttggcggtttcgacggcttcggcttcgagcttggcgtcggccggttcgaggtcgagggtgaagccgggggcgaatgcggcgtcgacgccccgcgcggctagggtgtcgaggaagctggtcatcttggtcggggtgatgtgggacgatccgccgccctggtagcgcggggtgcgcgcgaattcgccgatgacggcgattttcgcgtttgcagcgaccggcaggatgttgccgtcgtttttgagcagcaccatggattcgatggcggcctgatgggccacctcgtcgtgggcgtccacgtcgaaatggtaatcgtcgatgctcatggcggcgcgcgtcttgttgacgaggtcgatcatgccttgggccatgcggtcgagctgttcgggctggatgcggccgtcacgtgcggcgtagacgatctggtcgtccgtgtagctcggcggcatttcaaggttgaggccggcgttgagggaggcgacgcggtcgtggtcggcgccccaatcgctcatgacgatgccttcatacccccattcgtcgcgcagcacgtcggtgagcagccagcggttttgtgcggaatgcacgccgttgatgcggttgtaggagcacatgatggtccatggctgggcggttttgacgatgtgttcgaaggccgggaagtagatttcacgcagcgcgcgctgggagatgttggcggatacgcgcagacggtcggtctcctggttgttggccgcgaagtgcttgagcgaggtgcccacgcccttggactgcacgccggcgacgatgccgactgcctcatggccggccagatacgggtcttcggaccaatattcgaagcagcggccgccgagcggattgcgcttgatgttgactccggggccgaggatgacggccaccttctcctggatgcattcctccgccatggcctcgccgaccttgtggatgagttccgggttccaggagctggacaggccggctgccggcgggaagcaggtggcgggcacggagtcgttcaggtcggtttcgccggtgctggatgccagggatttgcgcagtccgtgggggccgtcggtgatcatgtagccgggaatgcctttggtttccacaccctgcaggtgccaggcgtcgccgccggaggtgagggacgccttctcttcgagggtcaggtcgttgacggaaggataagcggtgtcgctcatgagctgcctctttcgtatgtcttctgtgtttctggtgcctttcggctattttctcggccgtctcgcgattgtttcgcggtgggacttcaaccccgaattccctacctaccgattggtaggtactttatcaaaaaacaatacgcaacacgccaatcatctttgaaaaagaaaccgaccgaccgtaatgtgaattacatattccaataacctccagcaacgacgggagcacattatggccaacgacgaagtcgaccgcagaagcgcgattctcaacgcagcggtcgaatgtttcggcacgctcggctactacggcacgtcgctgcagcgcatcgccactatggtgaacctcaccaaaccgggcgtgctgcattacgtcggcagcaaggaagggctgctgcatgcggtgctcgacgaaatgtacgaccgtgagaccgaggacgtcaccgccggcatggtgcgagacgaacgtccgcttatcgccgaaatgtggcgcaggacggtggcggtcaacgccaaacgacccgaattggtgcacatgttctccacgttgagcgccgaggcacttaatcccgaccatccggcgcatgattatttcgccgaacgcgaggaacgtatcgtggaagtggccgcgaacatccgctggcatgtgccggaaggcgttgacgccgagcaggtgctgcgttccggattcgcgatgatggatggcgtgcagctgcgctggctgcgggttccggggcgcgacctgaacgaaatgtgggcgcgctgcgaggacgtcctcttccccctgccacagtgggagggctatcgctgaccatgaggtatctgctggcaccggattcgttcaaggaagccgcttccgcgcaggccgtggctgagtcgatacgccggggcgtggcggccggcgatcccggcgccgaatgccgcatgatgccgttgtccgatggcggcgagggattgaccgacgcgctggtccaggcaaccggcggcgaattgcgatcggagcacgcgcatgacgcgctgggccggccgatcatcacacgatatggattccttggcgagggcggtttcggaacatctcacgatggagagaatcctcgcaccgcggtggtcgagttggctgcggcgagcggcatcgagcgcatctcccccgccgaccgcgatccgttggcggcgtccactttcggcaccggcgagctgattcgcgccgcgatcgacgccggagcggaacgcatcgtacttggattgggcggcagcgccaccaccgacggcggtattggcctggcccgagcgctcggccatcgtttcctcgatgcggacgattgcgagctgccgctcggcggcggcgcactcccccggctcgcccgcatcgacgacaccgaggttcccgacgacgtgcgaaacatcccgatcgtattggcatgcgacgtcaccaatcctctgaccgggacggacggcgccgccgccgtgttcgcgccgcagaaaggcgcggatgcgcagcaagtggcgacgcttgacgccggtctcgcccggctcgccgacgccatcgaggcgctgaacggccgcatgatcgagaatcggcctggggcgggcgcggcaggtggtaccggcggtggcatgctcggcctgttcaacgcgtccatgcgtcccggcatcgagctggcactcgatgtgctgcatgcgcgcgaagcctgtgcatgggccgatgtcgtgatcaccggcgaaggatcgatcgacgaacagacgccctacggcaaagtgccgagcggcatcgcacggctggcgaaatcgcaaggaaaaccggttatcgccatcggaggcaaggtgacgcgggatccgcagaccatggccgcattgcgtgaagccggcatcgtcgcgacgttcggcatcgcgccgggcccggccgccctgccgcaactgctcgccgacacggaacgcaacgtggaagccacctgcgccgcgatcgccgggctgctgagcgtagcgcgcgaatgctcatcgagacctcatcaatgaggaacaggaaccccgcctgttgcaccggtattgaggactactttggggtcatcatcaacaggccactcgcctgaactagattttcacatctgcttacggtaagtattcacgcaagagcggaaccgcgaaatcaacttcgccgcaaccagtctgacgaatgacatatgcatccagcaaccgcttgcgaatatgtttggcattgtcgatatcaaaattatcaaagctatcgaaaaacgacagaagtgaagccttccaccgcgcatgaccagctatgcggcgcgcttcgagaagcggaacatgagcagggccaggatctcacccgtcacggccatgccgaagaacacccacatgctggtggaaaacccggcgacgtaggcggccgcggacttcatgcccgcgacacggttcgctgcggagaattcagcgatcagcgtggacgcaaccgcggtgccgatagcgccggcgagctgctgcacggtgttcatcaccgcggagccgtcggcgttcatcacagccgacaactggttcagcgcatgcgtctggtcaggcacgagcacgaatccggatgcggccatgaacagcgcgtaggcgatcgcgacggcccattcatgcgcgccgccgagcagcatcgagacatccatgattgccacgccgacgaaaccgcaggcgatgaatttcggcgggaaatgcgctttcagcgcgccaccgatcagcggtgcggaaatcgcgccgattaccgcacccggcaacagaatcagcgccgcaatcatactggtatgacccatgccgcgctgcaacagaatcggcagcaggaaattgacacccagcacaccgccggatgacatgagcagaatcagcatgcccagcgtgaaaccggggaatgcgaacgtgcgcacctcgatcagcggatgctccatcctcagctgcacggcggcgaacacacccagcaccacgatcgcgccgacaagcaccgtccagaagcgccagtcgccgttccactgcgcgaagaagctcgccgccacgatgatgccggccagaccggccgccaccaataccagcgacggcaccgacagatgccccttcccgccgtggcggatgtcggggacggtagcgcatcccagcacgagcgagatgagcaggaacgggatcatcgtgtagaagatccaatgccagttgaggaattccatgacgagcccgccgaacaccgggccgatggccggggccgcgcaggtcaccagactgaccaggccaagcatcatgccgcgtcggttgaacggcgctttctcgaggatgatgttggtcagcaatggcagcgagacgccggtgcccaacgccatgatgagccgcgccgcgagcaacatcggaaagttcacggcgagcgcgccgaccaccgtgccggctgagaacaacgccaccgcggtgacgaacagacctttggtggggaatgtgcgcaccatgaacggcgaggtcggaatggcgatggacagcagtagcagatagccggtggtgagccattgcaccacgtcggcggagatggcgaactcccccatcagcgtggagtacgcgatgttgagcgacgtttcggacaggatgccgaggaaggtgaggatggagagcgccaccaccacgatggtgagtctgccttcgctcatggtgccggcggagctggctgccggtgttgtccgatggttgtgtcgttcgtcgtggatgctcacggttctccttgtcgtgttggcgtcgtcggcgttgacggccgccggcgatatccgcatatcgtattgcctcgcctatatctagggaggaaaagttacgcgaaattgcatgcgcgtattcggacacgcccccgattgcgccaatgctgcctatgatgagatgaaagcgtgccgattacgaagggggcgcatcagtataaggagagactgatgagaaggacaccgttgcttgtgttgcgcggcggcggccacggccgtcatggcgctgggcgtcaccgtgcaggcgcaatgcgccgaaccgtatccgtccaatacgcagcagccggattacacggcattgctcaccgatttcaccaattattaccagccggatctcaccgcgccttccacggagctgcgtggacgcgtggtcaatgcagaggtgctcaaggaaaacagcgacgccacggtgtcggtgaatcataaggccaatgaggggcggaccagtgatgacgatccgctcaatcctcagcagcagcgcgcattgaaggacagtgattcgctgatcgaaaacacgtactccgatgcgcttggcccggttttggggaggtttctgagcgagggcatcaagcagggtgatctgccactttccacaacgttgttggtcaaacggcccggagaaagcgacatcggcacggaacggcacgcgttgctgtcacggtatgtgaacgattccgccgtgaagaagcagtatgtccatccgcgtccgttcacggatcgcacgaatggcggctatgtggctgccggtctgccgaagaccgagaatatcatccatctgccggtgtggacggacgattccggcacgcagcacaaccccggctatgacacgctcgcccccactggttcgttcccttccggtcacaccaccgtcgcctattccggcggtatcggcctggccacgctgctgccccagctcgcgccggagatcatgacgcgcgcatcggaggcggccaacaatcgtctgatcgtgggcgtgcactatccgctcgatctgatgggcgggcgcatcatcggagaggccgggcttgcgacgcggtggtccgatgaacagttccgcaacgacaagttgatgccggcatatcaggaaatgcaggcgtatatggcgaagcgttgcgtgggcgccaatatcgttgcccgcgcggcggatgatccgacgaccgtgcagaattgcgtgaccgcgttgaacgcgaattccgccgattcctccaagccgagcggcggatacaccaacgatttcaccgacgatttcagtacacagccggtgaccaaccgcacgtcggcattggccgcctatcaggcacgcatgagctatggattcaagccgacctccgccaccggcaaggccgccgtcgtaccggaaggcgcggagaatctgttgaccaccgcgttcccgacgttgaacgccgaacaacggagggccgtgctggccgccacggagattgattccggcgaaccgttggacgcaagctcgaacggctatcagcggctgaatctcgccgccgcctacagcgccaaagtgacgctgtccgcagacggttccgtggtcaaggtggagccggggcaggccgtcgcctccgtggtgcgcgagggcgccccagctaagcccggctcatccagcggaaggagcgatgccactgccagcaccaccaaaaccattgcgaacaccggctcggacatgctggctccggcaggcatgatggtcgcctgcttcatgcttggcatcggattgatgctgacccgccgacgcgcgtaaggcaataggtcgggtcaccctatgggaggcccgaccttcactcacctattgaaacggcaacgacgccgatgctcattgcaacctgtactccagatacacctgctcctcttccatgagcccttggagcaatgcggcccccaccctgcgatgcggaatccgcaccgttggcacaggcgtttcgccggctcgttatgcgcataggtgtcgaggcggacgaccgcgcagccgtgcccggccgcatattccttcgcgtattgcaccatccggcttccatacctgtggcccgcgaaccgcggcggcacgcacagcgtatgcacgacaagcacatcctcgccttcgccgggatactgccatgccacgtcgtcgtattccgcgggctgggcatttcaatatcatgctggcacggatctcaccatcctcttccagcacgatcatctccccctgcgggcacggcgcgcttcggtacagcgatcgtcgggtatacgcccaattcccaatgggaatcgcctccatgctcctgctcgtaagtcagcaggtcctcgtaggtcgcggcgatcgccgcgatatccgcagatgttgcctgtcgtatcatgctatttcttccttttcgaaccccggtgaaccgtaaccgatgtgtcatggcgagattccgtagagggtttcactgttccgtaggtggtcgccggtggtatcggggatgaggaacggctttattcaggccattccttcggcaggcattcagccccaaccacctacggaacccgaaaaccgcctacggaaagaccggaccttgccgtgactcccggcccgtatgcatgcatggagccgataccgcaaccaagaagtcattgtagaaccgcccacacgagcaatgtccgccaaatacgacatgcgctgcggcgacttgtgaaattacctgaatcatcgtaaaataccaagtggtaattaaaggacaccgcttcaacgaggaaagtgagcaatccatgaccaacaccaccgacctgccatacaagaatcccaacctgcctgccgaagagcgcatcgccgatttgctcggacgcatgaccctcgaagagaaggtcggccagatgatgcagcttgatgctcgcagcggcgatctggatgacctgatcgtcaacaagcacgtcggctcgattctgcacacctcccccgcggacctgccccgcgcggtcgagaccgtgaacacgaagacccgcctcggcattccgctgatcatcggcgacgactgcatccacggctattccttctggccaggctccaccatcttcccatcccagctcggcatggcaacaagcttcgacacggccaaggttcaggccgcgggccgtgccaccgccgaagaggtctccaccaccggcgtgcattggacgttctcccccgtgctgtgcatcgcccgcgacacccgttggggccgtgtggacgagacgttcggcgaggatccgtatcttatcggcgagatggcctccgccatcgtcaagggctatcagggcggcgccaaagctggcgagccgctcgccaaggatgcgattctggcctgcgccaagcatttcgccggctattccgaaacgcagggcggccgcgacgcttccgaagcggacctgtcccaccgcaagctggaatcgtggttcctgccgccgttcgaacgcgtggcgaaggagggttgcggcacgttcatgctcggatacgaatccatcgacggcgtgccggtcaccttcaacaagtggctgctgtccgacaagctgcgcggcgactggcactaccagggcacgctgatcaccgactgggacaacgtcggccgttccgtgtgggagcagaaggtcaaggccgattacgtgcacgccgccgcggacgcggtcaaggccggcaacgacctgatcatgaccacgccgaagttctacgaaggtgccatcgaggccgtgaagaccggcctgctggatgagtcgctgatcgacgaagccgtgtcccgcatcctcgcactcaagttccgcctgggcctgttcgaagatccgcgtctgccggaccaagagcgcatcaagacggttatcggctccaaagcccatcaagagctcaacctgcaaatcgcacgcgaatccgtggcgttgctgaagaatgacggcgcattgccgttctcggctgcggcgggcaaacgcatcgccgtggtgggcccgcttgccgatgacgcgcaggagcagttgggcgattgggccggcaattccggtcaggtcaattggatgccggatggccagccgcgtgagatgatcaccaccgtgcttgacgggttcaagcagcttgcgcccgaaggatgcgaggttgcgtattcgcgtggcgcgaacatcatcgatttggtggacgatccggaaggcgagttctatccggatggccagcctcgtccgaagctcgccgtctccgccaagttcgaccagcaactgctggatgaggcggtggacaacgctcgccgttccgaccttgttgtcgccgtcgtgggcgatgtggtgcagttggtcggcgagacctgctccaccgccacactggaactgctcggcgggcagaacgccatgctcaaagcgcttgccgacgtggcccgcgagaccggcaagccgctggtcgtggtgctgatgagctccaagccgcaggtgatgccggcatgcgtgatcggcacgaatggcgtgatcgtggacgaatccacggccgacggtgtcagcgcgttcatgtgggcgccgaatccgggtatgaagggtggccaggccatcgccgaaatcattcttggcgaaaccgagccgagcggacgtctgccgatcaccttcccgcgtcatgcgggccagctgccggtctattacaaccagatccgtggccagcacggcaatcgttatgccgatctcacgcaggatccggcgttcgcgttcggcgagggcctcggctacacgaccttcgcatatggcgaaccgacaatcacgaacgttccggcttccggcacgttcgccaccaccgataccatgcatgtcgaggttgcgctcaccaacaccggcgagcgcaaaggcaccgaagtagcgcagttgtatatcggcgatatcgtgacgtcctacagttggacggaccgcgagctcaaagcgttccagcgcgtggagcttgagccgggtgagaccaagaccgttgcgttcgatattccggtttcggagtgcactatcgtcgattcggatgccaaccgtatcgtcgagccgggcgagttcgaagtgttgattggccattcgagccgtcgtcgcgatttgaagcgcaccacgttcactgtggcgtagttgtatgcgatagtgcgattgcgttgcgtaaccacattgcgtaatcgcactattcaataccccctttcgctcacgcaaagtaaatcaagccgtcaatatacgtatgtgagcgaaaaggggtaatcgtatgccattatgcaaaatcacaaatggcggaattccaacgtttcctatttctaaaatcagataattcagcgcacgtatgcgcaaaaacgcacttttccgcaatccgtgagcaaaagggtggcttgcgattggactcgtgcaagccacaaaccaccaatcaaatcgcaaatcgcaatccgtgagcaaaagggtgcctcacgcaaaccaaaccgcaaaccgcaagtccaaaaaccgcaggtcgaaaaacgaaagcagatagacaatcatcagaatcacgcaatcgcaaccaaccggcggaacggacacgaccaaatcaataaatccgaatcagcggtaggcgtcccacaggggctcggggaacagcaggttttccatttcagcccattctgcgcataggtcgacttccggttcgcgcagccaccacagctggatgccatccatgatttccatggccttgcgcaccaccggccgcatgctttcctcccatgagccgagttgcggcggaaccaaccatggataacgggaataatgtgcccagatgttgtccattcgttccatgaattcatcatgcagcggatggtccgggttcagggattcggccgacagcacggtgaacagctgcaccatcatgcgccggcgcgagttgtgtttcaccaggtagcgcaggtatgcggggaaatgcggcgcggatgggtcgctgcccggcatgcccgatgagaagaagtcctccggagtgccggtttgcccgtagtattcgtcatataccagcgccagcatcttgtctttgttttcgacgtatcgcagcacgccttgtttggagatgccgacccgatcggccacgtcctggatcgaaatgccgttgaatccgcgttcgctgatgagctgcaccgccgcatccagcacttccgcacgacgctcctgcggcgatttgcgggtacgtttcgaagtctcttcctctgccatgactccgagtctaatgccctttgcgtcgattgccgttgattgacggcgccgatgccacgtcatcgtggggcgtatccgcttgaatccatccatgacgccatacgcgggttagatcccatgcttcgagattgccgccgttgcgcgggtcgcgtggcggttttccttcgccgctgcctggtttcgcggaacgcgcaagctggtagctccaatagacctgccccgccgacgcatcccatgccgcgcgttgcaatcgcgatacttgacggtatgcgtccgctcggtttcggccgtgcagggcccaccggttctccacgcaccactcgcccacaagtacagggatatggcgggccgccgaacggatggcgatttcgcgcgcacccaccagcattcggtacagccatggcaggtgccgcgattgcaggtacagtcggcgtgccggtcccgcgaacaacggttcctccatggcgatgagatattggtgggtgtcgagcatgacgttgcgcatgccggaacgacggaaccaatcactccagcggagcagtcgaaagccgtcgtggaatacgatcagggtttccggacgtagtatggcgcgcagccgggtgtaggcgtcacggtagaagcgcttcagaaaccgtagtgggacatgcgtgctgccggaggcctcgcggacgtccttcgccgtattcgacgtgccatggaacaccgaccagctcaccggttcgttgagcacttcgatgctgtgtagggtcggctcgtcacgatatcggcgggccaatcgttccagcacattcagcgcgtattccaccaagtccggattctgcgcccatttgcacacgcccgtcagaccgccgttgtcgaaaccattctgtgagccgggcacggtatgcaagtcgatcatgatcttcagtcccgtctcccgcgcccaacggaacgcgcggtcgaggtatgcgatgcagcccggatgtccgggccaatcgccgaagatgaaatatggtatgggaatgcgcacgagattgagcccatggtcggcgatgatgcggaaatcctccagggtgatgtaggcgtcgcggtgccggcgcagttcctcggcgagattccgttcggaccagagggcgccgtgcgtgcggtgcatccagatttcgtcatcttcggcagtgcgaacgaatggttccggatccatccatttctccagcaccagccagttgccgaggttcacgccgttgattcgctcgtcgatgcccagcaccatgcatcccaccgcctttctgtgcggggtttcgcccggcttgccgtttccgcctattcaaaaaccaaacagctcaaaccaaacccctatttcagcccaatgggccaaggaacgcaccgttcgcaacgctccttggcccattgtatgcgtcccgcaatcagccacgcggccggttggaatcggaccacggccggattggggtttcggaatgatcgtggccggatgggcgggatcagtcgaccggcttcgtctcgtccgcctcgtagtcgaagaagtcgaagtcggcagtcttctcgtgcagagcggcgtcggtaacggcgatgccgaccatggtgccagtgaattcgccgtacttgcagtattcgtcagagaaggtggtagtgtcgaaatccgggccaatcttggtccagttctcgccatcataaccccactcgaaccaagtacgacgaccttcgatattcaaacggaaatagatcggcttgtcttccacagcaacgcgagtgtcaagcatttccatcttttcaccgttttcgagacgcacaatcgaaatcgcgctgccgccaagcgtctgtgaataatacttgcgcaggaaaatattattcatgttgtcgtagtagatggtcaagccagcgctgtgctggtagacttccggctcgaactccatcttggtggttaccgtggcatacacgctcgtcagcttgcgagcaagcaggctcgtacgattcagcgaggcaagcgattcctcaccacgaacacgcaaccagcccgggcgttccgtagcatttgcaaacgtgctcggcatctgacgcggcgagtaataccagttacccagttcctcaccatcgaaatcgtcaaggcttggaatttccggcatcggcacatctggcagattcggctcctcgacttcgatctttgccagattagaaccatcagccatacgcaaccaaccatcaggcgtccactgcatcttctgaatggcggtctcacggccaagcgtacaacgcaattccggcacaaacggacggctggtcaggtgcacaagatatgtctcgccgttcggcagatccacgtaggagccgtggccggacttctgcaatacggaatccgggttgaaatagcgcggcttcaaatgatcgtcatcagcacgctcgtttgactccttcggctgcgaagtgacgagcggaccattcggatccggctcatacgggccccacacattgcgggaacggcccatggtcacagaatggttgtagccggtgccgccctcggcgcacataatgtaataccagccgtcacgcttggtcagatgcggagcctcaatgcagccacgatcagtagcgccacgccatatacgcttcggatagccaaccacatgcttggtttccggatcatattccacacagcagatcacacccggcttctcatagccttcacgggtctcccattccaagctgacgatgtacttcttgccattgtcatcatgcaaaatggacgcgtcgaaaccggaagatgtcagatataccggctcactccacggaccttcaatgctcttcgacttaatcagataattattcacgtcgaaatagcgtgcattcatggaattcataacgccgtaaatcacgtagaacatgtcctcttcctcacaatacgtgaggcatggagcccaaatgcccttagcgcttggcagcttggtgaggttcggattcgtatcatcagtaagcacgtgggtgagcagctcccaatgcttcatatccttcgaatggtaaatcggaatgcccggaaaccattcgaaggtggagacggccacgtagtagtcgtcgcctttgcggcagatggccggatcgggattgaagcctttgaagatcggattatgcagcattgtcgttccttaatgttcttgatatcacgcgttgctttgtacgattcttgcgtccgacggaatcacttttggacggggaaccaatcttgggcgatgcagcgtccaaggtcccatgcgtcccagccgatccagccgggagtgttgacagtgtcagtgagcagcttgtagttccagtagtagaagccgctgcccttgctccatgcggcgagctgggattcggctacgccctggtacagcgagcgcttctgttcggcggtcagggtttcgacctgagccccttcctcgccgttgagcacgctttgtccgccgtgggtgtccacaccgcagccgacggagttgaacaggcaccactcccccacaatcaccgggaagtattcgctcatctcggcgatcatcggcgcataggtattcctcacgaagtcgtcgtagccctccgctgtctgcgggcaacccatcgtttcggcggtcatgaggtattggtgggtatcaaggaccacgttcttaaactcgggcgcgagcttgccgtcggggccgcgcatgaagtccttccactgttcgatgtcgaaaccgtcgtggaacaccaccgccttgtctgccggcaatgcgcccttgtcggcatcgcgcagacggtggtaggcggtgatgtagaagttcttgagccagtcgaatgcgatcgggccggtgccttcggcgagttccggatcgaccgccttgtagcgttcggtcacgttcgccatcggccagcaggtggtggtgttcggctcgttgatgatttcgatgcccatcagcgcccgacgatggccgtaccgcctggcgaggcgttcgagcacggacagcacgaattcgacctcgtcgggcagctgcgcccacttgcacacgccggagatgccgccgttgtcgaagccgttctggctcatcggcgcggtgtgcaggtcgatgaggatggtcagaccgtatttctcggcccagttgaaggccttgtcgagttcgtcgatgcagccgatgaacggcgcgcggtcgccgaagatgaagtacggcacggggatgcgcacggagttcagtccccacgatttgatggtggcaaagtcgcgctcgttgatgtattcggcgcggtgggtcctgatgcgggcctcgtagacggccggatcgagttgcgtcggcagatagtattcgtcatcggcagtggttccatcgaataatgccgggttcatccacttttccagaaccagccagttacccaggttcacgcccttgatgtaatcaagatccatatgcactccttcgtacgtcatgcagtttctattacttagtaactacttagttatatcgtaatacatttccgttccacacgcaacccaatctcgtcggcatcccacggcgaaggactgctcggatgagaaaaaccaccaatacaaacaaaggtgcccgccgcgcatggaggggatccatcgcggcgggcacctcatgggcagggcgccggcgatcggcatatcgccgggaaaaagggaaaaaccggcattacgcgcgagtcgacgccgtatcactccggctcagtccagcacgaaagtgttgaacgatcgcggagcaagcgttaccttgaaaccacgttcggtggcatcgggatcggcgaattcgaacgggcgctcctcgtcgagggcgttctgcgccacgaccaccaccgtgccgtccggattgcggaaggcgatggccatcgagttgaaatggccagtggtgccgagcaccttcgcgccgggcctgacgaaatgcgagaagtgacgcatcacgtagtattccggattgcggcgcacctcatgcgtgtcggcggtgatggtgaacagggagttctgccaccagccccatgtggaatcctggtcgtcaagaatcatgttccagtaggtgtatgcggtggcgccgttgcggaagtagtggttgatcagatggaagatgtactccgcgtactcccagctgttgtcgccggtgccgcattcggactccgactggatcagctcgatctccggccatgattcgtgcgtgcgggcgatgcagttctggccggcccactgataggcgatgcccttgatgtacttgcgcgcgccgtcgtcgaagaggatgttgtcgacgaagcggttgtagttgttgagcgtcatgccatagccgccgccggtccaagccatgtcctccgggccgttgagggtgcccagccagatgtcggtgtcgagtccggcctcgtcgaacgccggtccgaggtagtcgcggatgaacaccttgagcgcttcggaatcccacagggcgctcgggaacttctggtcggcgaacacctcgttctgcacgtgcagctggttcacagtgatgccgtgctcggcgtaggcctggatgtacttgacgaagtacttggcgtaggccttgaggttctccggggtctgcacgagacggccgtagttgtaggccttcgggcgcttcatccacgtcggcgggctccacgggctggagaacagctgcatgttcggctgccattcctgcgcgcggtggatgtacgggatcagggtctgctcgtcgtgttcgacggagaaatgctccatcccgtagtcgccgtcgacctcgtcgtagctgtaccagtggtcggcgaaatcattggcgccgacgggggcgcggttgaaggtgaagttcatttcgtcggggctgaacagctccttgatgatctggtcgcgttcggcttcgctgacgttctgcagcggcagccagccgagttcgttgaagcagccgccgaagccgcgcagggcctggtattcgttgccgtcgagctgcaggtcggccgcggtggtggcgttggtggattcgatgtcggaggttcggtcggcaagcttgtcgtcttgcgtcgttgcaatccaggtggtcatgatgttccttggtatcgtcgttgataattcggatattcgttgatggttggcatggatgggaggcggggcgattcggtcccgcggaggggagacggcctatggcacgaccgtctcccccggtttacagcagctgccttacttgaccttcttgatggccatgatgaagaagcagccgatgatggccaatgcgatggacgtcgggaacgcgaagttgtagccgaggttgaccacgatggcggacatgacgaccgggccgcacatctggccgagggtggtggccatgttcaggatgcccagatccttgccggcctcttccttgttcggcagcacgtccaccagcagcgcctggtcgacggcggagtagacggcgtagccgaggcctgcgatgccggcgaacaggtacatgcccatggtggacttgaagatccacggcatggcgatgccaacggcgaacagcacggaggcgacgacgaccgggaccttgcggcggccgatgagatcggagaccgggccggagatgaaggagccgaccagggacatgaccatcatgatcatggacacgacggacacggtgacggcggattccttgacggactgaccgatgtagttctggatgatgtacagctggtagacgttgatcatctggtaggccatgagcatgcagaagcggccggcgaacgccttgtagaagtcatgcgcggtggagaacttcggcgggcggaaggaggagaggatgtccttggcggagccttcgtccttcggcaggaagtctgcggactgctccttcgggatgatgatcacggcgaccacgccaccgaggaacatgagcacgccggcgacggcgaagcccggaatcaggttttcgatgaacagtgcgccgagcatggtgccaatcggagcgccgatggtggagccggcgccgtagaaggcggacatggtgccacggatcttggaaggcacacggtcggacaggatggcgaccatcggcgcgatcatgcagttcagaccgaacatgcaggcgcagtagaagatggtcagcagcacggcgttatgcgtggtgccggtcaggaacagggtgacgccaccgagcacggctccgaagaggatccacggggtacggcggccgaagcgggaacgggagcggtcggagaagttgccgaacatcaggttggcgaccagggatgcgaccgcggtgaacgcgttgacgatgccgaccaacgcatcggcgttgacgcccgggatggtcttgtagtgcatgggcagcagcactgcggaaacgatgcccagaccggacatccacagcactccgaataccaggaagcctgcgccgaaacgtgcggcgttcatcttggacagcggcttgccggtttccggggacagcgacggatccttttccgccgcggcgatgttggcgttgtaagcggcaaggcgctccgccttgctggcgattgcttcactcatgaaactctctccttcgaatcatgcttcagtagtgaacttatgttgtgtgcgattccgcaccttagcggtgtatgtggtggtgggacggcctcgccccatctgttaactaccatgtggtaactaacgtgttttcagcgtaaaccatctttcgcaaagacacaagtcgacgtcatgtcatcgccgtctcaaagcgtttgcaaaaccggtcggacactgtttcattcagcttcacagtcaccggtttttattacctagtaactgcttagttaaatcatattataaatcgtttgtctgcgataatccggcgtgttccaagggttcccatcgtcttcttctcccccttcttgtaccttagtaagcaccagatgaaggagagcatatgcgtcgccgcaccgaaaacaaacccagaaagcgaatgagcgccgaggatcgcaggaaggcgattctcgaaaccacggtctcattcatctcccagttcggtttctggggcttcaccatacgcgatgtggcccaggctcagaacatcaccgaagccggcctcctttactacttcaaatccaaagaacaactgcttgaggaaaccctcaaatacgccgatcggaccaatcagatcgccatcgccgagcatcttggcgtgcagggcgtgaccggcgaagtccttgacgacggcatcgcgtaccactgcgatctggggctgaaggccatttccacgggaaccgtggagaccaacgccgaccgtccggagatggtccggctctacaccttgctggaaagcgaggcgctgagcaaggaccatcccgtgcacgagtatttcgaacagcgcgaaatcaatctgctgaaggaatacgcgttcgcggccaagcgcgacggcgtcgccgatccggagcgcaccgcgctgcaggtcctgtccgcgatggaaggcctgcagctgcgctggctcaacggatcgcatgacgtcgacttcatcggggaatggaaggccatcatcgacctgctcatcccctgacccagcgggccgacgcgccaccaccgctttgcggctcagccggcgatgacgaccacattccagcggccgatcgtcagcctgtcgcccacctcgaccttcgagccctccttcagagcgatcgccgcggtggcggattcatcgacggtgccgtcggtgcccaccaccaccggagcgaccaccacatcgcccgacaccgggctgtcgatggtgacctcgtcggcggagtagttgagcagatacgtcacctgctcgccgcgggcgttcgttccgcggcgcaccgtcacctgtccggcgagcgcggtgccggcatcggcgatgcccgcgtgttccacggcttcacgcaggacggcgcggatggtgtcggcgtcgagcagggtggcaatccattcggcgtcgcccttgccgaagccatgtcgggtcaccgcggcgtaattcttccacgcgtagtggccgtagctggcgagcacgtcggtgccgtcgaatggggtgaccagttcgatgagcgcctgcgcgtcgcttgccggggttttggcgagcgttccggcgaattccacggatacgtggccgttcgggcgggtgaattggttgtaggtcatgccgaacacgtcggtgaggttgtgcggcgcgcggtcgtgccatacggtcacctcgtcgtcggttacgaaggagcgcatggtggagacaaggtggccgccgctggagacgaattcgcgcagacggtcggttgtttcctgcggagtgcagtacagtgccggggtcacgatcatctcgtatttggccaggcgttcggccggcgcgtcggacgggatgaaatcgcattccacgttgagttcgaacagcgcgtcgtagatgttgcgcaccacgtcgttgtacttgagggtgccgccgaacgggaagccggcttcgatgaggaaccagtcgagcgcggtcagcgattcgttgctgaccatgatggccaccttgttgtgcttcttcaggtggacgagccgctctcccacttccggtttggcgatctcgcggccgaacacgcccgcctcgcggtaggtgggattcggttcgaggtcgtggctcagcaggcccttccaatatgtttcaaaggaattgtggatggagtgccagtgccaatattccaccatgtcggcgccggaggcgaggtgggagtaggcctgcaggcgcagctggcccgggaacggcacccaaccgtgctggccctgggcctccgtttcgagcaccaggtagttcctgccgtccttggtggagcgggtcatgtcgccgccgaaggcgatctccctgccggtcaggtcgtcctcggtggggtggtagatgtccacgccggtgatgtccacggcggtcgaggccttgaagtggtcgacggccggctgcacgccgtaggagtatccgcgccattcgaaatcgaagttgtgggtgatgaactggtcgtcatgcgcgtattcgcgcacgatgtcggcctgccactgcaggaaggcgcgcacctggtcgcggcggaacttgtcgaattcgccgcccagggactcgttgatggtggcggtcacgtccgggaagtcctcccaggagtcgatgcggttggaccagtagtcgaggccgaagtggtggttgagctcgtccagatcgccgtggaacttctcgcgcagatacttgacgaacaggcgctgcatgtcttcggagacggaatcgtagtatttcgtctcgttgtccacctggtagccgatgacggccggatggtcggcgacgtgggagatgagcttgcggatcacacgttcgccgtagaagcggtaggtggcgttgacgatgtccatgatctggcgcgcgccatacttgccctgtccgttcggcgtgaccgcgagcacgctcgggtcgagcttgacgagccagctgggcaccgcgtaggtcggcgtgccgacgatgacatcgatgccggcacgctgcgcggcgttaagcgcgcggtccacataagtgaagtcgaacacgcccggctgcggttcgcaggtgctccatgtggattcggcgatgcggatgacgttcagtcccgcagccttcatcatcgccatgtcctcatcgatgtggtcaatgcccttcatcatgagatattcgtcgtaatatgcggcgccgaacagaatgtggtctgcttcgtaacggcccatgaatcctccatcgtcctcgttgacttttatatctaacggttattagatataagaactatatatcttccgaaacaaatcgtcaactgtcgcagattttcaggcgtttcttaactaacaaccattagatatatgtcttcggaaggcttaccgatatccgtcccacaccggcgaggggaagatcatccgctcgaagacgagccactcgtcgtacaggtcgatcggcggcttgcgcgtccaccgcagctggatgccatccatcgcctcgatgcattgccgtacgatcggccgcatattatcccatccgccgacttccggaggcaatttccatgcgaaccgcgaataatgctcccacgtcagatccggtcggttttcgaaatactcgtgcagtggatggtccgcgttgaacgattcggtttccaaaaccatgtacagctgcagcagactgcggcgttgcgcattgtaccggaccaggaaccgcagataggcagggaacagcatgccgtccgaatcgctgccgggcaatcccgacttggcgaagtctgcaggcgtgccctgctggtcgtagttatcggtgaccagcagcgacaacaaccgttccttgttgccgatgtagtgcagcagtccgggctggctcatgccgatggcgtcggcgatgtccttgagcgacgtgccgtagtaccccttctcgccgatcagcttgcccgccgccgcgatgatttcgcgtttgcgctcttcgggcgatttacgaacccgctttttcccctcggtaaccatatggaacagcgtaccatcggacggaccctcggccggtcacgcctggaagacgtccggatgcttcgggtcgcccggttcgtcggcgagcacaccctcaaggccgaggaactcctgccagaattccaacgaattgccgtatgggatggcctggcttccgcgcgcctgcaggttcgccttggcctcgaacacgtcctcctcgcggatgccgtcgaagtagctttccagacgttcgagattcgtcggatcgtagaacagcgagccgatgatttcagtaagccgctcggcgcgggccaccggcagcgaatcccagtggcggaattcgatgaagttcttcaaacgcacgtcgttgaagtgcgtggagatcacatggttgatctcgtacgcgttgagcccgcggtccgggtacacgtcgttcgcgttctcgtagaacgccggatggtgcagatcggttccgggcaccgccagcgcttcgggcgtgtgcgtcaggtcggcgaacatcatcggcgtggacagcacgtccaccgcgtaatcctcccaaccgaaacgcgggtcgaacaggccggggatgacgttcgtgcgttggaaatcgagataatcccacatgcgttggcgcagcagcggatacgggttctccctgccttcgaaatacggggtgttgcggaagaaccatgccagaatcgggccgatcaccgtgcccaaccgcagtttggcgatcgcgtcctgttccgaaacgtagtcgatgctgacctgtgtcgaagcggagcaacgcatcatgcacggaccgaactgtccgacacgtcccaggtaggcggtcatcgccttgtatcggtccttcggattgacgggaatgtcggcgtaactggatttcggttggtaaccatagttgacgagtcggaaaccaagttcttcgaggatggggtcgacttcgcggcggaacgcgccgtacaatgtggcgagctcctccggcttgtgcaggatgccgatggacgtttccaactgtccgcccggttccaaagatacggagatgccgtcacgggcgagtccgaccagtcgcccgttttcccagtattccttgttttcgtcgtaatacgggcggatgcggttgagcaacgcttcaatgccgttgctttcgtagtaggtcaccgcggtatcgtcgctgttatgtaccggcaggtgttcgatttccacgccaaaaccgccggtgccgcgctgttggcagccggattcgaagaatttgataaggctttccacatgcttcggattcggctcggtcagcaggtgcgcgtacgtgatctttggcgttgtcatagtggccatcctaacgaaaagcgccattcgcaacgcaggctacgctatacggaaaatcgataaccgaccatcattccccatcgatttggctggcgatttgaatgccgattcgacgaccatcgattttacgatcgccgaatcagccatcgatttggcggctcagataccgtcgaaccgacgtcggaaagtttcccaacgtcggttcgacggaaataagaatggcgattcaagcggccttctcgctgttgcgcgcctcttcggctgcgcggtgcgccttcttggcagcggagatcatcagcttgatgcggttgagctggttggcttccgaagcgcccggatcgtaatcgatggacacgatgttggcttccggatgcagtcggcggatcttgccgaacatgcctcggcctgtcacgtggttcggcaggcaggcgaacggctgcgcgcacaccacgttcgggcatcccgattcgatgagttccaggatttccgcggtcagcagccagccttcgccggcctgcacgcccacggacgtgacctcgtcggccttcttgaccagttcaggcatcggcagatcctgcgagaacttgccgtgagccagatcgatcgcctcgcgtaccggagcgttgtacaggtcgaggcccttgcgcatcagcgcatagccgatcttgctgccgcccatgccgaggtaatgctcgttccagtcggaaatgtacggtcgggtggtcatgaattccatgatgcccggcaccacggcctcgcaatcctgcgattcgatgacgtccaccacatggttgttggcgtccggctggtacttgacgagaatctcgccgaccacgccgacgcgcaccttgcgcggctcgtccttcaacggcaacgcgtcgaacgacttgacgatctccttgacgagcgtcggatacggcaggtaacccttgctgatgaatttgcgcgccgtcttggaacgaccgtggtgttcgagcgcctcgcgcacgatggtgtcccacgtcttgtacagctggttcgcgctgccgggtgtcacttcgtacggacgcacgcggtacaggcacttcatcagcagatcgccaacgataagcgccttgatggcacgatgcagcaaagccggcgtggcggtgaagcccgggttgtcctcgatgccctgcgtggagatggcgatcaccggaatctgcggataaccggcgtccaccagcgccttgcgaatcaggccgaagtagttggtggcacggcacatgccgccggtctgcgtgatcgcaagcgcggtgtggtccggatcgtatttgccttccagaatcgcgtccacgagctggccgatgaccatgatggccggatagcaggcgtcgttgttgacgtatttcaggccggtttcgacgtcctctcggctggcatgcttgaggatgtcgaacttgtagccgccggagcggatgacggattccaccagagagaagtggatcgggctcatctgcggggcgacgatggtgtagtccttcatgttcttgccgaacgggatgcggttcgcatacttggacagggtcgccgagttgtgtgcggacgcgcccttgccatttgtctgcgttttggcggtttcttgcgattcgcccttgccgttttccgccgcgcgcttggatgcggccgtgacggcttcggtgagtttcggattggctttcatgacggtgtcgagcatgacctggcgaccgggggtcggcgcttcggtgccggtcttgcggaatccgtcgttcttcttgttgcgttcacgctcttcgacggccgccttgagcgagcgcagacggattttcgccgcgcccaggttggagacctcgtcgattttgagcatggtgtacacgtcggccttgtccgccaggatctcggacacctggtcggtggtgatggcgtcgaggccgcagccgaaggagttgagctgcacgagctcgagtcccggataggatgcgacgaagttggccgcctcgtacagacgcgcatggtaggcccactggttggtgacgcgcaatggcatcttggtgaccttgcggtcgtcgacgtggcggaagccgttcgcgttcttcttgcgcggatcctcttcgccttcggcgaggaattcgctcaggttgagcttctcccccggctgcagttcgcagatggagtcttcggaaagcaccaccatgccgagcgcgcagatggtctccgggatgccgtggttgatttccgggtcgacgtggtatgggcggccggcgagcacgatgcccttgcagtcgtgttccttcatgtaggcgagggccttgaggccttccatctgcacgtcgtgcttgaacacctcgttttcggcgtaggcggccttgaccgcggtctcggcttcctcgcgggtcacgttggcccaggcgaattcctcgacgatgcggtccaccatgagctcatggttggccatgttgaagtacgggcgcatgtagcgcacgccttcctcgcgcagttcgggcatgttcgcgccgatgaccaccggatagttggccacgaccgggcagttgtagtggttgtcggtgttgggaacgaagttctcctcatagctcacgcacgggtagaagatcgtcttgatgcccttgttgagcagccacttgatgtggccgtgcacgagtttggccggatagcagatgttctcggaggcgatcgattcgatgccggtttcgaacagttcgtgcgagctgcggccggagatcatcaccttgaagccgagcgaggtgagcagcgtgaaccagaacgggtagttctcgtacatgttgagcacgcgtggaatgccgatttcgccgcgggtggccttcttgtcggtcagacgacggtaggcgaagcaacgcttgtatttgtagtcgtacaggttgggcctgtcggaacgctgcttcttggaatcgccgccgcgttcgcaacggttgccggtcacgtagcgggagccatcctggaatgtggtgatggtgagcttgcagtggttctggcacagcttgcacacgtcacgttcggacgtcatggacaggttgtcgaggtcgctgccggacacgatgctggatgcggtgtgcgtgacgcctgcgatatcgaccgtcttcgcaccttccgtagcggcggaatcgccgtcgtcgagaccgtcggccacgtcggaatagtgcatgcgtgcggtcaacgcggcgccgtacgcgcccatcaggccggcgatgttcggtcgggtcacctcacgttcggtgagcagttcgaaggcgcgcagcacggcgtcgttgaggaacgtgccgccctgcaccaccacggtgtcgcccagctcgccggaatcgcgcagcttgatcaccttatacagcgcgttgcgcaccacggaatagcacaggccggccgcgatgtcctccatcgaggcgccttccttctgcgcctgcttgacggaggagttcatgaacacggtgcagcgcgagcccaggtcgacgggatgtgtggagttgagcgcggcctgcgtgaactcctggatcgtcaatcccatggactgtgcaaaggtctgcaggaacgaaccgcagccggacgaacaggcctcgttgacggcgatcgagtcgatcacaccgttggagatcgccaagtatttcatgtcctggccgccgatgtcgatgacggcggtaacgcccggcgagaccatttccgcaccgcgataatgggccatggtctccaccacgccctcgtccagatgcaggccggtggtgatcagtccctcgccgtatccggtggcgcaggagcgtgctatccacgcgccttccggcagctggctttgaatctgcttgacgatgttgacagcggccgtcagcgggctgccttcgttggtggcgtacgacgaccatacgatttcgcggtcgtcgttgacgagcgtcgctttgatggtggtcgacccggcgtcgatgccgaggaagtgcgggccttgcgcgccttccagcgtgccgatgtgcacatgctcgcggtggtggcgcttgttgaacgcctcacggtccgcttcggtcgggaacagcggaggcatggtgggggtgttggccggcagattcttcaggtcttcaaggcttttcagaatatcggcgcaggtgcgtgcttcgaaatgctggccctcctcaagctggtccggttcgccggcgagcagcgcggagccgaacgccacgtacaggtgcgcgtcggtcggcacgatgaattcgtcgactttgtcttcgagcgcgcggtggaacgcctcgcgcagttcggacatgaagaacagcggaccgcccaggaagatgacggtgccgtggattggtcggccggacgccagacctgcgatggtctgcgtggcgaccgccgtgaagatggatgcggccagatcgggcttggccgcgccgtcgttgatgagcggctgaagatcggttttggcgaacacgccgcaacgggaggcgatcggatagagcgtctcgtaatgcttggccatgtcgttgaggccagccgcgtcggtgtcgagcagggtggccatctggtcgatgaacgcgccggtgccgcctgcgcaggaaccgttcatgcgctgttcgggagtcggcttcagatatgtgatcttggcgtcctcaccgccaagttcgataatgacgtcggcttgcggatattcctcgtcgatggcgcgggtctcggcgatgacctcctgcacgaacggcacatggagattatcggccaaggcaaggccgccggaaccggtgatggccagacgaatcggctcgtcgccgcggccacgggcctcaagttctttgtggatgtcctccagcaggcccgccacggtggcacgcacgttggcgtggtggcgacggtaatcggagaagagcaccgcgtcgagcgaatcggtctgatcgagcaccacggccttcaccgtggtggaaccgatgtcaagacctacgcgcaacggcttcgtatcgcaggtgttgtctgcggtaactgctgcttcgaccatgtactgtacctctatcgttctcatccgccgggttgcgtccgtgccaacacgaacgccctgccccggttatccaagtatgtaatggtagtctgtgcccctgcctaattccaaccgtccgtacacgaaccgttcgaaaccattcaggaagccgtcccctcccctgcgacgcggtccttgccgtagatttcgggaatgaaccgcgtctgatcgtgtagtttcgaccacagcaccacctgcccgctttccaacgacttgggtacatcgatgatgcgctggttggagctgccccggaactgcagcagcgaatcgtgcagatccttgatataccggccatccacgaggatatcgatctgttcgagcagttcacgcttgtcggggctttcgccttcgcgcatgagctcctcccacgtgtagcccgtccagcaccagatgtccttggtgcggccgaaccgctcacggatcttgcgtgaaagcggcagcagcacgccggtgttgagcagcggctcgcccccgaggaaggtgatgccctgcacgtacggcaggctcagatcggccatgatctgagcttcgagccggtcgttgtattcgtggccggcgcggaaatcccagatcgacgagttgtagcagccttcgcagtggaatgggcagccggagacgtacagcgagcagcggattccctcgccgtcggtcatgaggaaccgcttgtagtcggcgatcatgttgtggctcatcgcgttcgtccattgtccggcgcgcgggttgctggcgcggtttgtcggaatgaacggcccgcggccggtttcgccggccgcgaaatcacggcgagacacagcgggatcggcgctgcttaccatacgttgctcctgaattgcctgttgttttgcgattattgcgattgattacttggcttcctcgaaccattcgcgttcggaaccgtcgtcaagggtgacatggccggtttcgccgctcatgtgcttgacgcggtgcgcgatttcctcgtgtcggccgtgcaccatcgggcgctgcaccggattgccgaggtagccgcaggtgcgcttggtcacgttgcagcggtccgggtcggagttgccgcattcggggcacttgaagccttcttcggtcggttcgaagtcgccttcgaaaccgcattcgtagcaacggtcgattggcgtgttcgtgccgagatagccgatgccgatggtgtaggcgtagtcccacaccgcttcgagcgccttcggattggcctgcaggcacgggaattcgcagtagttgatgaagccgccggacgcgtagtacgggaagtccttctcgtagtcgagcttctccatcggcgtgggctgcagccacaccgggtagtggaaggagttggtgtagaagtcgtggtcggtgacgccgcccacttcgccgaacttctcgcggtccatgcggttgaagcggtcggtgagcgattcggccggcgtggagtacacggagtagtggtagccttccgcatcgctccattccttgcacagctcgttcatgcgcttgacgatggacagggcgaattccttgccttgcggatcccagtcgtggtcgcgcatccagtccttgccatagaacacgctggtcgcctcatacaggccgatgtagccgagggacacggtggcgcgttcgttgcggaacagctggtcgacgctgtcgttggcgccgagacggccgaatgcgccgaagcggaacagggtcggggcgttgaccggagtggcctgcttgcaacgcatgatgcggaactgcaatgcctgatgggcgacggtcatgcgctcgtcgaagatcttccagaagcggtccttgtctccgtgggattccaatgcgatgcgcggaatgttcacggtgaccacgccgaggttcatgcggccgtcctcgacatccttgccggtcttcgggtcgatccagccctgcaggaaggaacggcagcccatcggcgctttgaaggagccggtgatcttcacgatgttctcgtagaagatgacgtccgggtacatgcgcttggtggcgcattcgagggccaactgcttcaggtcgtagttcgggtcgcccggatcggcgttcacaccgtgcttgatggtgaagacgagcttcgggaagatggcggtgtgatgctcggaaccaaggccgcggatgcggttgaggaagatggcgcgctggatttcgcgcgcgaaccagtcggtgccgagaccgaagccgacggtcacgaacggggtctggccgttggacacacggttggaattgatctggtattccatggtctgcatggcgtcgtagatggccttgcgggtctggatcttcgcccagatctcacgcagctgctgcagacggtcggacgtcttgtcgaacggctcgtccatcggcagtgccggacggtccttttcgaaatgcaggcgcttcggctcgacggccttggccatgcgcacctgacgttcggcgatctcgatcggcagatcgtcgggcatgatctcgtgggcctgctcaaggaacttgtcgtaatccttcttggcgtattcggcgaaatgctcgtcggcgcggttggcggtctgtccgccgtactggctggaggccacgtccttcatgatctgggtgatctgcgtggcggcgatggagatgctgttcggcgaacccatcggcgcgttgccgagggtgaagccgttggcgagcatatcccagtagttcggcagcgagcagttggactgcgcggtgaacggcgagtaatcggcgtcgtggaagtggatgtcgcccttcatgtgggcgttggacaccgcgtccggcagcatggagaaggcggacgccttggacaccgcgccggccagcaggtcacgctgggtggagtagacgttggagtccttgttggcgttctcgcgcaccagagcctcgtcacggttcaccagacgcttgacggcttcgttgatgtcggtggccttggcacgttcgatgtctttgttcagacggtagttggtgtacgtgcgcgccacatcatacaggtgatcttcgatcaggccgtgttcaacgagattctggatgtcttcgatcttggcgggaccgttgtaacggtccttgatttcggcctcgacctgattggcgatgtcgcgaatcagccgttcctcctgaggaccgattttcttgtcgaggtcggcgaaagccgatttcaccgcgctgatgatgttgatcggatcgaaatcgaccacacgcccgtcgcgcttctcgacaagcaccttgaccatttccggcgcgttctcggtttcggtcgcaacgccttccagagtctgggtttccatgtatatttcctttccgggccggacccatccggccaggtttcatgcttcgtccgcatgcccgttcatacctacagatgcacactctacgccaaggtcggcactaaatgtagtgtcaccacgccgctagagaaactatatattctacttttggtgagatttcgccattttttgccttgtgtgacaaaagtaacgatttcatctcggagtgtcgttttgacacagccccacacaccgtactatcttcacgcacggagcattcgcaacactcgaacatatgttccatttgtccgcaagatgatggaatcttgacttatgacttggaacccggattacaacccaccgacggcacagcagacgtcgaagccgctgccccgtctggcgtcggaaaccaccgccgacaacccttggccggtgagcctgctcagcgagaagttctacacggcggtcgaacgttggccctccgtatgggtggccgggcagatcacgcagatcaacacgcgtcgtcagggaagcgcctacatcacgctgcgcgacgaccagcaggacatcgctatggaagtcaacggcttcggacggttcgccgcggcggcggcgccgtttgtgcagggcgaccgtgtcatcatccacggcaagccgaacgtgtggatgaagcgcacgtcgctgtcgttgcgcggcgacgcgatcatcgcggccggcgcgggcggcagtctgaaggccatgatcgacgagctacgcaagaagcttaagggagaaggtctgttcgacgccgatcgcaagaagccgttgccggaatttccgcattgcatcggcttgatctgcgcgccgcaggcacgtgcggaaggcgacgtcatcaccaacgtgcgtctgcgttggcccgtcgtcggcttcaaggtgacgcatgtgcacgtgcagggcgagcagtgcccgtcggacgtggtagcggccatccggcagctggatgccgatccagatgtggatgtgatcatcgtggcgcgtggcggcggcgctttcgaagatctgattggcttttccgatgagaacgtggtgcgcgccgcggcggcggcccacactcccctgatttccgccatcgggcatgaggacgattggaccctgctggatttggtggccgacctcagggcctccacgccgaccgacgcagcgaagaaggtcgtgccggacgtgcatgagcagatgcagctgattcaggtgaacctggaccgcatgcgcgtgcgcatcgatgccaccgtctccaacgagaccagacttatcgaaggctacgcgaaccgtccaagcctcacccagccgctcaccatgttggaaccgcatcagcgtttccttgatgacgcacgcacaagaatgcggatcggtctgacccgtattcttgacgacgcgagcctgaccatcgagaaagcgcacgcgtcgctgaccgcgctcagcccgcaatccaccctcaaccgaggctatgcggtagtgcagggagccgacggccatgtaatcgacgatgcgagcgccgtgaacaccggcgaccagctcaccatgacattgaagcacggcatgatcgtgtccgaagtcaccaccgtaacgaaggagcagcaatgaccaacaaaaccacccccgcatccagcctgaccgacaaggaacgcgaagcaatcgcgcagatgccatacgaggaggcgcgcgacaagctcatccaggccgtgcaggcgttggaggcgggcggcctgaacctcgaccagtccatgcggcagtgggagatcggcgaggcgttggccaagcgcgcgcagagcctgcttggcgaggtccgagccaagctcgacgccgcgcaggccgagcaggccaccgcggccaacaccgcaggcacgcaagacaatctggcctgagcatccgtcgcggcacagccgctcccctcacctacggacgttccaccggaacgtccgtcaaacggcttgagcccgaacaatcaggtccgattacccgtcatgtcgagtccatattgtgtgtacaatggtgactcgttgcctcagtagctcagtggatagagcacttctctcctaaagaaggtgtcgtaggttcgattcctatctggggcactttttcatatccccgtacattgtcggcgcgcatcgccatcggcagcatccaagatcaatcgcacgtccgcaatccggacaacaccatctcaccgccaccctccagcacaggcacaatgagcctccctctgttatagtggcaaacggatacttaagcggttgagtgaatgtatccaaaaggttcccccttctgctatggaagcatcggaaagcaaccgcacaacccatacatcacctttggaagaccaagggatcagcacgcaagacataccatattcctctattgtggaacggctggcgcacacgaatccggtaggacagttgcccggaccgctctcctacaagctgctcgaccagttcaccatgccgatgctgcccacagaaccgcaatgcacgaacgtcatcgcctgcatccgatattcgaataacatgccggtcgtcaccgtctagccacggacttagccgacccgcacaatcgccagcagcgctttgtggtcgctgccgtccactttgactgtgcgcacctgtccggcctgcatgccggaatccagtacgatatggtcgattccggcgaacgacggcacgtaatcgacattcgcaggccatgagaatttcaatccctcgccggcctgacgggaggcgtcggagaaacggtttcccagaatgttgcggaacggcgtatggtcgtacgtcgcgttgaaatcacccatgaaaacgtaccgtcggctagtgtcgaaacgtagtttcgccagttcgtcgagcgaccgcttccactgctgccagtaatcgttcgtcggcgacgtggtatgcacggatacgaaacgcacctgcgtggctcccccattgaacgaaacggtgccgcccggcatgaacgacgcgctcgaatcgacatcgtcatcggaagggtcgtcaagcggactcgccgaccaaaggccgttgccgtacacgccgtccgaactcgacacctgcgcatagggcagatacgaggcgatgccggcacggttcagatcgtccacgaaagcgtcggtcgtctcctgcaacgcaagcacctcgacgtgttcgctgcgcaccagatccacgatctcacgcgcatcggcgcgccctttgtacacattgcacgtcatcagccgcgcgtagccgtcatccgtgttgacggtttcgccggacgccgccgcgactgcggcacgtggcagtttcgaaggctggtagaagaacggatactgccagaacgcctgcaacgcaatcgccagaacggccatcacgatggacaccgtacgtttggagacgatggcgcagacgagcgcgattacggcgagcagcgtgaaccatggcactagggagacgacgatcggcatatacggcaacgcctgcagttcttccggcagaatgtgcgtgacagtgcccagcagcgcggcgagcgcgaatatgaaggcaatcaccgcgcagatgaagttgcgtacgcgatgcgttttcgtcttattcagcgtgcgtagcggcttgaccggtctcgttgcggccggttttgctttagcccgattcgctttggccgacgcttgcgatttgcccgttgccggcccttgcggctggcgtgtttttgcctgagccataccattcccttgttttttcggaacgcacgtccgcgaccatccatgtccgcccgtgtccgtttatgtccgttccgttgatgttccgacggtttccttcacgccttcggcttagtcgtcgaggccgagctcgtggcggatgccgtcgatgatgatgcggctggcggtggtgccgcgttcacgcgcgttttcctgcagcatcattttcagatcggatggaattttgaaactcatgagcacacgttcgccgttgccgttgccattgccacggctgcgggtgtcctgcacgctggtcagcggagcggtggacgctgccttcgcaccaccgttcggttttctaatggccatcaggcgatcgcctcctcaagttcgagatacacgtcttcatacccattgagattgctaggaaatgcgtggccgatgactttctgcatgcccacgcgcttgggtacggacgcgtcgaagacgctggcgccgcgttcgcggatgagattgaccgcgttgccggccagcttgttgttttccactttgagcagcagcagcgcgtacggtttgccggccgcgtcgaggctttccgcggtttcgagcgcatggctcagttcgaatggcccctgggtggccggaacgatgacgaaatcggccacatcgcaggccacatccaccacgttgccggccggcgggcagtcgatgatgacgagttcgtcatccgccatggttttgcgcagtcgtttcagtttgccgatattggcggagtccacggtgaacggcagggtttcgccggcgtcttcggcgtcgcccgcccatgtggtggcgtcgccttgcggatcggtgtccagcacggacacgttgcggttgtgccgtgcggccgcggtggccaacgccatggcggtggtggttttgccgctgccgcccttgaggttgatgaccgagatgatcatgaaggttcctccgcttcgacaatcaatttatataagacgtatatactttttatatattggatagacgacagtcacgctgacggcgtaacggcattggcaatgtaaaagatagtggcgacgcactcttgtcagttactttgacgggtaacgaaaaatcccgaggagctcagctcaactcgggattcgaaaagagtaaacgcggcgacttgctactctcccacaccctctcgagtgcagtaccatcgccgtgctaggccttagcttccgggttcggaatgggaccgggcgtctcacctaggctatgatcaccgcaagaggaaacaatacgcgaacatgcggcaatcggcaaacttcggcgtgtcgcgcactgcaatcgcgttccccaatcgccaatgatcgccagtaatcgcgcgaatgccggcaatcgcaatgcatatgcgctacagtcgaagcaatgccgcaacaattgcggcgtgcttacgaaagaaggccagcaatgacgatcgcctcctgcggttccgtttccgcaaccactttgggtctgccgaattccactgcgattcccgccgagaagtcgaagctgccgaaaggcctgttcgtggcgaagattccggtttccgccaaaacaaagcagcgattggcgaacgacatcgaatcaatcaccatgctgtcgctgctgcaggcgcgcaatacgaagcttgccgccggtacgcgcgtgccggaaatactggtgatcggcctgcgtttgcacgaaccaaacgccgccgttccgacggatatcgtcgaattgattgcgatgcaacgcaagtcgggcatgctgttcgtttgcgtacgcgacgccgatttcgaaggtacgacgcgtcaggagtgcgcgttcgccgtccgtcgagcgctgccggcacgtgccgggcacacgaccacatccaaggtgttcgcttccgattggcagccggccggcgaggccacgctgaacgccacggatccggcggtcgattccatggacgccttgtgggagtcgctatgctcgcaggtgattctggacggcccctcccccatcgacgtgaacacgcgtcttgcccgacgcatgcagattgcacagctcaccgcgcaggtcgacaagctcacccgcgaccatcagcgtgccaagaatcccgaacaacgcaatgaaatctacgcgaaactgcacaagacgaagcgccagttggaggaactgcaagggcagtaataccgccgtaatacaaagctcggctgcaatcgttacgattaccgagattccagtaattgcaacaattacagccgagccgtaagcgaggtttggcaacgtggccaaagcgcgctctcaacaacgcgccacagccgcgaagccgctagaaaccaagccttgtgcggccgaactggtcgagccagcgcagaatcgcaccttctcgcagcgcccacgggcagatttcgatttctttgacgtccagtgccttcataatctcatcgatcaccaggccaccgccgacgatctgatacgtacgttccggcgtgacgcccggcaatgcggtgcgctggtccggggcgatggccgcaagacgcggtagccaatcctcgagctggtcgatcgtcataatcgacgtgtccacacggcccggttggcgcatcaccgcaccggcgagacgggccagggagcgaatcgtcttcgacgtgcccacggcatgcatcggatgcttcgatttggggaacgacttgaccattggctcgaggatcttgcggatgttcttgcgggcagcttccagatcgtcatcatccgcgacgccgctttccggcaggaactcgcgcgtcacgcggccagctccggcaggaacggacagcgcgacggtcgggtcctcgtcggagcccatggccacttcgagcgagccgccgccgatgtcgatgacgagcaaacggccggcatcccagccataccaacggcgggcggccaggaaggtgagtcgggcctcatccacgccggacagcacggtgaccggctggccgatggcctcttcgatcttgcgtaggatcttgcctccgttcggcgcttcgcgtagtgcggaagtggccaggaccagcagctgggtgatttcgtattcttcggcgagtttcatcgccttttcaaccgcgctgagcaaggcttcgatgcctgcttttttgatgctgccgtcatctttgagatactgcatcaggcgaatggtgcttttggtgctggcctcgggctcggggcgcgcgcccggagccgcgtcgacgatgagcatgtggacggtgttcgaaccgatgtcaagcacgccaagtcgggtggcgtgcgaatgcaatgtaaccatggttcacagcttaataacttaagcgattaacctattgcacgacatgccttgataacctttgcaaatatgcccaccctcggaaaggagggtgggcacccaataatcacagtgcgggaaacgattgcatcggcgtgaaaaatcgcgcttcagacatatgtttcagccgaatatctcaaccatgcacctcagccacgcactttggctacgaaatcaccgagtcgcttcaatccttcgcgcagggcttcgcgggaagccgcgtacgacaggcgcacgtgcgtatccgcggtggcctcgccgaaatcgcggccaggcgtcaacgcgatatgcgcctccttcaacgcacgctcgcagaacgtccacgcatccaaaccggtgctggaaatgttgaaatacgcgtagaacgcgccgttcggttcgacttccagcggcagaccgatctcggccaaaccgtccactacaatgcggcggcgctccagcagttcctgacggcgttcctcgcacacggccagcgtttccggcgtgaagcaggcgagcgccgcatgctgggtcggcgtgtgcgcgcacaggaagaagttggtggcgaggtcgtccatggcttcgagcgcgtattcgggcacgaccatccagccgagcctccagccggtcatgccgaagaacttggagaagctggagcagacgatggcgtccggatcgcaggccagcacggatttcacgtcggatccgtccggttcgcggtcggccaggtcgaggtaggtttcgtcgacgatgcgccatgcgccacgctcacgggctaggtcgcacacggctttcagggtgtcgaaggcgatggtggtgccggtcgggttggacggcgaagtgatcatgacggccttggtgcggtccgtccagtattctttgcacagttccggcgtcaggtggaatcgggtggcggcggacgtcggcacgtccacgactttgccgccgaacgcgcgtaccagctcgcggttgcacgggtaggacgggtctgcgatgagcacttcgtcgtcatcgttgaccgtcagcgcggcggacagcagcagtgccgtcgaaccgcccgcggtaatcgcgatgcgtttcgggtcgacgtcgacgtggtgacgttccttatagaaatcggaaatcgcctggcgcagttccggcaggcccatcgccgcggtgtacggcagcggacggccgtcatactgttcgcgcatggcgtcacgcacggccggcggcgcgccgaagtccggctcgccgaggcttagtttgaccacgtcggtgccgtcggcgatcatctcatcggccatggctccgaacaccatggcgcggaacggattggcaatctgcgcgcgcttcgacaactgcggctgcgcgccattttcagcatttcccatatttcgtttttaccacgttccctgtaatgctgcctgccgacactcatttcacggaatcgtccacgatttcgcggtaaagccgttccaaccgttcgtcgcgcaccttcttaccgagctcgcattcccacaccacgatgactttccagccgtccgcttcgagttcggcgcgctgcctcgcgtctcgttcgtgattgcgcagcagtttcgcggtccagaattcgacgttcgatttgggcacgcgtgtggctttcggacagccttcgtgcatgtgccagaagcagccgttgacgaatatgatcgtacggtatttcggtagtaccacgtccgggtggcctgggtatcgcttgtcgtttttgcggaatcgcaagcctttggcaaacagaaagctacgtaccatccgttcgatggatgtgtctttgccgcggatgtgggacatggtgtagctgcgcgtgccccgctcgtatttttcgggtttgccggtttttctaggtttgccggttttcttgggtttgccggtttttccgggtttggctgtctgcctgcgatgctctgccgtcacggcttcccattatggcaaaagggccgatcaatcgttttcgcataacgcgtgccgccgtcgcatgtggcgtacgctggtcattgcaacgtagcaaacaggcagttcaaaacaaggagatttcatggcacagatcaatgtggcgattctcggcgcgggccgtatcgcgcagagcatggccgaaacgttggtgaaaatggcggcggatgaccggtaccgtgatctggtcgcaccgtacgcggtggcggcccgcgacggcgagcgcgcagcggcgttcgcggcgaaatatggttttccggtgtcgtacggatcgtatgaggagcttgtcgccgatccgaacgtgaatcttgtgtatatcgccactccgcataacttccatgccgagcaggcgattttgtgcatgcgcgccggcaagggcgtgctggtggagaaggcgttcggcgcgaacacgcagcaggcgcgtgagatattggacgtttcggatgagaccggcatgctgtgcacggaggcgatttggacgcggtatatgccgtcgcgtggcatgatcgacgatatcatcgcgtccggcgtgatcggcgaggtgcaggcgatcgacgcgaatctgtgctatccgaccacggcgaaggcgcgtatcaccgatcctgcgctggctggcggcgcgctgctggacgtcggcgtgtatccaatcaatttcatcgacatgatcatgcataatgcgccgatcgcacgtgttgaatcgtcgatgcaaccgtatgaaaccggcgtggacgcgcacaattcgatgacgttctattaccagaatggtgtgatggccaccgcgcaaagctcgattctgtgccattcggaccgtatgggcgcggtgtggggcacggaggggtatctcacgtgccagaacatcaacaatgtcgaggcgattgacgtgttcgacggctcgcatgccgtcaccgcgcattatgacgttcccgaacagttgaccggctacgagtatgaggtggcatcggccgcacaggccatgctggacgggcgtaccgaatgcgatgagatgccgcattccgacacgttgcgcatcatggaatgcatggattcgctgcgtgcggattggggtcttaagtacccgttcgaagcgtagcgatgcgatcgatgacgtgggcgtgacgcgctccgcccacgttataattgccccttgcggcgatttggaaacgcatggaaggagcgtcatgggattgctgaggatgctgaagtacgtgctgggcacggaagatgagacgcagcagccccggcaaacgcaatcctctgccaagaatgccaacaacgccaagtctgcgcggaccggacagaccaagcagacgggacaggttgcgcgacgagtcacgcaaccgcaactgcaaccgcatgccacgccgcaacgtcaatcgcaacgccgtcaatcgcaacgccgtcaatcgcagcaacaccaatcgcaacggcctgcaaagctcaccccgcaaccgctgttgccagccgaccgcatcgacaaggcgcgtggcatcatcggcaatatcgaaaagcacgaattgagcgacgagcagatcagcgcgatcgccggcgcaggtcacaacaccctcgtgcttgcgggcgcgggaaccggcaaaaccactaccatcgtcggatatatcgcatggctgcttgccacaaaacgcgccacccccgaagagattctcgtattgtcgttcaccaaggcgtccgcggacgaaatgtcgcaacgcatcatggcaagcaccggcaaaaggatccgcgcatgcacgttccacagtctcggcctggaaatctgccgtgcggccaccatcgccaaccgtcccatcatcgacggccatgcgtcgaacgccgtggtacgagacacgtttgaccggctgctcgcacagaacatcccctaccgtctgctcgcattcaagctcatgtcgaaggagctgttcggcaagtatggcgccgccgcgaaacgtgaggatttccaactgccgacggatgattacgctttcaaccagtacaggcaaagccttgtcgagaacgcgcagaccatcatccagcacatgcggcagaacaatatcggcatcgacggcatgcgcgagctcaatgagaggcgcggcggcaaacatatcggccgtaatcgtgagatgctgcagctcgtcgggccgctgtacaacgcgtatgtcggcaatttccgcgcgacccagggcatcgattttcccggcatgatcaccgacgccattcgctgcgtaaggcgcggcgcataccgccacccgtacaaatacgtgctcatcgacgaatatcaggacatgtcgcggccacgttacgagctgatccgcgcattgcgagagcagagcgatttcacgctgttctgcgtgggcgacgactggcagtcgatctaccgtttcgccggcagcgacattcacctgattctcgatttcgccgatatttggcgcgattgggggccgacacgcatgttccagatcacgacgacgcgacggttccggcagagcctcatcgatgcgagcggcgcgttcgtcatgcaggacaaaagcctgtacgccaagcaattgcgcaatccgagcgacaagaaggattattcgctgaaggcgcttggcggcgcgacgcaggaggaacggttcgatgcgatcgtcgagcagttgcgcaaactgccgaaagccgcgtcggtgctgatgctgggacgctaccgaagcgacctgaacctgctgtcacgcaacgaccgcgacgggctgttccaaatcgacgagcataccggcggcatcgtttttccggaaaaaccggacatggacatcaaattcatgaccgcgcacgcttccaagggtctgcaacgcgatttcgtttttctgctgtgctgttccggcggtttgaagggtttcccaagcgcgattccggaagagccgctgctcggcctgctgctgccggaagtggaacgcatgccgcacgcggaggaacgccggctgttttacgtggcgatgacgcgttgcaaaaagaagctgtttttcgtggtggaccagtcgcgtccgtcgcgtttcatgtacgaattgcacgacaggatctgtccgaacatcttccatggcgtgaagctgccgccgcaatgcccgaattgcggtgaggcattgcgattgcgacacaccggctccgacccgtcccgcgcgttttacgggtgcaccggtttccccaactgccgatacaccaggccatgcaagtgacaccattgggactgatttccatcgcgtaagttgctccccattcgggcctggcgtaatctcccccgttgtatcctggacctgttcattagtcaggagaaagcaatgacggcaaccgaccagaatccgcaacagtcagcgcaaccgacaccgcgcaaaaccattaacgtcgtcggcgcggctatcgtcaaagacggcaaggtgctgtgcgcgcaacgcggagaaggccgatcactggctggtttctgggagtttccgggcggcaagatcgaaccgcatgaaacggcgcgtcaggcattgcatcgcgaaatcgaagaagagttgctgtgcgaggtcgaagttgccaacgaagtgtgcacgtcttcttacgattacgatttcggtaccgtcgtgctcacgtcgtttgtgtgccatttgataagcggcgcaccccatctgaccgagcatcatgagattcgttgggtagcgcccgccgaaatgcccactttggactgggcgcccgccgaccgagaagcggtgcgattgatctccgccatggattttccggcttttccggcagccacgcacgaaagtgacgactgatgatgcgcaatatggacgaccatgaccattcctcccttgttgaggcgctgctatccggtttcgtcaacaaaaaggacaatgtcgacgcacagtacgagccgacgttgatcgccaatcatgacggtcggaccatggaatacgccatcaaggacgaactgcaacgcagtcaggatttcgacatgtccgtcgcgttcgtcagccagggcgcgttgcaggtgcttaagcagtatttccttgatctcgctgacaacaatgaccatcaggccggtcgaatcatcacgtcgacgttcaattatttcaactctcccaaagcattcagggaactgctgaaacttcagcgggaaaccggtattcaagtgcaagtttggcagccggagcggtccagtcgaaacgatgacgatgccacagctgcctacccttatcatcccaaaggctatgttttccatcatgcgcaaggcgacgagccgttgtattccacgtatgttggcagttcgaatctcaccatcaacgcactgaattccaatcgcgagtggaatctcaaagtcgccaccaccgataccagcggtcttgccgaacagcttagcgaggaaatcgaatcgcaaatcagcgaatcgaagccgctcaccgacgcttggctgaaactgtacgaggaagacttcgaaaagtacgcgccgcaacggccgaatcgcaagccgatcgaaaaaacaagccaatcgcaaaccattcagccgaacgccatgcaggtggaagcgctgatgaatctcgcacagctacgcaagcagggcgaaagccgtgcgatcatcgtttccgctaccggcaccggcaaaacgtatctgtcagcgttcgacgtgcggcaggtcaaaccgaatcgcatgctgtacatcgcgcaacaggagcagatcctcaagaaagctgaagaatcgttccaaaaagtgcttggatgcccgaaaagcgaactcggcctgttttcgggtggcagcaaggaatcggatcgcaaatacgtgttcgccaccgtgcagacgatgtcgcgtccggaaacgcttgcacaattcgacgcagacgagttcgattacattctcgtcgacgaagtgcatcatgcggccgccgaatcgtataaacgcgtcatcgaccatttccagccgaatttcatgctcggcatgaccgcaacgccggaacgtacggacggtgcgaacatcttcgaattattcggcaacaacgtggcctacgaaatccgcctgcagaaggcgcttgaagaggacatgctctgcccgttccactattacggggtgcacgaatacattcaggacgcgcccgacgagaagatcgccggcaaagacgtcaaggtcgagtcaatgaccgaccaggaacgtaacgagctaagccgttggcttgaagaactcgccgacccgaaccgcgtgcgctacatcatcgacaagatacagatctacagcgaggccggaacacccgtgcaaggtctggtgttctgcagccgacgcgaggaagcgaaacgactgtccgacctgttcaaccagcagatgaaccagcaggcggaacggccataccgcacgaaagccatcaccggcgaaaattcgcagatggaacgcgacactgccgtggcacagttggagaacggcgaattggactatattttcaccgtcgacctgttcaatgaaggcgtggatattccacacgtcaatcagatcgtgatgttgcgtcaaacgaagtcgagcatcattttcacgcagcagctcggccgtggtttgcgcaaggcaagcggcaaggattgcgtggtcgtcattgatttcatcggcaattacgcgaataattatctgattccgatcgcactgtacggcaataccggcgaccgcgacgtagcccgtaagaatctgcaacgcgaaaccatcggcgtctcgtccatcagcttcgacaaaatcgcccgcgagcgcgtgcttgcctcgcttgacaccgccgatttgtcgaatatgaaattgctgagccagcagtaccagcagatgcggtacgaattgggacgcatcccgatgctgatggatttcgcgcgccgtgacgcgtcgctcgtgttcacgatggctgcgaagaacgacgattatctgtcgttcgtgcgttcccgtgagaagagcctgtcgcgtggcaagaacgcaaccgtttcgtatcttgaacagcttgaatcgacttcggatgcgcacaatggtgtgctgaaaatgttgaccgccacgcaattgcgcggcttgcgtccgcacgaattgttggttttggcggcattgtgcggtatggattggcagcggatcgatccggattgttccgaggatgcgctgactgcgcttcgtgaggtcgcttcacagcatgcgatcacgatcgtcgatttgcagacgttgttgactgcgctgttccccgatgcggacagtaacgagttgcaatgccgttccgcgttcgccacgttggattattcctatttcatcgccgcgaacagcaaacgtttcgggcagactcctttggtgcgcctctgcgatgatggggcttatcggttgaccgacgagttccgctcgatgcttgaacagaccactttccgcacgttcttcacggataccgtcgaagccggtctgttcaacgcgttagcgttggcggaatcgtcccgcaagcatcatatccgccagaatcatgggttcctgtatggagaaaagtacagtgtgttcgatgtgatgcgactgtgtggttggcctgcggaacaggtgccgcagaatgtcggcggatacaaattggacaccgaaaccggctcactcccgattttcattaaatatgaggcgagccagtatggcgaccggttccttaatcccggcgagatcgaatggttcagcaagaacaatcgttcgcttaaatcaaacgaattccggtggctgctggacggaacggaacgtactccggaatggcagaatcgccattttgtgccgattttcatccgtcgcaaagccgaagaacaggagaaatcctattacttcgtcggcagcgcggtcgcattggacgatgtgcacgcgtcggtgaaccccggcgaggatggcagcgagtcgaaggtggtcatttccacactcaaactcggcaaaccggtcgatccggaactctaccgccacctcaccggcaagtccgccctgtaattcgcgaccttctgacacctatctcgcttatagatggcggatttggatcactgacacatgccatctcgcttatggatggcggttccaacagcaaaaacgaagtttgggggtatgaatcatacccccaaacaagcgatttacttcagtacaccgccatccataagcgagataccagcagacgcacatgaaaatccgccatccataagcgagatagccccgcaatcactccagccacacatcgaaacatataaaaagcggcttgcgtatatacgcaagccgtccgagctgaaagtagccgaaactacggaaggtcactcaccgaccgtcggcgtagccacccatgtcgggcccatcgaaaccgccgtcgaagccagggccgtcaggacccgggccgaatcccggaccagcaggaccacccggaccgcccaggaattcgcgcgccgacatgccgttctctctacgggaggcatccactgcttcctgcagcaccttgcgaacttcgaatccgttcagcacgttcttcaatgccactacgccattgccggacgactgatcgcgcgtatccagcacaatcgtgcccatgccgaagatgcgctgcaggaatgtacgttccacgctgatatccacgatgcggaacagtttgatcaagttgaaactctcgttcagaatgccggttttgacgctcagctcacggtcggtaagtgtgtacacggtgaacgtgaacggcgtacggcaccaattgcgcttgcgctgctgccacaggacattgccacttgcaaccttcatatggttcccccttttcatcagaggcctaattggactggccgccctatgcggcacagcacaccattctaccgtcacgctcgcacgaacaccgttttatctatcgcacagcgcagacgtttcacacactgtttcacacgtcgttccgtgtaggaaaaagagacacttcacagcacgcgcagcagcttacgcagcaactcgcgccgcatccgtcacgtcgcgcacgataacgcaaacacaggcgagcgccgcttccgcggcattggcaccaatcagcaccacaccgtcaaatcagttgtagcccttcacttcgcggaagatgccgctcaaattgccgttgcgtccgtcgaacaccttgccattggacagcttggccaaatcgttgagctgctgcgaatccgcgtcgccgaacatgatggagaaaatcggaacgcctttgccatcggacgcatactgctgcttgaactcgtcaagcttcgccgtgtccgactgcccgtcggtcagcagcgcgatcgccaccgtgtaatcgtcgcggtcggacggcagattcttcaacgcgacttccagcgcattgtagatgtccgcattgccatttgccacctgattttcgctggcggccagcaaggtcgcggtttgcttgccttgcgcgacctgcgccactttcgcgctgctgttgaaggggatgaacacgttgacgtcgtcatcgcccggctcgatatgcgaggcgcgtgcctgatcggtgtcgagggccgcctgcaaaccggccacggcaccgcttttgcccttgcctgacatcgatccggaataatccaccacccacaaggtgtaagcgggcttgcgcaggacggtctgatactggtcgagcgcctgttcgatgatgtcggaggatggcatggtgatggttttcagcaccgatgaatccgatttgacgccccattccttacggaacgaatccttcaccttcgcatctttggcatacgccagcgtgccgtccgaaccggttctacgacccgcctgttcgaacagtttcttggaatccttcgacgtgatcgacttgctgaatcgcttgaacgcatcctctttgtcctgcctgcgatccacgtaagcaagcggcgaatcggaaatcgcgatgccgtcggacggatagacggccagcagcggctccttgttcttcgccgtcaacgccttgtccgcctggatgacgagcgattcgtagttcaccatggaatcgttcgtatccgggtcgttgacgaccatgtccttcagccagtcggacgagccggatgaacgattgacgcccgacagtacggttttcacggacttacgtaatgaagcatcgttcaaatcgtctttggtgagtgccgacttaccgccgttcagcgccgtcagaaacgccatgtacgccgacgctccggaattcgattgcgtggcggacgtcatagcgaacgacagcttcttggccttcaccgcatccataatgtctttcgtggacaccggcttcgttgtaccgtccgtattcgcccagccgagttcctcagccttgctttgcttcacgccgaacaccaccggcgtggtggacgtggagacctggtccttgacgacgtgcttgatatcccccatggtgatccacatgctgctggccggccagaccgcatcgtaatccctgcccgcgtgatggcctttgttgcgcagcgcgtccataacgtccaacgaccccatgtagtcgacggtcactgacactttcgattgtttggccgcctgttcgatggccccgctcacttccttgttttcggagccggaggcgatgcggatggaatctttggcaccgtccacggaatatgtcgcggttgtgccgctgttcgaatcgccgtccgacgtcgcattggaagcgctgttcgtcgaaccgcatcccgtgaacagacctacgatcaaagcgatgcccccagccgccgcaccaagtttgcgtgcgttcatcttgtgttggccctccgttcatattgcgccaaaaaccgttcagcgcacccggaaaacatttccgaatgcgctgaaaacatgttctgttatgtgcgattgattatagtccgattttaccgaacggccattttgccgtctcattttcgtcattattttcgtttccccctcattccgccctttccgctctcttccacagacgtagccgacgccgcctatacttggtgcggctacttgttgcggcacaatcgcaactatgcaatcacaggcatcgcaacggaaaggtgggcgcatgggcagcttcaatcgcaggcaggaagccgacgatctcaccgactacgtcaataacggatggctcagttccgccgaattcgacgggccgactttcctgtggaatcatctcatccgcgaagcaagccaggaggatgccgcgcaacgcaacgatgtgccggtcgccaatctttccgacgcggacgtggtcatcaacatgcccatgcaatggtatttcgacgccctcgcctccatggtgcccaccgcggaacgtaccgatacgggcgtggagattccgcgcatcgatatgccgacgttttcgatcgattcgcaggcgctgtccggcgtggacgcggtggtcggcaacgcggtgatcagcacgcgatggcttgacgcggtcggcaatctcgccaaagctgtggagatgaccgcacgattcgtcggcaatgtagccgaccgcgacaacgagggtttcgactatctgaaggatctgattcagaccgtacgcgtgtacatggatgccgtggcctgcaacgccgatccgatgacgggcgagcaggcgttgcgcatgatcacgcaggtggcgtgcaatgaggatttccggctcaacgccatgcagatggtggagctgctgtcttgcggactgtcgttcgcgcaatgggatgatacgcgcatgttcgcctatgacgcgttgaacaagggcattgccgcgatgcgtgatttcgcagcgaagtccggtaatggcgatgcaagcagcacgactggcgacactatgaacagcgtcggcagtatcgacagtgatgttacgggcgatacgggtgcacgcgacgccaccgcaacgcaatcgcataaccttcgtgatacgtcctctgacgcggacagtgcgcatagcacgaatagtacagacgctgcggacggcgcggataccgcgaactcgatcacgcattccacgggcgctgccggcgattccactaccggcggttcgcccaccctctcccccgaggaactgaacgatctcgccatgcttgacccatcattcctgtccaaacagcagcttgcgcagaccgcgcaaaaccagttcgaccatgccgtgcagttcctgcggcacgatctgatgcggatcagtggcgatgccgaggaggccgatcgtttcctgcgcgacaaccatacgtccgagccgcttgccgacgcgtacgcggcgcggctgatcgctgccgaacggtggcaggatctgctgaatttcgtcgatctggtggagcgtgacgcaccgaaccagtgcacggtcatgttccccgaggaagtggtgccgtacgaatgggagtcgattcgtgaggccgctttggaggcgttgggccgcggcggagaactggtcgcgatgtatcaggagcggttggatgacacgtacgatcccaacaccgagctcaatcgtatgaagcttcaggcgtggactcaagccaaggaataggcggcgcgcggctcagcacatccgccgccagttcctcatctatcgcagacttccactcttattcccatcagtatttccaccatcgcttccacaactgacgcgcaacgtggccaattggaacggatgcaggctcagcatcgctccttgcgccgttcttgccacggacggatcaccgtcggcaaaagccgcgggcaattcggcatccagccgcgcatcctccataatggaacactcgcgtaccgtggccttccccaaagcggcgttgacggcaagtctcgcatgggcttcgccgccgaccgcctcatagacgcgcagtatcagatcaccggaaccgtcatcggcaagcttgacccagtcaagcaccatgacgccatccaccgggttgagctgcgccagcggatcgaacgccggcacggcaggcagcacggccgcgttgagacggttcgcctcgtcaagcacagccggcatactggcatccgccacaacgttccacgcgaactcatgcacgcccttgtcagtgttcggatcggggtatagcggggacgacagcaacgaaagtcgaatcatcgtgccacgcaccggcccggaagccgtgttccggtgaatcggcgaaacgtcggaaccgtaggtgctggcgttgacgaccgcagccgcatagccggcatcggcgacgcgtacgaaccggtgcgtgcagctttcgtatttcgcctcgtcggaacgtgtgttcttctgaatgggccgttccaccatgccgtactggcattcgtactgcgcccggtcggcctggatagccatgggaatgtcgactttgaggaatcgttcggatgcccgccaatccactttggtccggaattcaaggcttttcgactttggccgcaatgtaatgcaggcatcgatggacaccccgtcggcggtgctggacacgtgcacggtggctccgccgcgttttgtctccgtcactcgttccacatgcgagtcatcgatgccttcggcgctgaggaaggcatcgcgctggatgtcccatgcgtcccactcgtatggctcgtcgcggagaagctcgtaatgcccgattccactgccgtcgggcaccagttcgtgtccattatcaaggtcgatcagtgaacggaccgtaccgtctggtgcgatgatggcacgtagcaaaccgttgtcaagtatgattcgaccgtcgtcgcatgtcgttgcgatggtggattcatcggcgaccgcgtcggtgccgttcgcgtcatcatcctgcgttctcactgccgcggtgcgagcaatccacgaatcgccattctttgccgtatatgggacgatggccgcgttcgatcgcatgtcggcatcatcccgcgccgatgcgatggaagcacccgcttcagcggcgatatcacgcagtcttgcgatgtcgcgcacgtagtccgcacgcgcctgccgatgcacccatgcgatcgccgatccgggaagaatgtcgtggaattggttcagcaggagcgttttccagataccgtcaagttcctcacgtggatatcggtattctgggttgaacacgctggctgcggcgcacagatattccgttgttctcagcaggttttcttcccgcctgcatccgcgtttcatttcctgttgcgatgtcagtgtggcgcgatgcagttccagatacagttcacccttgaaaaccggggtttcgtccggagcctcatcgacgatatcgtgtcggacgcggtcgaacagttcgtccggagtgccgaaatcgatgctcggagcgccggcaagatcatggtccctgcggatacgtgcgaccatttcgcgggtgggaccgccgccgccatcgctgtatccgtacagcagtatggcgttgcgcgacaggtccttgtcaaggaagttgcgctgggaatactgcagttcctgcatgcttacggtcgagccgtacgtgtccgacggcgggaagtgcgtaaggattcgcgatccgtcgatgccttcccattcgaaggaatggtgggggaatttcgtggtgtcgttccatgagatcttctgtgtgaggaaccattcgaaaccggcacgacatgcgatttgcggccatgccccgcaataaccgaaactgtcgggaagccacagtccttttggttccacgccaagatgctcacggaagtaacgcatgccgaacgtgatctggcggatcagcgactcacctgtgggcagcatgttatcggattcgacccacattccgccgacgggaatgaatcgtccttccttgatgcgctgcagcatgcgcgcgaacaggtctggatgttcctgttccagccacgcatactgttgggcggaactcatcgcgtacgtgaaatccggatcctcgtccatcagggcaagcacgttggacaccgtgcgggccactttacggtgggtttcgcgcacgggccacagccatgcggaatcgatatgcgcatgggcgaccgcgacatgatggatgacgctggaatatgcgggttcggataataccccggcaagcttttccttggctggctccagagttccggcgatatcacgctcgtcatatgtgttgagtgatcgttgcagcgctttggccagctgccaatatcgaggatcatcatccttgagttccctcatcagcgaggtgacggtttccaagtccatcagatagtcgaacacgttttggttgaaagcgcacacgtccattgtggtgagcacatagtcggatggacgaccgtcggcacgctcccccagattcatcggcgcgaatggcaggtcagcttcgaccagtggattcgatgcggcctcgacatataccgtgaaacgaccggcatcgtcaagctccacattcgccacgccattggcatcgataagcggaatccagcaattgtctggattcaccgctttgatgacgctgccgtcaggtcgatagcataatccttccgcttggaagcccgggccacgatgtcgtttccatcccagatctacaaccagttcgacggctctgcctttgaccgactcacggtcgatacgtccacgaacctcgaaccatgtggtaccccatatcgtgccccaggcaccaggaaccatgaagtcgagaaaatccactttgttttccctgacacgggcaagaaagtcggcgctctgttcgggttcgccttcattggcgaaagcgcgtaactgacaatgcgataatgtttcgtgcacatatggcacaagtcgttgccgcatcactcgatcggcacgtctgagttgctgatctggaagaagaaacatagctatccccttggcacatgattcctatggtgtatccatggtgccacaacacaatctcaaatcaaaaaaacatcaacgagaaaagtggttctcaaagcggacatccggtggagactccggataaggaccttcgacgagcccgaaaggcgttgccgggaggcccgggaggtgatgaaaaaatggggttcccggagcatatccggtgggaattccagggaacataaaaaaaggggcctcccgggagccaaaggctcgaccgggaggcccaacatgtgaagcggcggcgtgctactctcccacaccctctcgagtgcagtaccatcgccgcatcatcgtcccatggacgggcacgaccctaagtgcgcaaaccttcgggcactacctggtggtgatgatcggatatggagaggataatgacctgcatcctttggataagcgccatgtcgcgcagcgcttggcaacggctgccgagtcgttggtttatggacgtgatcgcgagccgatggggccgcttcctgtcatggcgattcacaaggatgacggcattgagatctccttcatccatacgggagggggattggtctgcacaggcgacgtgccttttgacatcttggagccgggaggctcgatatatcgggtgaaggctcgtcggtacgattgctatggcggtaacggaaccgggcgtgcgagtggcgcagtgagagagctctccccagtacagtgtcagtttgtcagccaatgaagcatcgatgataacgctattgccgggggcagcgtaaatagttttcgcagttaatcgtgtttgggcggaagtctgtgatttcctgcgtttggaatacttaaatctattcgagagtttcgtaaatatttgcatatagaactttcgcaacaacaattttaagtatttagttaagcgatttgactttcttgaaagttaaaccatataatcaaacagtgctttgactgaaatgctaaagcatttacgaaacatgaagatgtgtgttcgtgcatgtcgccaaaggagaaagacttctgtattcccacatccgatattgaataaggagatgcagcaatgaagtttgaataccatgtcaaaccaaccggcaacgatgctgcgtgcggcgacgcggagcatccgttcgccacgatttccaaggccgcgcagatggcctctccgggggacacggtaatcgtgcatgaaggcgtataccgcgaacaagtcgatccgaaacgcggcggtctgagtgaacatgagcgcatcacctactgcggagccgaaggcgaagcacggccggttatcaaaggctcggaatgcgtgcagggctggacggaattggccgatcacccgcatgtgtggacggtgatgcttgataatacgatgttcggggatttcaatccattcgcgaccccgattttcggtgactggctggaaatgcccaagttcggcaaggatccggacaaacatcttggcgatgtgtatctcaacggtgtttccttcttcgaatcgacgacgttggaaggcgtatacgatccgcaaccgcgtgatacggatgaggatttcgcgttgaagattccctgccctgtgccggatgtggaccgtacacgttatgtatggcatgccgaagtggacgagaatgccggcaccacaacgatctgggcgaatttccaaggtgccgatccgaatgaggaactggtggaggtcagtgttcgtcgcacatgcttcttcccctcccgcaaccatgtcaactacatcaccgtgcgtggctttgaaatggcgcaggccactggagattgggcgccgcctacctcgcagcagtggggcatgatcggcccgaactggtcgtatggctggatcatcgaagacaacgtgctgcatgacgccaaattctccgcggtgtcattgggcaaggaaatctcatccggcgacaacgagtggacgaaaaccgagcgcaagaccggttaccagtaccagttggaggccgtgttcaaggcccgtcgcatcggctgggaaaaggggctgatcggcggtcatatcgtacgcaacaacgacatctacgagtgtggacagaatgccatcgtcggacatatgggcagcgcattctgccgtatcgagcataaccatgtccatcacattgcgttgaagcgtgaattcttcggatgggaagtcgctggcatcaaattccatgccgcattggatacggtcattgccaacaacaacatccacgactgctcgctgggcatgtggatggattggcagacgcagggcacacgcatcacgcgcaatgtgttccacgataacgtccgtgacctcatgattgaagtgagtcatgggccgtatctggtggacaataacgttttcgcctcgccggtgatgttccagaactggtcgcaaggtggtgccttcgtcaacaatctgatttgtggcggcattgaaccgcataccgtccccgaccgttccacgccgtatcactatccgcacaccaccgaggtggccgggtgcgctgtggtatccggcggcgatgagcgttggctgaacaacatgttcgcgccgcaaccggtgaaaccgactgtcggtgaatatggtttgtccgcctacagcgattgcccgatgtcgatgcatgaatacttggaacgccagcgggccatgtgggcagatccttcgcagggtggtggcgagcgcaatcctctgcagtctctatatgcgggcggcaacatctatctgtccggcgcacaggggctgaacaagcaggaaggtgcggccgacgattcggagcgcatgcaggaggacgccccgttcttcggcggcaccgtctccacgagcgttgcgtgtgatgagcccatgccggtgacattggtcgaagaacccgatggactgtatctgcagtgcactgtgccacaggccgtcgccgataccaggatgcaggtcgtcaccagcgatatgctcggcgtgcctcgcatcgtggaggaacgctatgaacagcccgatggcagtgactatgtgctagacaccgacttgctgggacaagccttgaccgcaacggaacgcaaagccggggcgttgaatggtcttgtctccggagagaatcgcatccgaatctgggaatggaacaactgatatgacaaatgcaaccgataccagcaagacattgggcgagtccatgttcgcacagtgcggatatgcccaggacgccatcgataggcgcgtgtcacaggtctggtatgaaattttcgaaggtccgaacaaattctattgggagaacgacgaaggccttgcctatgtgatggacaccggcaacaacgatgtacgtaccgagggtatgagctatgcgatgatgatcgccctgcaatacgaccgtaaggacgtattcgacaagctgtggggctgggtaatgcgtcacatgtacatgaaggacggtcatcatgcgcattatttcgcatggtcggtcgcgccggacggtacgccgaactcgaatggtcctgcacctgacggcgaggaatatttcgcgatggacctgttcctcgcctcccgtcgctggggtgatggcgaggatatctacgaatattccgcatggggacgcgagatcttgagatattgcgttcataagggcgaacgctacgacggcgagcccatgtggaatcccgacaacaagctcatcaagttcattccggaaaccgagtggagcgatccgtcctaccatctgccgcacttctatgaagtattcgccgaagaagccgacgaagaagaccgtccattttggcatgaggcagccgccgcaagccgtcgctatctgcaggcggcctgcgacgagcggaccggcatgaacgctgaatacgcggattatgacggaaagccgcatgttgacgagtccaatcattggcatttctattccgacgcctaccgtaccgcggcgaatatcggactggatgtagcttggaacggtctgcaggaagtgctgtgcgaccgcgtcgccgcgctgcagcgattcttcctgacccacgaccgtactagcgtctacgccatcgacggcaccgccgtggacgaggtcgtgcttcatccggtcggattcctggccgcgaccgcgcaaggctcacttgcggcggtgcattcggcccagcccgacgcggagcataatgcccgtgaatgggtgcgcatgctgtggaatacgccgatgcgaaccggcacgcgtcgttactatgacaatttcctctatgctttcgccatgctggcgttgagcggaaagtatcggtatgaatgatgattacctcaactaatcctacggtctacacggattttcctgatccagacatcatccgggtcggggacgtgtattacatggccactacgactatgcatttcacacccgggtgcgatattctgcgcagctatgacctagtgcattgggaattcattgcgcacgcattgaatatcgtggcggatacccctgaagaacgtttggaatgtgaaggtgccaacgcctacggtcgaggcatgtgggcgccgtcactgcgttaccatcggggcacctggtatgtgttgttcgccgccaacgatacgcatgccagctatctgctgacggcggacgatccatgcggcccatggcgaaagcgtgagcttgacggcttctatcacgacagcggactgttctttgacgacgatgatcgagcctatgtcgtatatgggcagtcgacattgcgcatcacggagttgaatcctgaattaagcgggccgatgccgggtggactcgaccgggtcatcgtgcaggacgatccgcaggctgaccttggttatgagggcagtcacctatacaagcatgatggacgctattacgtcttcacctgtcacttcccgcaaggcaagggcaaaacagaagcctgcttgatggccgaatccttggatggcgctttcgaagcgcgtgaaattatcgacgacgacctgtccttccacggttacggagtcgcgcaaggcggtatggtggacactccggacggcgactggtatgcattcatgatgcaggaccgcggcggtgtgggacgcgtgccgacactgatgccgatgcggttcggcgaggacggattccccgtcgtcggcgagaacggcaaagtgccgcagtcggtcagcgtgccggctgcaagctgtgccgaacctgtcacgcccatcaacggcagcgaattcatagcccggcataacgctgaaggcggagtcgatgccaactgtctgcagccatactggcagttcaatcacatcacacatgacgaatactggtcactgacggaacgtccgggagcattccgcctgcattccggacgcatcagctcgaatctcaatcatgcatggaacacgctgacgcagcgcacgatggggccggtgacggtggccgaagtcaccgtcgacgcgtcgacattgcatgatggcgacttcgccggattggcggcgttccaaggatgctattcctacatcgcgcttacgcgaaggaacggccgcacgatgctgaccgtccaatacaagccggcgaatgacgattccatcttcttcgacaatgattgggacagtccagccgtaacggatgcggaaatcatggcggatgcggattgcatgcgcctgcgcgcggtatatgatttcaccgattgcaaggatgaagtgacgttcttctaccgcgatgcggatacgccggaatccgaatggcgtccattggggacagcgcaccggatggtcttcaaaatggatcatttcacaggttgccgtatcggattgttcctgtattcgacaaaagagaccggtggaatcgccgatttttacgactttgcgtattcgacgccgaatacgaaggaaagagagcaatgaagcgacaggtcatagtggcgcaaggaactgtcgaaggcttggcggctgaagatcagggcatcaccgtgttccgaggggtcccgttcgcccagcctcccgtcggcggtctgcgctggcgtgcgccgcagccggccttgccgtgggatggtgtgctgcaagccttcgatttcgggcctaccgcgatgcagccgacgccgggcgcctccgatgatttctatgatcgtgaatggggcactgatccggccgtgccgatgagcgaggattgcctctacctgaatatttggactccggcattacgcggatatggcgcggatagcatggtagcctccgaaaagctgccggtcatggtctggatctacggcggagcctatcaatgtggcggcacgtttgaaaaggaattcgacggcacacatctcgccgcgaacggcgtcgttgtggtcagtgtggcctatcgtctgaatgcatttgggtttatgacgcaccctttgcttcatgaggaggccgtagaacgcggcgacggcgaaccatatgcgaatttcggattcctggatcagcgtgccggaatccaatgggtgaaggaaaacatcgcgaagttcggcggagatccggaaaacatcacggttttcggccaatcggccggtgccgccagcgtcttggcccatatctgttcgccgatgaatcatggcctgtttcagaaagccatcatgcaatccggcgcaggcctagggcatttcaatgcgcggcaggacacgctggagcatgcgcaggccaacggaatccgtctgttcgaagcattgggtgtctccacgctggagcaggcccgtgcaatcccggcccgaacggtattggaagccgccgagtccctgcctgttccaccggacagcggacgtgaagatgactggtcgatgatcgtcaattgggcgccatgcgtggacggcctgttccttcccgatcaggaggagcgtatcgtcgagggctgcaaggccaacaacgtcgacatgctggtcggcaacacgaccaatgagttcatcgcttcgactgaagatgggaagcctgtgcatgtcggccagctcggcaatctcacgctgatccgcaaatggaccgcaagcggtgggaccgcgccatactactatcatttcgatgtcgctatgccgggggatgatgccggagccttccactcatccgatctgtggttctcctttggaagccttgcgaaatgctggcgtccgttcgttggatggcattacgatctggcaaggcgaatggggctgtactggaccaattttgccgccaatggcgatcccaacggaacggaccgtgacggaacgccgcttcctgtatgggatccttgcatcggtgaggaatgccccgccatgcatttgtgccaagaaccgggcatgcggacggattggcttaccgaaacggatcgaaaagcattcggcatgtgacggcatgccgttgatgtatacatactgatatgtaaacagggacggtctttgcggatcgtccctgccgcataatgatttgccgttgcgcgtgcaggaggatttcgagactgattatccgacttttcaccgtttctgtcgtctggttcgtcggtggcgtctcgcggaggctcgggccattaaagaccctgttcggcgttgtgcaggctaggagctgtttgaagtgttctaggccggacgtttcgccgtataggggcgtgtctgcgtggattccgtcggatgtggcgtctcaattgttggacgttgcggtgagcgtgaacgggggtgattatgaggaagactgaacccccgctcatgaccattgccgacacgatggcctatttgcagtgcagtcgtcggctgtcttgttgggtacccaactcgggtaccttgctgggtaccggaaatgttggcattggcgtacatttccgtacattctctgtttgcgccgtatgttttgaaatcgttggtattccgccgttttggcatgaaaaaagggcttccggatttctccgaaaaccctcaaggcggagtcagagggattcgaaccctcgagccgctaaacacgactaacaccttagcagggtgcccctatcggccactcaggcatgactccactgttgcgttacgacgcaacagcatgtaactatagcatctatccgcgtgcgaaacaccatattgtgaaaaaatgagagaaaaacgtgtggtgatgtcagtgggactcgaactcgtgagccgtgtcgagcggtctcattgatatgcgacacgccggtatgcccgcaggtttcgccatattcgaacatttgttccaaaactgccgaatcgttgtctatcatggaatcatgagcacagcaccaagaatcgcagcggccaaacgtgactggggtcacgatgaggtcggatgcacggtgctgcatatcgacatggacgcttttttcgcatccctcgaagtggcgcggcatccggaatacgccgacaaaccggtaatcatcggcatcggcaaccgttccgtggtgtccgcggcgaactatgaggcacgcaaatacggcatcaattcggcgatggcaagctcccgggcaagaaaactatgcccgaacggcgtctttctgccggtggacatccactactaccgtgagatgtcccgacgtatcttcacagaggtgttctcccgcgtcaccgatcgcatcgaacaggtttccgtggatgaatgctatatggacgtctccggcgcgctgctgcggtggaagagtccccgcgccatcggagcttggatacgcgatcaggtcgccagacggtaccacatcacctgttccgtcggcatcgcggcgaacaagcttgtcgccaaaatggcttcgaccaatgccaaaccggatggcatgctcatgatccccgtggccagacatgccgaattcgtacagatgatgccgttgcgtggcatacctggcatcggtccgtccttggagaaacgactgaacgcatggggcgttgattccgtggctgacttggcgaagatgagcatggaatcgcttgagcaggcgacggggtcagccatcagcgcgcgcgggttgtacatggcggcacgcggattggatgaccgccctgtcgcaccgcgtgcgcaggagaaatccgtcggcgcggaacgcacgttcgacaaggacacccaagacatgcggcaggtgacatccatgctccgctggtgttgcgatgatgtggccggcacgctgcgcagacgagggttgatggcgcgtaaggtcatggtgaagctgcgattcccggatttgagctatgcgacgaaaggacatacgctggactgtccgacggatgcggcaagcatgctgtatccgcaatgtgtcgcattattgctggccatgatgggcatgccggaaagctctatcgacgccatttcgttgaccagaccggtgcgacttgccggcatgagcgcgggcggtttggtcgaagcggcggatgcggcggttcagctttcgcttgatgacatgcttgaagagcagaacgaggcgcagcggggtcgtgggacggatgccgaaccgtcgacccaatcggaacggctacgcggtgcggaagcggcattagacgcggtacggctcaaatacggtaaaggaagcgtgcgtcttggcatatggcgtacggggccatcaggtaatcttgaacattgagagtgatgtgggacatgagaagaaacagggggagtgccatgagatacagggacaaggcggtgcatgcccgcaacccggaagtgctggttgcagggcgtcgcaggctggccatcgtcgcagccgtcgtgcttgttgtattgctggcggtaggtgggtggttcctgacgcggtgcttgcgttcatcacagtcccaagccgggcagggggccacaacgcagatgaacgtggccaagcagaaaaagcatgtggtgaaaaaggccgagccaaaggaacatcacggcaattcgccggactgtccggataccgattgcatcgccatgatggtcaatggcgatctgctgttccaccctggtctgtgggacaacttcgccggtcccaataccgcggcgacggacggtacggcctatgacttcaccagtctgttcgaaccgatgcgcaagtacatcgatgcctccgatatcgcggtgtgcgaattcgaaacgccgatcgcgcctcgcggtggcccctacaccgggtatccggtgttcaacattccctcggaggtcgccgacgcggccgccaaggtggggtatcgcgcatgcacgcatgcgtcgaaccattcgtgggatcaaggcgtggatggcatcacacgcctgtgggataccctcgaccaggacggcatcgcacagacgggctcctacaagaccgaggaagactctaccaaaccgctggtcatcgattccccgaccggtggcggcaaactgggcctgatcgccggtaccgtgtccctgaacgcgcaaacccccgattatgattggcgcgtcgaccgtctgcgcgagagcggcgatccgaaccatcaggccgacatcgacaaagccgtggccaaagccaaagaggcccgtaaacaaggcgccgacgtggtggccatcgccatgcattccgtgcaggaatatcttgactacgccgactcgtggcagcagtccgaagcgcatgagctggccgacaccggtgcgttcgacgtcatctacggtgccggatgccactgcgcgcagcccgttgagaactacaacggcacatggatcatctacggtctgggcaacgcggtgacggtcacgtcctacattccaggcaacgaggtcaacaaccaaggcgtgacggcccgcgtccaattcgccggcaagaaaggcgtggccggctcatggcgggtcaatcgcatcgattgggtgccgacggccaatgtgcgtcaaggccaataccagtggtgtccgatttcggacgaccatccggatggagcctgttggaacgaaacagaagatgccaatcagagacaacgtatctggaacgtgatctattccatgggcgcggaccagaacgtggttcgcgaatggaacatcaccgcagagcaagctggttcatctggaaagtagtttcccgtggcagaatatgcctcgtattcgttaatcgacctgtatggagcgtttccgctcgtgatgtgaggtgaaagaaatggatggagttttcgagacccagccggaccgcaccgacttgccgctggtggtcatgccggtggtcatcgaatcgatgatcggaccgttcaaacagaacttcacgatgctcgaaaacgtggcccgcgtgcgcatgtacgaggatttcacactggacgaggacaccatcgtggaacgctgcaaggatgccgacgccgtcatggtcatcggattccactgcgccgatgccatcctcgacaggctcgacgccaagtgctatgcgttcggaggcaccggcgtcgccagctacatcaatcttgagaaaaccaaggaacgcggcatccgcgtctgcaacgtgctgcattacggcgatcacgccgtcgccgagcacgccatggcgttgctcatggaactgaccaggcacgccggagcgcttgatatgcaggtcaagcaaggcgattgggacggtgccgacggtttcgaactgttcggcaagaagctcggcatcatcggactcggcggcatcgggcagaccgtggccggcatcgccaacgctttcggcatgaaagtatccgcgtggaactcccacgtgccggcacaggtgttcgagaacctgaatgtcactccggtggaagacatgaacgagttgatctcgaattcagacgtggtcagcgtgcatatgccgttgcttgactccacccgtggcatcatcacggcgaagaacctcgacgcgttgcgtccgggaaccctgttcgtcaacaccgcccgcgccgaagtcatcgaacccggcgcactgctcgcaagacttcaacgcggagacattccggcggccttggacgtgttcgatcatgagccgcttgccgccgacgatcctttgtgcaagattcccggcatcgtgctcaccccgcacatcgcatggcgcaccgacggcgcgtatatcggcatgaccaagcaggtggtccaatccatcgccgccttcttcaagggggaggaattcaacgtcgtcgtctgaaaaaataaccgggaagcagcatatgcgcgcggtcggtgaggttaggtaggttgaacagcatgcagaccatactcgattccgccgatcggccggcgcacgacgccttcgtcgaaaagaaatcggaattcatcggagacgcctgtcatatcagctcgttggatgaggcgctcgctttcgttcagacgatccgtgaccagcatccgaaagcccggcatgtcgcctatgccgcggtgtgtggtggatccgatggacgtcttgcggaacgcatgagcgatgatggcgagccgtccggaaccgccggcaagcccattctcgacgtgctgcgggcaaacgaaatgactgattgcgtggtcgcggtcacacggtattttggcggtatcctgcttggttccggcggcctgatccgtgcgtattccacaggtgcgtcaattgcggtcaaggctgcttccaaggcgaaaatcgtaccgtgcggcgaatatcaggtaactcttgattatccgcagttgggcagcttccagaatctgttgtcaacggtggaaggcgagcagaccgacgcgcagtacactgaccgcatcgccttgactgtggtggttccgcaggaacaggcgaatgccttcgaatcccgagttgtggaaactttcaacgccacggtcgttccgcaactggtgggcacgtccaaccgtccggtcaaagtatgagttcacgttgtgagccgcatgcatatagtgtcgtaaggtgaaaatatgagtgatgagaacgagcagcatgagaatgattcgcaggccgacgcctcgaacgccgatgagaccgtggatttcgagccgttgaccgccacatacgagcggctccggcattccactgattccaccgcattaagcgagttcgccagacgtccgctgccggaccggagcgaccaggcggcgttctcccgtgccaccgcattgcttgaggctgtggctggcaacgcgcatacgccggtggaggaccgcgtcttccttgccgaaaccatgccgttcccgaacattctggtcaagctttccaccgacgagtctcctgacgtacgcaaagccgttgcgggaaacgccgatgacaagaactggctggtgggccgactgaccaaggatgagtcgcccgaagtgcgtgccaccgcgctgcgcaacaaacgtacgtcttggaaaatgcgtcttgaaggcgccgaagattccaccatggattccgacacgcttgatttcctgggctcgttgggaacgcaggtcgaaccggacgctccggtggtgcttgcgaccatggtgcgcagggccgtcgccttgaatccgaatgtttccgatcggatgctccagcagttggcgcaggacgcttcaagcgacgtgcagaaggccgctcaacggcagcttgcggaaaaataattgcatacgttgtcatttttatgagattcctgcgcgtggtgcgcatgttttggtcctagactgggaaccatgacagaacagaccgaaaacgcaacgcgtctcgcccgtccgctcattcgtctggcaaagctggtgggtgtcgccaccagctacgtcggtatgagccatgattaccacgaaatcgaagacgatgttctagtggcggtgctcaaggcgcttggtattgacgcttccaacgatgaggcgatcaaccagtccatcacatccatcaagtccgaacgcgaaactcgcgtggtggctcccaccgtgctgcatatcgtgggcaaggaaagcaaggtggaggtgcacggcggcatgttcgatgtgccggaagcctccatcacgctggaaaacggcaagcaattcacgggcaaaatctcccatgagggcggtgagaaaatcgcccatgagatcaatggcagcttcttcttcatgtcgtatctcgtcctgcccgccgatctgcccgaaggctatcacaccctcgaggtcactgtcggcagcgagacggagactgcaaccgttatcagcgctcctgagaaaatcgaactgctcgatgatatgaagaacggctccctgtgggggtggatgagccagctgtactccatccgttccaagggatcctggggcgtgggagacttcgaagatctgaagaccatgctggtcgaggctaaaaagaagaccggctccgacttcatgcttatcaacccgatgcacgccgcggagccggtgcctccgctgacgccatcgccgtatctgccgatttcccgccgtttcatcaatttcagctacatccgtccggagtccatgccggaatatctcacgctgtcccacgaggacagggccgaggtcgatgcgctgcacgagcaggtcgaatcgctgaatgacgacgcgcggctgatcgatcgtgacgccatgtggcgcgtcaagaagcatgcgctgtgggtcatctacaaggccggccgaaccaaggctcgccaggccgaattcgaccgttacctcgccgaatgcggagacgagatcgaatcctacgccacctggtgcctgtgctacgacaagtggggcgctccctccgacgacgccgataattgggtgcgcaaatacaaccgtgattccgaagaagtcgcgcagttgcgtgagaagttcccggacacccttgagttctaccgctggcttgagtgggtcgccaccgatcagttgcacgcggcgcagcaggccgcccgcaaggccggtatgaagatcggcatcgtcgcggatatggccgtcggcgtgcatccggcaggatccgatgtgtggtggaatccggaacgcttcgccaagggcgccacggtcggcgctccgccggacatgttcaaccagcagggtcaggactggagccaaccgccgcttaatccgattgcccttgaacagaccggtttccgggtgtaccgcgatatggtgcatgacatgttcgccaatgccggtgcggtgcgtatcgatcatatccttggtctgttccgcctatggtggattccggaaggcaagcccgccactgatggcacatatgtgcattacgattccgatgtcatgctcggcattctcgcgcttgaggcttcccgtgctggtggcgtggttgttggcgaggatctgggtgtcgtgccggcctatgtgtccaagtcgctgtccgaacatggcattctcggttgtgccgtggaatggttcgaacagatggacggtgtgttccgcactccgaaggattggcgtccgtacgcactggcgtccgtcaatacgcatgacatgcctcctgcggccggttacctcgaatacggccacgtcaagctgcgtgaacagctcggcctgctgtccggaccggtggaggaattccagaagtccgcaaccgccgagcacaatgccatgctgaacatgctggtcgaggagggctatctcgacaaggctgctctggatgacgaagccgccaacgaaaacgagattatcgacgcgctgtaccgtggtctgaaaggttcgccctgcaagctcatggccgcctccatcgtcgacgcggtcggtgagaagcgcacgcagaaccagccgggcaccaataacgagtatccgaattggcgtattccgctggccgatggcgaaggcaacgtggtgccgctcgaaaagctcttcgacgaaccgcgtctgcaggagatcaccgccatcatgcgtggctgatcttctataggcgattccatggggtgtccacaggtccgacggtctgcggacacccttgtttttcgtgttgccgaatgtcaaggcaggcgatatactagtagactgttgtgtttccctacggggtccttcaaagcgcttttcccactcgccatcgaggactttcagggagcccacggataatgagacctgaaaaacggcattattccgcgcccaaccaacgcgtgtaatgctgatggatggtccggaacacaatatatagaaaaggtacatcgtgaaaactttcactccgaagccagctgatctgactcacgactggtacgtcatcgacgccaccgacgtggtgctcggtcgtctcgccactcaggcggcaaccctgctgcgtggcaagaacaagccgacctacgctccgcacgccgattccggcaaccacgtgatcatcctcaacgccgacaagatcgctctgaccggcaacaagttgggcaaggaactgtacatgcactccggtcgtccgggtggcctgcgtcgcgatagctacgcccagctgctcaagaccaaccccgagcgcatcatcaagtctgccatcaagggcatgctgccgaagaaccgtctggccaaggttcagctggatcgtctccacatcgttcgcggtgccgagcatccgtacgctggcatgaagccgcaggttttcgagatcgctcaggtctcgcagcaggctaagtgaaccgaagggagataagaaacatggctgaaaacaccaacgactccgcggttctcgagaccgaagaggagctcacctcgtacaccaccgagaccaacgctggcgctggcaccggtacttccaccatcgctccgggctacggcaccggtcgtcgtaaggaagccgtcgcccgtgttcgcctggttccgggcaccggcaagtggaccatcaatggtcgcaccctggaagagtacttcccggccaagctgctgcagcgtgaggtcaactccccgatcgttctgctcaagctcgaaggcaagttcgacgctatcgtcctcgttgacggtggcggcaccaccggccaggctggcgcaatccgcctgggcgttgcccgcgctctgaacgccatcgatcgtgatgcgaaccgcgccgccctgaagaaggctggcttcctgacccgcgacgcccgcgtcgtggaacgcaagaaggccggtctgcacaaggcacgtcgcgctccgcagttctcgaagcgctaaagcttacagcaagctttattcgaaacccctcggaaacctatggtctccgaggggtttcctcgttattgtgggcaagcgttagatgcgttggacgcaatgggctcgttagatgtgttggacgtatctggcagacgttgcagatgaagcatccgcatctccctcattcgcggcccacccgttaccggacgtttcggatgggccgtttgcgtattgatgtatgcgccgattcgttgcgccgtccgctgcgcgtcaatccgtcgaaatctgcttcatcgcgctgatgctcagagccggcagcgtccacagggtcggatcgtcctcggacaacccgtcgtcagcggagttcagactggcggcattctcatccatctgccaatacatggtattgagacgctgcagatggttgcggaatcgcccggcaggtttgtcctccgcttcctcatcgaactcggccagcttctcgatctgcgtgccctgtccgggatattcgccggcgatttccgccgaggaccagatcatttcccattcgatgtcgttgggcagatggaatctgacgttctcgtcggacccattgaccagaatgagcaggcttggctcgtcgggggagagcagctgcatggcgaacgatcggaccgagggattcgtccaatccgcatcatgcggcgtctttccgttcggcaggaaccagtgcacgcggtcggatttcttcaacagtccgattttgctcagtcgggtgaagaaatcctcatggttgtagaggtcccgggcctttctcagcgctatcagccgggaagtgaggttgaacagcttgagctccacggtctgctcggtgctgtacagccaatcccaatccagccatgtggtctcattgtcctgcgtgtaggcgttgttgttgccgttctgcgagttgccgaattcgtcgccggcaagcagcatcggcgtgcccagggagagcagcagcgtgcccagcatgttcatgatggcccgttctcgttgctgtgtgatgatcggatcactgcacgggccttcatgtccgaaattgacggaatggttgttgtcgctgccgtcccggttgttctctccgttggcttcgttgtgcttatgccgatactgggtcagatcggcggtggtgaagccgtcgtggcatgccacgtagttcacggatgcggtcgatccgcgtccggggtcggtggcgaacagatcggctgagccgcataggcgcgtggccatggactgcatggtcatgtcgccggtttcaccaccacgtgcacgttccacatcggtcagccagaaggtgcgtgtgcaatcgcggaagcggtcgttccattccgcgaaggggatgccgaattgtcccgttctccagccgttcgggccgcaatcccacggttccatgatcatcttgaggttgccgagcagcagatcggagcgcaacgcgtacaggaacgggtggtatcgcgtgaattcgccgtcaagacgcgccagcgtcgccgcaagatcgaatcggaatccgtcgataccaatgcgtttggcccaatagcgcaacgaatccacggcgaacgtggtgacgtgcgtgttggtgaaatcaagcgtgttgccgcaaccggtggtgtcgtacaggcggctgatcttgtctttggtgcgtcggtagtacgagagattgtcaaggcctcgccagcaaatggtcgggccttcggggcctgattcgcaggtgtggttgtacaccacgtccatgatgacctcgaaaccggcctcatgcatggcccgcaccatgtcgatgacctcctgccgcacggcgcccgctcccgcttcctgcgcctgcttggtggcgtacgaggcttcgggggcgaagtagccgagcgtggaatagccccagtaattcgtgcgattgcgttcctgcaggaacagttcggattgcttggcttggatgggcagcagttcgatggatgtcacgccgaggtcctgcagataggagagcgtggccggatgggcgaggccggcataggtgccgcgcaattccggaggaagccatggggcgttcgcggtgaatcctttgacgtgcagttcgtagatgacggttttgctccatggcacatgcgggtgggatggttctcccatatgcttgttgatgtcgcggtcgtcaatggccacggaaacaggcatgtgtcccagagagtccacggtgctcatcggtccgaacggcgaaccggcgaccttgccgtttttgatctcgcattcgtaggcgaaggcgcccgggtcgagttccatcttgccttcgatgcctttggcgtatgggtcgagcagcagtttgtatggattgaagctcacgccatggtttggatcccatgggccgttgacgcggtatccgtattgcatgccgtcccatgcttgcggcacgtgcacgtaccacagtccgtagttgggaccgtccatgcggaacagtgtttcgcgaagattgagcgagggaatgcgtctggtgcagatgcgctgttttttggcctgatcgatgaacgtgagtccgggttcgttgaacagccgtgcggcgtcggcatagaaggcgctcggttggtcaagtggttcaagtacgcaaaaccacacttggtctgctgtttctgagcggacaacggcgtccgcgccaccatcgtcggtgaaatagagacctgggcgggttgcgtagcggtgcaaaggtgggttcttcataacctcattctaaacactttgaaattatctgttgacttgctatgtcgaggctgtcgacgctcgtgccggtctgatccagccgtgagcttgaactcgagcaggtgcaggacttcctcgacggcaaaatcgccgccgcttccaaggctgtcgtcaaaatcggcgccggacgctgtttattcgtcctgaacagcttggaattagcgaaaaagtatcacgacatgacggcaaatgcgccgccgacatcgccgcatagcgcatatcctaatcacaaaagggaaaaatcaatcgtattcatcgttatcaggaggtaattttatgacgaaagcaatgtctgaattcactaccgatctgcagcattccggtatgccggcgaaggatctcgacgaaaccatcgaattctatacgaagaagcttggtttcgaactggccggactgttccataacggcgaaaatcgttgcgcattcctgcgttacggccatctgaccatcgaaacgtgggagggtgatccggctccgctgaccactggtgccatcaatcattgggcattcgacactcccgacatcgaagctgcattcgaaaacgcgaaggaactcgggctgaatttcaaagataacgaaatccagcatatcgacagcttctgggagcatggcatccgctacttcaacgtgtacggaccgaacggcgaaaccattgaattctgtcaaattgtcaaataactatcgttagatgattgccgtcaaataatcgttgaaaacaaatacaacaggcgaaacagacggaagcaaacaaagaagcgtgcgctgaaccttatatacgggttcggaacacgcttctttttgttatgcaatcgatgcgactaatgcgattaatatgtgcgcaaaagcggtcacatatcgcatagttcgcgtacgtacggctccacaaaacgcagagccgcgccgataatgtcttgatggtcgagcgccattcccttgcgcagggtgaaatccgtggtgccgaatggcgtgtgttccaccacgcgttcgcgtagtccggccatatcgtcctcatcgagatattgtgctgcctcaccgctgatgatcacgtcaccggccagcaccgagcgaatattcgttaccgccagcgccacataatccagccattgcgagaatcgttcgcgatgctcctgctcgccttgttccaacaccgagaagaagccgggcaggctttcgccgtcttccatcagcgtttccggcgagcaatacgtatccatgcagccctgttgcccgcagtagcaggtgttgcctcctggaatcagcgtcatatgttcgattgagccattgcattggttgggcccttggtagagcgatccgtctacgatgaccgcgcctctggggcgtcgctcgaggtagatgcagacggcatccttcagattgtggtcgaaccagagttccgccatggcagaagcgtcggaatcgtgaatcatcagcgacggatagttgaggccgtggctgagttcgttgagtttcaggccggtgttgttcatgattttgccgaaggtgatcgactgcccgtctgccgatacgatgccttgcatgcagaaggccacgcctcgcaccgtgctgccttgtttcgccagttcctgcgcgaaatcgttgatgatgccgttcatgcgctggtagtaggcgtcgttgttacgataggggagtgtgcgctgtctggtggccacggatttgccgttcagatcaatggcgatggccgtgattcgtgtggtttggattcgcacgccgatagccacgctggagtgtgccgcgaattcgtagatttgcgctttgcgtccaccggtggattgctgcatctcgcctttgacgatgagcccgtcggcctccatggcgcgcagattctgcgtgatggttggcaggctgagccctaattcgtgttcgaacatctgcttggtggctgaaccttgagtgtagatgaacgcggtcatggccttgagattggcttctttgactgatagggcggattgggctttcactggttgatccttcctgcgcaacttcttttccaagattacttcataaaagtcctttccttatgtctcgtgttggtctgagatatcaggtattgcaaaaaagtatcaaaaacagctgtgcataaaggattttctgccacttttctgcgtcgaaaatatatttatcaacaaaaagttgagacggtgacaacgacgttctaccaagaaaagagacatgttatgaagataggtctgccgcgcacgctattggccggcttggtcgccatagcggtgttcatgaccggcgatggctttgaattgacttttttgtccaaatacatcgtggaccagggattcagctcttcgcaatcgtcgctgatgttcaccatgtacgggctggtggctgcgcttgccggctgggcgtccggtgtgctagctgaaatgttcggtgccaaacgcatcatgcttatcggcgcgagcgcctgggtcgttttgcacctgctgttcgttggtgtggcgctgccgagcggcgtctatccgctgatgttaggcgtgtatgcgttgcggggtgttggttacccgctattcatctactcgttcgtggtgttgatggcgcaaaccatcgatcctgccaagctcgcgtcggccatggggtggttttgggccgcctactcgttcggcatcggcgtgtttggcgcatatttgccgagtttcaccattccgatggtgggcgagtactattcgctgtggctttcgttgccgttttctatagctggactgctgatttgcctgctgatggtgccgaaaagcaagggttctggcacctcttccatgagcaatgcagacaagctgcgcgagcttagtcgaggagtcaccattctggtgcataatcgccaaatcgctttggctgcggtggtgcgtgtgatctgcaatctgacgttgtatggctttcccgtcatcatgccactctacttggccactaccaacaatggcggcggcgattggtttaaggtttcgcaatggagtcagatttggggattccagtttgtggtcaccattttcggcaatgtgttctggggtcgtatgggcgattcgcatggttggatgcggcaaatgcgctggtttggctgctggttctgtgtgatcggcacgctgggcatgtattacattccgcagtttttcggggcgaatatggtgcttatgtgtgctgatgcggttgttcttggattgggaatttccgctttcgttcctatgggagccgtgtttcccgcgttggcgttggaacataagggtgctgcgatttccgcgcataatttcgcttccggcctggctacgtttttcggtccgctgattgcgacggtgctggtttccactatcggattcggcggcgtgtgctggacgtatgcgatctgctatgcgatcggatcgttggtcacgttcggcattcatcctcatcaacccggatttgatgatcgcggccatcgcattgccacgatcgagcgtaactaatcgcaattgaatatcaattgctcgatcatcatttttctcaaaaaacatcattatccacaaaggagaataatcatgaaggcagtcgttctcgaagagcagggcgtcatcaatgtgcgtgaggtgcctgacgtccccgcacctggtctaggcgagctgaagatcgcgccgcataccgttggtgtgtgcggttccgacctgcactattacactcatggtcgcgtgggcaaatatgtggtggagcagccgatgattctcggtcatgaggcttccggcacggtggttgaggtcggtcctggcgtcgaaggcttcaaggtgggcgatcgtgtggccatggagcccggcattccggatatgagttcgcgtgccagcaaactgggcatgtataacgtcgatcctgcggtgcgtttctttgccactccgccgattgatggctgcctgtgcgaaacggtgaaccatcctgcggcgttcacctacaagctgcccgacaatgtgagcttcggtgagggtgcgctgcttgaaccgttggctgtgggcatgtggtccgccaccaaggctcgtatcaagccgggcgatgtctgcgtggtcaccggatcgggcacggtcggcatgctgaccgcgtcgtgcgcgttggcaggtggtgcttccaaggtgctgatttctgatgtgtcggcaatcaaactggcgattgcggctcagattccaggtattattccggtggatctcaccaaagaggatctggtggagcgcgtccgtgaggaaacggggggttggggtgctgatgtggctttcgagtgctcgggctcgccgaagtcatacgagacattctggaagctgattgctcccggtggcgctgccgttatcgttggcattccggtcagtccggtggctatcgacattacggaactgcaggctaccgaggtgcgcatcgaaaatatcttccgttatgccaatgtgtatcagaaggccattgacctcgtggctaacggtaaactgaatctgaagccattcatcaccgacacctatgcgatggaggatgccaaggcggcgttcgatcgcatggccgaggggcgtcctggagatattaagctgcagattaccgtgaataacgactgacgttacgcacgttacggaacgacgaaaggggtctaggccatgggtgctgttgtacaagtcaacgataatcggcatgggaaggcggctttggctcagacctcttttggtggattcgtgccgaaaggtggaagttcgaacgattccggcgtattggagatcattgtgccggacgcgcaggcttcggtgcgttgggtgaagcatggctacccaagctcgttggcgaaatggcatcatcatcctcatattgaaattcatctgattcgggaaggtaccggattgatgatggcgggcaatgccgttgttccgtatgaggccgggcaggttgcgctgattggttcgaatcttccgcataattgggtgtccgacatcgctccgggggagcggcttcgtcagcgtgatgtggtgtgccatgtgcgtccggaaaccatacgtctgctgatgtctggatttccggaaacgtctggttttgcaatggtgttgaggcgtgcggggcaggcgttggtgctgagcggtgaatccgctcgtcaggccggttcgattctggaaagcatggaggaacatagtcttgcttgccgtgttagtgatctgattcgtgtgttggatgtgttcgcgcatgcctcagcagatgaatcctatacagtggttgcgtccggatacgatccggctgtatgcagtggtgcggaaagtgtggtcaacgatgccattgagtacatttcctcgcatctgagcggtgaaattagcctggatttggccgctcgtcaggctggaatgagtgtgtcggctttctctcgtctgttcaaaagggccgcaggaataaggttttcggattttgttcgacgattgcgtatcgggcatgcgtgcagattgctgacgaccacgaatcaaagcgtcgcgtcgattcgtcgtgcttgcggatatggaaacgcttcgaatttcaatcggcgcttctttgaagaaacgggcgaaactcctactggctggcggaaaaaatacattggacggacaagataagtaaataaactttgtaaaagtttgatatgattgatatcatatagaaaatacttttataaaagatgaggaggtgagacttgagaaagtgtgtgtgatttatgataaaaagcaacaaaaacgctcaaaatgatgtttttaaagctttttctcttcacaaaagaacgcaatctaaacattaaatgaacagaatataacatttctcttgcgacacgacgcagtggaaaatcatattgcatactcgctaaagtgtgtcctaggtcacaaaagaccagcaacgcgtccatccgcttcgaggtgggtggaataacgggaaactactttgcaaacccccaaagaatcgaggaggacttcaagtggcagacgcaaagaaggaagagccgaccaagccgactccggaagagaagctcgccgcagccgaggctgaggtcgacgctctggtcaagaagggcctgaaggctcttgacgatttcgaaaagctcgatcagaagcaggttgaccgtatcgtcgccaaggcttccgtcgcagcgctgaacaagcatctggtgctcgccaagatggccgtcgaggagacccaccgtggtctggtggaagacaaagccaccaagaacatcttcgcctgcgaacacgtcaccaattacctggccggacagaagaccgtcggcatcatccgcgaagacgatgtcatgggcatcgacgagatcgccgaaccggtcggcgtcgtcgccggcgtgaccccggtcaccaacccgacctccaccgccatcttcaagtcgctgatcgcactgaagacccgctgcccgatcatcttcggcttccacccgggcgcgcagaagtgctccgtagaagccgccaagatcgtgcgtgacgcggccatcgaggcaggcgctcccgagaactgtatccagtggatcgagcacccgtccatcgaagccaccggcgccctgatgaagcatgacggtatcgccaccatcctcgccaccggtggtccgggcatggtcaaggccgcatactcctccggcaagccggccctcggcgtcggcgctggcaacgctccggcatatgtcgacaagaacgttgacatcgtgcgcgccgccaacgatctggtgctctccaagcacttcgattacggcatgatctgcgctaccgagcaggccatcatcgccgacaaggacatctacgctccgctcgtcaaggaactcaagcgtcgcaaggcctatttcgtgaacgccgaggagaaggccaagctcgagcagtacatgttcggctgcaccgcatactccggccagaccccgaagctcaactccgtggtgccgggcaagtccccgcagtacatcgccaaggccgccggcttcgagattccggaagacgccaccatccttgccgctgagtgcaaggaagtcggcgagaacgagccgctgaccatggagaagcttgctccggtccaggccgtgctgaagtccgacaacaaggaacaggccttcgagatgtgcgaagccatgctgaagcatggcgccggccacaccgccgccatccacaccaacgaccgtgacctggtccgcgagtacggccagcgcatgcacgcctgccgtatcatctggaactccccgagctccctcggcggcgtgggcgacatctacaacgccatcgccccgtccctgaccctgggctgcggctcctacggcggcaactccgtgtccggcaacgtccaggcagtcaacctcatcaacatcaagcgcatcgctcggaggaacaacaacatgcagtggttcaagattccggccaagacctacttcgagccgaacgccatcaagtacctgcgcgacatgtacggcatcgaaaaggccgtcatcgtgtgcgataaggtcatggagcagctcggcatcgttgacaagatcatcgatcagctgcgtgcacgttccaaccgcgtgaccttccgtatcatcgattatgtcgagccggagccgagcgtcgaaaccgtcgaacgtggcgccgccatgatgcgcgaggagttcgagccggataccatcatcgccgtcggcggtggttccccgatggatgcgtccaagattatgtggctgctgtacgagcacccggaaatctccttctccgatgtgcgtgagaagttcttcgatatccgtaagcgcgcgttcaagattccgccgctgggcaagaaggccaagctggtctgcatcccgacttcttccggcaccggttccgaagtcacgccgttcgctgtgattaccgaccacaagaccggttataagtacccgatcaccgattacgcgctgaccccgtccgtcgccatcgtcgatccggtgctggcccgcacccagccgcgcaagctcgcttccgacgccggcttcgacgccctgacccacgcatttgaggcttacgtctccgtctatgccaacgacttcaccgatggtatggcactgcacgctgccaagctggtgtgggacaacctcgccgagtccgtcaatggcgagccgggtgaggagaagacccgtgcccaggagaagatgcacaacgccgccaccatggccggcatggctttcggctccgccttcctcggcatgtgccacggcatggcccacaccatcggcgctctgtgccacgtggcccacggccgcaccaactccatcctcctgccgtacgtgatccgttacaacggttccgtcccggaggagccgaccagctggccgaagtacaacaagtacatcgctccggaacgctaccaggagatcgccaagaaccttggcgtgaacccgggcaagactccggaagagggcgtcgagaacctggccaaggccgttgaggactaccgtgacaacaagctcggtatgaacaagagcttccaggagtgcggtgtggatgaggactactattggtccatcatcgaccagatcggcatgcgcgcctacgaagaccagtgcgcaccggcgaacccgcgtatcccgcagatcgaggatatgaaggatatcgccattgccgcctactacggcgtcagccaggcggaaggccacaagctgcgcgtccagcgtcagggcgaagccgctacggaggaagcttccgagcgcgcctgatcgcaatatcgcaacgtaactccttatataaaagatgtgaagtgaagcgtatataaggagtcgtgcaaaaggagcctgatgggaaaccatcaggctccttttttatagtgagggggaagtggaccgtcgccgttaccttccgcgttcttcatcgaaagaagacgcgtgattgtgttggcgcgacaccgcgaaaaacgttggaaaaaccgcgacacgcgcgaattccatatgttcacccctgatgcttagataaagaagttgcctgattttagggctcgcaaattgtaattcaaaaagcgagcgtggcacagcggctcactccggtgagaagctgcatggctgcgcactgatgtggtatggccacggaacttccacggttccgggggtcttctgcgccggtgcccttggaagcaggctggtaaacagtaaataacgaatcgctagaaagggcggaaggcaatggcgggacagaaaatccgcatcaggcttaagtcctatgaccatgaggtcatcgaccaatcggcgaagaagatcgtcgaaacggtgacgaacgcgggcgcaactgtggttggcccggttccgctcccgaccgagaagaacgtgttcgtcgttatccgttctcctcacaagtacaaggattctcgcgagcatttcgagatgcgcactcataagcgtctcatcgacattgtggacccgaccccgaaggccgtggactccctcatgcatattgatctgcccgcagacgtgaacatcgagatcaagctgtaagggaggagggaaccattatgtctaatcgcaccgcactgctgggcaagaagctcggtatgtctcaggtctgggacgagaacggtttcttcgttcctgtgaccctcgttgacgtgtccaccaacgtggtgaccgctgtcaagtccgaagagtccgacggctacaaggctgttcagcttggctacggccaggttgacccgaccaaggtgaccaagccgctcgccggccacttcgccaaggctggcgtcaccccgcgtcgtcacctcgctgaggtccgcaccgataacgccgaagagttcgagccgggtcaggagctgaccgctgagctgttcccggaaggcaccctggtcgacgtgaccggtaccaccaagggcaagggcttcgcaggcaccatcaagcgttggggcttcaagtcctatcgtcgtacccacggctctcacaagaacgagcgtcgtcctggctctgttggcgcatgcgccaccccgagccgcatcctcaagggcaagcgcatggctggccgcatgggtcatgtgaccaacaccgcgctgaacctcaccatcgtttcgtcggatgttgagaacggcgtgctggctatcaagggcgccattccgggcccgaagggcagcatcgttctcgtccgttcggcagtgaagggagcctgataaatcatggcaaacgttactctgaacgtcaccgataaccagggcaaggccaccggcaccgtcgatgccccggctgagatcttcggcttctccgctgaagaagttcagtcccgcatcccgctgatccaccaggtcgtcatcgcccagctcgccgctgctcgccagggcacccacgccaccaagactcgtggcatggtttccggcggtggccgcaagccgtggaagcagaagggcaccggtcgtgctcgtcagggctccatccgtgcaccgcagtggtaccacggcggcaccgtgttcggtccgcagccgcgtgactactcccagcgcaccccgaagaagatgaaggccgctgctctgaagtacgtgctttccgatcgtgccaatgccggtcacgtggccgttgtcgacttcggtgtttccgaagccccgtccaccaaggccgccgttgccgctcttaccccggtgaccgagaacaagttcaccaccgtggtgctctctcgcgagaatgtgaacgaatggctttccgttcgtaacatcccgaccgttcacccgatcttcgccgatcagctcaacacgtacgatgtggtcaccgctcagtacgtggtcttctccaaggaaggctttgatgctttcctcgctgcgaaggctgagccggctgcaaaggaggcctgattttcatggtcgctattcacaagcccgcacacgacatcatcctcaagcctgtcgtttctgagaagagctacgctctgtccgatcgcggtcagtacaccttcgtggtggccccgaacgcgaacaaggttcagatcaagcaggcaatcgaagagatcttcaatgtcaaggtgacgaacgtcaacaccctcaaccgcgccggcaagcgccagcgcacccgcaacggtttcggccagcgcgtcaatcagaagcgcgccatcgtgaccgtcgccgagggccagacgatcgacatcttcggtaactgaaggctagccgagaaaagttaaaggaagaactagattatggctatccgcgtttataagccgacgactgcaggccgccgtaacgcgtccgtctcggacttctccgagcttacgcgctccacgcctgagaagtcgctggttcgcaagctcagcaagactggcggtcgtaactcctacggccgtatgacctcccgtcatcgcggcggcggtcacaagcgccagtaccgtctcatcgacttcaagcgttgggacaaggacggcgtgccggccaaggtcgctcacatcgagtacgacccgaaccgttccgcccgcatcgcactgctgcactacgcagacggtgagaagcgttacatcatcgctccggaaggcatcaagcagggcgacgtcatcgagaccggcgctcaggctgatatcaagccgggcaacaacctgccgctgcgcaacatcccgaccggtaccgtggtgcacgcgattgagctccgcccgctgggtggcgccaagatcgcccgctccgccggtgctgccgtgcagctcgtcgccaaggatggcgcctacgctcagctgcgtatgccgtccggcgaaatccgcaacgtggacgctcgctgccgcgcgaccgttggtgaggtcggcaactccgaccacgccaacatccagcttggcaaggcaggccgcgctcgttggatgggcaagcgcccgatcacccgtggtgagtccatgaaccctgtcgatcacccgcacggcggtcgtacccgcggtggcaagccgccggtttctccgtggggcaagggcgaggttcgtacccgccgtccgaagaaggcttcgaacaagatgattgttcgtcgtcgcccgaatggtaagaaccgtaagtaagggagtgtcgagtagatgactcgtagcatcaagaagggccccttcgtcgacgcccacctgcagaagaaagtcgacgagcagaacgagaagggtacgcacaacgtcatcaagacgtggtcccgtcgttcgatgatcacccctgatttcatcggacacaccttcgccgttcacgatggccgcaagcatgttccggtgttcgtcaccgaatccatggttggccacaagctcggtgagttcgccccgaccaagaccttcaagggtcatgtgaaggacgacaagaaggcacgccgctaaaggagagtaaggacacatggaagctaaagcaatcgctcgtcacgtccgcgtgacgccgcgcaaggctcgccgtatggtcgacctcatccgaggcaagaaggcgaccgaagccatcaccattctgaagttcgctccgcaggacgcatccctcccggtgcgtaaggtcctggagagcgccatcgcgaacgctcgtgtgaaggccgacaaggccggcgagccgttccgcgagaacgacctggtcgtgaaggagacctatgtggacgaaggcgtgacgctcaagcgtttccgcgcccgtgcacagggccgtgccgctcgtatcaacaagcgcaccagccacatcacggtcgtcgtcgctaacaaggaaggaaaccgctaaagatgggtcagaagatcaatccgtttggctaccgcctgggaatcactgagaaccatcgttccaagtggttctccgattccaacaaggttggcgaacgctaccgcgacttcgttctcgaagatgacgccatccgcaaggccatgagcaaggacctcgagcgtgcgggcgtgtcccgcatcgtcatcgagcgtacccgcgaccgcgtgcgtgtggacatccacaccgctcgtccgggcatcgtcatcggccgtcgtggcgctgaggctgagcgcgttcgcgccaagctcgagaagctcaccggcaagcaggtccagctcaacatcttcgaagtgaagaacgccgcactggacgcccagctcgtcgcacagggcatcgctgagcagctcaccaaccgcgtgaccttccgtcgcgcgatgcgtaaggcccagcaggatgccatgcgtgcaggcgccaagggtatccgtatcaagctctccggccgccttggtggcgccgaaatgagccgttccgagttctatcgcgagggtcgcgttccgctgcagaccctgcgtgccctcattgattacggcttcttcgaggccaagaccacttacggccgtatcggcgtgaaggtctggatctacaagggcgatatgaccgagcgtgagttcgaagagcagcaggcacagcagagcaacaaccgccagggtcgtcgcggcgatcgtcgtccgcgtcgcggccagcgcaacgctgctccgcagcagaacgcagcagcagaggctccggccgctgctgaggcacctgccgcaacggaaacgaaggagtgagctgagaatgcttatcccaaagagaaccaagtatcgtaagcagcaccgtccggtccgccgtggcatgtccaagggcggcaacgagatcgctttcggcgatttcggtatccaggctctggctccggcttatgtgaccaaccgccagatcgaggccgctcgtatcgccatgacccgctacatcaagcgtggtggccgcgtgtggatcacgatcttcccggatcgtccgctgaccaagaagccgctcggcacccgaatgggttccggtaagggtactccggaattctggatcgccaacgtccacccgggtcgcgttatgttcgagatcggtggcgtgtccgaggatgtcgctcgtgaggctctgcgccgcgcaatcgacaaactccccatgaagtgccgtgttattgctcgtgaaggcggtgacatctgatggcagtcggaactgcagactacaccatgaagaatctcaacgagaagaccaacgaggagatcgagggcttcctcaagaagtccaaggaagagctgttcaacctgcgcttccaatccgcgaccggtcagctcgaaaacaccgcccgcctcaaggcggtcaagcacgacatcgccaggatgtacaccatcctgcgcgagcgtgagctcggcatcagccaggcccccgaggcgaccgaaacgaaagctgaggagaagtaatggctgaagagcgtaacttccgcaaggttcgtcgcggttacgtcgtgtccgataagatggacaagacgatttccgtcgagctcgagcagcgttcgacccacccgctttacggcaaggttgtgcgctccactcgtacggtcaaggtccatgatgaacacaacgaggctcacattggcgacctcgtgagtattatggagactcggcccctgagcaagaccaagcgttggcgtctcgatagcattatcgagcgcgctaagtaaataagttcggcaaggctccgtgagtcaccccgcctgcttctagcaggcaggcggggtgcttggggagaaccagctcggctaaggagaatcaatgattcagcaggaaacgcggcttcatgtcgccgacaacacgggtgcgaaggaactcctcgccatccgagtgctcggcggatcgaagcgacgctatgccggcatcggtgacgtgatcgtcgcctccgtcaaggacgccatccctggcgggtcggtcaagaagggcgacgtcgtcaaggctgtcgtcgtccgcactgtcaaggaacaccgtcgtgtcgacggctcctacatcaagttcgacgagaacgccgccgtcattctcggctctggccgtgaaccgaagggcactcgtatcttcggaccggtcggtcgtgaactgcgcgacaagcgcttcatgaagatcgtgtccctcgccccggaggtgatctgacatggcagccaagattaagagcggcgacctggtcaaggtcatccgcggcaaggatcgcggcaaggaaggcaccgtcaagcaggtgctcaaggacgatcgtctgatcgtcgagggcgtgcagatcgtcaagaagcacgtccgcgccacgcagcagggccagcaggccggcatcgtggctgtcgaggctccgattcatcgctccaacgtgatggtcatcgatccggagaccaagcagcccacccgcgtgcgcatcgtcgaaaaggaagaggcccgtgacggcaaggtgaagaccgtgcgcgtgcgtgtcgccaagaagtccggaaaggagctggcatgaccgataccactgtcgaagcgccggcaactccgcgcttgaagcagaagtacaacgagcagatcgtgccggagctggagaaggaattccactactccaacccgatgcaggtcgctcgcgtccagaaggtcgtcgtctccatgggcgttggcgccgcagctcgcgactccaagctcatcgaaggtgccgtcaaggacctcaccctgatcaccggccagaagccgaagatcaccaaggccaagaagtccgtcgcacagttccacctgcgtgagggccaggccatcggcgcctacgtcaccctgcgtggcgagcgcatgtgggagttcctggatcgccttctgaccatggctctgccgcgtatccgcgatttccgcggcatcaacggcgaccagttcgacggtcagggcaactacaactttggcctcaccgagcagtccatgttccacgagatcgatccggattcgatcgatcaccagcgtggtatggacatcaccgtggtgaccagcaccaaggacgacaaggaagctcgcgtgctcctgaagcacctcggcttccccttcaaggagaactgatatggcaaaaaccgctcttaagaacaaggcggccgctaagccgaagttcaaggtgcgcgcctatacgcgttgccaggtctgcggtcgtcctcactccgtctaccgcaagttcggcctctgccgcatctgccttcgtgagaaggcccaccgcggcgagctgcccggcgttacgaagtccagttggtaaatatcgacgctgaaggtccgcggcccgatcgcctctaaggcgtgagggcggcggaaaccatggcgagaaagggcgttagcccaaatgacaatgacagatccgatcgcagacatgcttacgcgtctgcgtaatgcgagcgcggcaaagcacgagaccgtggatatgccgtactccaagttcaaggcgaacatcgctgagattctgaagcgtgaaggctacatcaaggacttcaccgccaaggaagccaaggttggccagactcttgaggtcaccctcaagtacggtccgaacggcgagcgttccatccagggcatcaagcgcatctccaagccgggcctgcgtcgttacgcaaagtccgatgctctgccgatgccgctcggtggccttggcatcgcaatcatctcgactagctcgggactgctgacccagaaggaatgcctcgaccgaggcatcggcggcgagatcgtcgctttcgtttggtgagaaaggagagctgaaacatggcatcgcatattggtaagctccccgtcaccattccggctggcgtggaagtcaagatcgacggtcagtcctttaccgccaagggcgctaagggcactgactcctacgagattcctgaaggcatcaccgcagtggtcgaaggcaacgaagttgtcctcaccccggctgatgacctgcgtccgacccgtgcaaagcacggcctggctcgctccatcgtggcgggcatggtcaagggcgtgcacgagggttatgccaagactctggagatcgtcggtaccggttaccgcgcccagatgaagggcaagggcattgagttctccctcggctattcccacaccatcaccgtcgagccgccggcaggcatcgaattcgaactgccgaacccgaaccaggtgatcgtcaagggcatcgacaagcaggctgttggccagtgcgccgctaacattcgtaagcttcgtgctccggaaccctacaagggcaagggcatcaagtacgcggatgagcacattctgcgcaaggctggaaaggctggtaagtaatgagcgtccagattctcggtaagggcaagaaggtcgcgcttaagcgtcgtcacgctcgtctgcgcaagcacatcagcggtaccccggagcttccgcgtctggtggttacccgttccaaccgtcacatggttgcccagatcatcgatgacaccaagggtgtcaccctggtgagcgaatccactctgaccagcgatttcgccggtttcgagggcaccaagaccgaagccgccaagaaggtcggcgaactgatcgccaagaaggctcaggacgctggtatcaccgcggtcgtgttcgatcgtggcggcaacaagtatcatggccgcgtcgcagctgtcgctgaaggcgcccgcgagggaggtctggcactgtgagcgacaacgaaaaggaaacccaagtggctgaagaaactcagaacactcaggctgccgctgagtccaacaacgaggaccgcaagtcccgtcgtggccagcgcggtgagggtcgtcgtggcgagcgtcgcaaccgtcgtgaggaatctcacgagaacgagatgctcgatcgcgtggtgaccatcaaccgtgtgtccaagacccacaagggtggtcgtacgttcagcttcgccgccctcgtggtggttggcgacggcaagggcaccgttggtgttggctacggcaagtcccgtgaggtcccggctgcaatcgccaagggccagctggatgccaagaagcacatgttcaccgtgccgcgcatcaagggcaccgtcacccacccggtgatcggccacgatgccgctggcaccgtgctgctgcgcccggctgctccgggtaccggcgttatcgccggcggtgcagtccgcgccgtcatggaatgcgctggcatcaccgacgtcctgaccaagtcgatgggctccgccaccgccgtcaacgtggtgcgcgcaaccgtcgacgccctcaagaagctcgaagagccggaagagattgccgcacgtcgtggcatgtctctcgaagaggtggctccggacgcgctgctgcgtgctcgcgccgaaggcatcgccgaggcccgcaaggctcgtgaagaggctcaggccaaggctgctcagaaggacggtgagtgatgactaacctgaacatcaagctgcaccacggtctggtgaactccactccgaagcagcgtgctgcggctcagactctgggcctgaacaagatcggcaagaccgtgactcgtgaggacactccggcccttcgtggccagctgcaggtcctccgtcacctgatcaccgtcgaggaggctgactgattatggcagacattctgcagatgcatgacctgaagccggctccgggtgccaacaaggatcgtatccgcgttggccgtggtgaaggctccaagggtaagacctcgggccgtggcgacaagggcaccaagaagcgctatcaggttcgtccgggcttcgaaggtggccagctgccgctgtacatgcgccttccgaagctgcgtggcttcaagaacccgttcaagaaggaataccaggtcgtcaacgtggctgctcttgcggaactgttcccgcagggcggcgagatcaccgtggctgatctggttgccaagggtgccgtccgcaacggcttcccggtcaaggtcttgggcgacggcgaggtttcggctgcctacactctcaagggtgtcaaggcttccgcttccgccaagtccaagatcgaggctgctggcggctccatttccgaggactgattccaacggaatatagctgactgaagctcagacatgaggcttcccccgctttagggcgggggaagcctcattcgtttgcagtcaaaatgcaatcatgcatggaaaaacaaaaaaacagacgaataatgacgaaaacgccatatcggtagacgccgtacgctagactcgagcgttagagtctgtttttgcacgtgtgcgcaggtgcgcacgacgatggaaggaaccccaggtgaggacgttaatccaggccttgaagaccaaggaattgaggaataaaatcctcttcacccttggtatcatcatcatttatcgtatcggttcattcatcccgacccctggcgtcgattacaccgtcgtccagcagtgcgtcggcaagatgaacaacgcttctgagaactttatcggtctggtgaacctcttctccggcggcgccatgctgcagctgtcgattttcgcattgggcgtcatgccgtacatcaccgcatcgatcgtcatccagctgctgcgtgtggtcatccctcgtttcgaggcactgcacaaggaaggccagtccggcgaagccaagctgacccagtacacccgttacctgaccatcggccttgccgtgctgcagtccaccaccatcctggtgaccgcacgttccggcgcgctgttcaactaccagtgctcccaggtcgttccggacggttccgtgtggaatctcgtggtcatggtgctcatcatgaccggcggcaccggcctcatcatgtggatggccgaattggtcaccgacaagggcctcggccagggtatgtccatccttatcttcatgtccatctgctccggcttcctgccgcagctgtgggagatcggctggggcaccaacggtaccgatggcaattggggcaagttcgccgcggtcgtcggcacgctgctggtcatcatgattcttgtcatctacgtcgagcttgcccagcgtcgtattccagtgcagtacacccgccgtatgatcggccgcaagatgtacggtggctcctccacctacctgccgctgaagatcaacatgagcggcgtcatcccgccgattttcgcatcctccatcctggccgtgccgacgctgatcgcgcagttcggcaattccgaccagtcctgggtcaagtggatcaactccaacctggccaacaccacatccgtgtggtacatcgcactgtacgcgctgatgatcgtgttcttctgcttcttctacacggagatcaccttcaacccggacgagaccgccgacaacatgaagcagtacggcggcttcattccgggcatccgcgcgggaagcgccaccagcaactacctgagctacgtgatgaaccgtctgaacacggtcggcgccgtctacctgctgttcgtggcgcttatcccgacggtgctcatcatggcgctgaatctgaacaccaagctgccgttcggcggcaccaccatcctgatcatcgcaggtgtcggcctcgacaccctgcgccaggccaaggcccagaccgaacagttccagtacgctggcttcctgttcgaggacaccgaccacaaggaaggtaagtaaccacttgaatcgtgatgccgtttccgttgatcgggagcggtatcacgatttttatgttaggtaatccatcatccgaaaatccccgttgaggggaatgaacgaaacggagaacaacacatgcgactgctgatcatgggcccgcagggcgtaggcaagggcacccaggccgctctgctgagcgagcactacggaatcccggcgatctccaccggcgatatcttccgctacaacatcaagaacaagaccgagctcggcgtcgaagcgctcaagtacatcgacaagggcgagcttgtgccggacgagctgaccaacaagatcgtcaaggaccgtctggccatggacgacgccaagaacggctggattctcgatggctatccgcgcaacgcctcccaggtcgaggctctcgacgccatcctgggcgagctggacaccccgcttgacgcggtcgtcgcactggatgcagatcacgacgtgctcatggagcgtatgaagaagcgcgccgaaatcgaaggccgctccgacgacacccctgaagccatcgccaagcgtcttgacgtgtacgccaaggagaccgcgccgctgctggacatctaccagaagcgcggcctgctcaagacgttcaatggcgtcggcgccgtcgacgagatccaggccaccatcgtggcggagcttggctgaaggaaaaaccaagcagaataacatatttccaacgaaagcgggaatcgcgacacgccgaacgtgtcttgattcccgctttcgtgtattcttgcaagttggtgtgtcttcgggcacgcatagtaatcgccaaggaacggaacgaggctcatggctaaagacggtgtgattgaagtcgaaggacaggtagtggaagcactgccgaacgcgatgtttcgtgttgaactcgaaaacaagcatatcgtgctcgcaaccatttcgggcaagatgaggaagaattacatccgcatcctgccgcaggatcgtgttgtgctggagatgagcccctacgatctgaaccgcggccgtattacgtaccgttacaagtaaaggtacacaagcaaaggaaaaccatgaaggtcagccctagtgtgaagaggatctgcgagaactgccgcgtgatccgtcgtcacggccgcgtcatggtgatctgcgtcaacccgcgccataagcagcgtcagggctgagagcagatccagcggcataaacagtacaggcgctgagtcacagcccgtgaaagcgggatgaaccccgggtacgcaggcccgggccgggaaaccggacgactcggtgcaagacctgcggaaaacagaaggaatcgcaatggcacgtcttgccggagtcgacatccccaatgagaagcgcatcgagatcgccctcacctacatctttggtgttggtcgtactcgtgccaaggaaacgcttgccgcgaccggtatcaatccggacattcgcgtcaaggatctgacggatgagcagctgattacgctgcgtgattaccttgagggtaactacaagatcgagggtgatctgcgtcgtgaaatcgatgcggacatccgccgtaagatccagatcaactgctaccaaggccagcgtcaccgtaagggacttcctgtgcgcggtcagcgcaccaagaccaatgctcgtacccgcaagggcccgaagcgcacggtcgccggaaagaagaaggccaccaagtaatcggtggctgacagttcaagccacgaggtgtgagcctcatcgtttgaacatcaaagcaaattcgttattaggaaacgagggtcaatggcagctcaaaagcaagccgcgcgcaagccgcgtcgccgcgaccgcaagtcggtcccggttgggcaggcgcacatcaagtccactttcaacaacaccatcatttcgatcaccgacccgtccggcgcagttgtgtcctgggcgtccggtggcgatgtcggcttcaagggctcccgtaagtccacgccgtacgccgctggcatggccgccgaatccgcagcccgcaaggctatggagcacggcctcaagaaggtcgacgtgttcgtgaagggcccgggttccggtcgtgaaaccgccatccgttccctgcagtccgccggactcgaagtcggttccatcaccgacgtcaccccgcaggcacacaacggcgttcgtcctccgaagcgccgtcgcgtctgagcactagaagaaatcatcaatccaacgccgcttatggccggtgagtgcaccaccggcctgaagctgaaaggataaccacagtgcttatcgcacagcgtccgacacttaccgaggaatctctcaaccctcagcgttcccgcttcaccatcgagcctcttgagcctggtttcggctacacgcttggcaactcgctgcgccgtaccctcctgagctccattccgggagcggctgtgacttcggtgcgtatctccggcgtcccgcacgagttcaccactctgccgggtgttgaagaggacgttaccgaaatcctgctgaacatcaagggcatcgtgctcaccagcgaatacgatgagccggttgtcatgtatctgcgcaagagcggcaagggcgaggccaccgcgggcgacatcaccccgccggccggcgtcaccatcgccaacccggacatgcatatcgctaccctcgccgaggatggcgaactcgagatcgagttcaccgtcgagcgtggccgcggctatgtgcccgcccagatgaacaagcaggataacgccgagatcggccgcattccggtcgactcgatctactccccggtgctcaaggtgagctatcgtgtggaagccacccgcgttgaacagcgcactgacttcgacaagctcatcctggacgtggagaccaagccggctatttccccgcgcgatgcagtcgcatccgcaggctccaccctggtggagctcttcggtctgtgccgtgagctcaacacccaggctgagggcgtcgaggttggccctgctcctgtggcagaggaaaccaacccggagatgaacatcccgatcgaggacctgaaccttactcagcgcagctacaactgcctgaagcgcgagggcatccacacgatcggcgagctggtcgcccacaccgagcaggatctgctcgatatccgcaatttcggtatgaagtccatcgatgaagtcaaggagaagctccagtctctgggactcgccctcaaggcttccccgctgggtaacttcgataccaataatctcgaaggtggcaccttcttctcgccggaagacgagtgatccgccacttttgacctaaccgcttcgttggattcggacgttcgggcaactgcccacctgaatccaacggggctttcaaggagaaacaatgcctacaccaaagaagggtccgcgtctggcctccagcccggctcatgagcgtcttatgctcgcgaacatggccaccagcctgttccagaacggccgcatcaccaccaccctgccgaaggccaagcgtcttcgtccgctggccgagcgcctgatcacgctcgccaagcgtggtgatctgcacaaccgtcgtcgcgtgatgcgcgtcatccgcaacaagtccgtcgtgcacaagctgttcaccgagatcgccgagcagatggagcagcgcgaaggcggctacacccgcatcgtcaagatcgctccgcgtcgcggcgatgccgctccggcagccatcatcgagctcgtcaccgagccggtgagcccgaagcaggccgtggtgaaggaagccgaagccgcaaccaaggttgccgctgccgaggctccggaagccgccgctgaagaggctaccgctgagaacgccgagtgaatcgctcttagctgattgaaggccgggaatcgcaaggttcccggcctttgtcatatctgctgccaagactgtcgtgccacatgcctcactatgccagccatttgctatgctcgatgccgtgagactacgcatcgatttggcatatgacggtaccggcttctacggatgggcgaaacagcccgaaatacgtacggtacagggcgaaatcgaacgcgtgctgcataccattcttcgcgtaccggaaggagacccgaccgaaccgctgcgccttaccgtggccggacgaaccgacaccggcgtgcacgcctcgcatcaggtatgccatctggacgtcaacgaggacgtgctcaaacgctgcgtcggccacatggacgtgccgcccgtcatcgcgcttacccgcagacttcagcgtatgctgccggccgatatcgcaatccgcggcatcgcacccgctccggacggtttcgacgcgcgtttctccgcgttggaacgtacctacgtgtaccgaatcgccgataggtcaagcgaggtggaccctcgtaccagaaacttcgtattgcatatcgacgatgaacttgacctcaaatccatgaacgaagccgctgcgatgacgatcggcctgcacgatttcggctcgttcgccaccccgaatccgggcggcaccaccatacgcgaggtgaagaccgcgtattggcgtcgcgtgccgcagcggacgcttatcgacgacggcatgacgatgggggagcggtaccgtacgccgaccgtggaatcgggcctcgtctgcttcgtgatcgtcgccgacgcgtttgcacgcaatatggtgcgctccctcgtcaacggctgcgtgcaggtcggtatcggcaaacgttccctcgactggtttgcaggaaaaatggcggctccgctgcgcgaaggctccacaggaccgatcgcgccgcaaggactgacgctggagcatatcgaatatccggccgacgaccagctggcggtccgcgccgaagccattcgcgccaagcgcacactgtagctttattgcgattgtcatagccatgttacgggcgattgtcatgtccattgccgagacattgtcgtaacagaccgtttcgttttccggaaacgctggttcgttaggtttttcttccatcaaggcacgatgcctcagattggcatgcgttcgcatggggtggaagggagcgtggaacgatgattgaatccgccgcacgaaggttggcttcggaactggtcgatcgtcgggagtcgatcaaccgggagctgagccgtaatggcgtacggttcggcatctacaagaacggcgagtaccatgaccggctgtttccgtacgatccgattccgcgcatcatcgaatcggacgaattcgacagaatggaagccggactgaaacagcgcgtcaacgcgttgaacgcctacctgcgcgacatctactccgacaagcaggccatcaaggacggcatcgtgccggaagaatacgtgtacacgtccgcgggatactttccgcaagtcaacggcgtgacacctccgggcggcgtgttcgcgcacgtcgccggcgaggacctggtgcaggggcaggacgggcaatggtgggtgctggaagacaatctgcgcattccatccggtgccagctatccgctgttcgcccgcgatatcgaacgcagaatcacgcccagcctgttccgcaacgtacgtgtgcgcgacaatcgcgattatccacgactgctgcgccaatccatggatttcgtctccaccgacggcatagcagtggtgctcacccccggcaggtacaattccgcgttcttcgaacatgcatacctggccgagaaaaccggcgcggcgctcgcgttccccgaagacctcgaagtcgtggacaacaaagtgtacttcctcgactatgccggcaggaaacaccgcgtcggcgtggtctaccgccgtctgtccgacgaatatctcgacccgttcgcgttcaacccggattccgtgatcggcgtgccgggaatcctgtccgcctacaggtcgggcaatgtggcgatcgtcaacgctccgggcaacggcgcggccgacgacaaggccatctactatttcgtgccgaacatgatccgctattatctcggcgaagagccgattctgcacaatgcgccgacctacatgccgatgttcgacaaggaccgcaaggaggtactcgaccggctcggcgaactggtcatcaaggatgtggcggaagcgggcggctacggcgtcgtgttcggctcgtcgctcgaccggtcgcaacgagaggaactggccgaacgcatcaaggccgaaccgcgccggttcatcgcgcaggaggtcatccaattcaaggacatcgacgtggtggaccccgaaaccggacagatgagcccacgtaaatgcgacctgcgcgccttcgtggtgaccggcaagaacacgcacgcatggtattcgggactgacacgctactcgtccataccgggccagatgatcgtcaactcatcacagggcggcggtttcaaggacacctgggtactggccaaagagaccggcgtggagcatgattacgcacccggctcggaggtcgtgcgcgtgctggagcagtcccgcaagcactcgctggcactcgtcaccgcgtcgaaggccgacaacctgttctggctcggccgctacacggaacgcgtattcaccacgctgagccaattcttccccttctacgaccgtgtgatggacacggatgtggacgcgttccgaccgttcgcccgtgcgctcgacctgccggaggatttcgaggatttcgacgcgttcatccacagcttcctgtacgacgagaagaatccggattccgtacgcagcgccatcgtctacgcgttcaacaacgcggtgattctgcgccccgaacttggttctcgctcgttgcagcaggtggagttggccatgagctccatagtggaggcatccgaatacggcggcatggacgcggacatcttcaaacaccgcgacatcgcggacaacatgctcgccttctggggaggtgtggagaattcccccgtcgaaccgactctgaaatcgttcattttcgtgggcaaatatctggaacgtctggatctgtacacacgattcggatattccgtggaagagctcaaggcgccgcttgccaaactgggcagctacatcctgccgttgaacggtctgccggtaccgcaatgcttcgccgaaggattgcgctggctggtcggccagctgccgcagcggggatatgcggagcttgcggaaaaactggggatgctgctgaaagatttcgatgggcgcatctccacgaaggatctgaaggatctgggcatgctcaacacgatggacatggacgccgcgcgactgtgaagaatacgtgccacagccatcgcacggtgcgtgtataacggctagaacaaggcccacggcgtggaaaacgccgaaggaacgacaataatcgctgaggagacgatgtgaagaaactggtgtttgactatgagatgaagctctcattcagctcgcccgtgaccgaccatcgcttccaactgcgctgcattccagccaccggcccacgccagcaggtgatcgacgtggcagtcaaaatcgaaccggatgtggaactcgaaaccaccatcgattccttcgattccgtggtgatgaccggattcattcccgaaccgcacaccatgttcaactactcggtgaccggcatcgccttcgtggacaacgcgcatatcaaatccgaaatctacaagccgctgtaccgcttcaattcggcgttgacagtgccggggccggccatcgaagcgttgatcggcatctgccgtgaacgcatcgcgtccctgcctgccgactgcacgccgatcgaccaagcccgtgaggtgatggacgaggtgttcaaaacgttcgtctacacgccggcctccaccaccatccgcaccaccgccgaggaagcgttcgctcaacgcaagggcgtatgccaggattacgcgcacgtcatgctgtccgtgtgccggcacgtcggactcactgcccgatacatcgcgggattgctcggcggcgagggcgccacgcacgcatgggtcgaaatctaccatgatggacgttgggtcggtttggaccccacacaaccgtatggtcgacgacaactacatcaccatcgcccatggccgcgattaccgcgactgcatgctcgacatcggcatcttctccggctgcgacgtcaagcaggaccagtgggtcaacgcttccgtgcacgagcagggatactgattccccgacgttttctcgatgccggattccgtatttcggcagatgcaaagcagataaacaaaaaaggccgaaacgccattgtttcaaccttcattgcatgcggataaggcgagattcgaactcgcggaggggttcgccctcacacgctttcgaggcgtgctccttagaccgctcggacacttatccattcgtcacctgaaaacaagcaacttgataattgtgccacagcggtggcgattgtcaaatcggactggctgcaacggtgtgatttccggcgtgtcttgctttgcgcccgactgtgcgtccttaggcgaacagcgcttcgtcgaaggaaggatagccccaatcaagcgccaattcgacacggtccgcaatcagaccggcaagcacgcccagggattgcgctcgcgaatccgtcgactgttttgcattggtgacgcgtgactgggaatgatcgttcgcggcattggagcttccggcgattgccgttatctcgcttcgcgcgcagttcatttcgatggtggcgtcggtcggtgccgtaaggccggtggcggaatcgagcatcgtgtcggggtgggcgagcaaggcggtggcctcgtacgttttcctacgatcgtcaatggcgcccgagaaggatgcgaaccgttgcgatgtggtcttatgacgatcgctgatatccagcgtcgcatggccgctgttgcgggccgccagcacttccatggcgaatccggcacggtcttcggcctgcgcggcggtggcaagggacttggaatcgacgtcaagcgattcgacatcgtcaaaacgcgacagcgtgatcggcgcgacggccaccgacagttgatcgcccagtgcgcgagccatatgacgtgcctgcgcgctgcgcaacgtgccttcggcaaaacgcgccggacattgcgccgcggtgttcgtccatgcggagaccgcctgctgcgccgagaaatagcggcggatgatgtgctgatgctggtcgtgtgcgattttgttatcggcggtggcatcgaaataggccttctcgcacgggctttgccgttgttcggcttcagccctgcctgcgatcctgggcatggagcatgccgtcagcgccggcatgaggatagcggtgcaaagcaatgcgcagacgcgtttcgcgataaaagaaaccgagcggaaagaaggggtacgtgtctgcatgaatcattagactaatatctgactgtgaccattgggccatgcgctcggaataacttcatataggaggtcttggaaatatggaactggacctggcaggaatgcaccagctcgccgctgggcagggaattgatcccgagacgctggatgccgcactctcggaagcattgcgactggcatatctgaaaacccctcacgctgcgaagcacgctcgcgtcgagcttgatccgcgtgcgggaagcttcaccgtatgggcccaggacgagattcctggcgagccgactgaagacgatccccatcccgcgccgactctgggcgaggaatacgacgacactccgcacgatttcggccgactggccgctgcgaccgctcgtcaggtgatcagccagctgttccgcaaggccgaggatgacaaggtgttcggcgcgttctccggtcagaagggcaagctcatcaccggcatcgtgcaacaggacgtcaaggacacatccaacgtgcacgtggccgtcggcgacgtcgaagccctgctgccgcgccgcgagcaggtgcccggcgaacgctaccgtcacggcgaacgtatccgcgtgtacgtggtgaacgtggcccgtggtctgaagggcccggaaatcgtggtgtcccgttcccatccggagctggtccgccgcctgttcgaacgtgaggttccggaactggtttcgggagccgtgtcgattatggccatcgcccgcgaggcgggcgcccgcaccaagatcgccgtccgtgccaacaccgaaggcgtcaacccgaagggcgcgctgatcggccccggcggagcccgagtgcgcgccgtcatggagaacctcggtcctgagaaaatcgatatcgtcgactggtccgcggatccggcgaaattcgtcgccgcggcactgtctccggccgtcgccaccggtgtgcaggtgatcagcgagaagaacaagacggccatcgccttcatccacgatgaccagctgtccctggccatcggcaaggaaggccagaacgcacgtcttgcggccaagctgaccggctggaagatcggcatcgaatccgctgaggcgcatgccaagaagatggccgaatcggcggaccattccgatggggaaaccgaggaataaacaacacttccggtagacaacaagcccgtggacgtacaatccacgggcttgagtatgctggactcgacaatccaaagcgtgacggccatgccgtcatgcccagggaaaagacgaggtatcacgaacatggttgcacgatgagaaggaacaagctcgccgtgaatcagtagcggtcgcgcccgtatgcgcgcggcccaagataggagaattgagtgccgaaagcacgcgtatatgaacttgccaaggaacttggcgttgacagcaaaaccgttttaagcaaacttgaggcgatgggcgaattcgtgaagtccgcatcgtctaccgttgaacctcccgttgcacgcaagctgaggaacgcattcgcgtccagcggacagggcaacgcatctgattccaagaagccgggccatacggccaagaagcctgccgaaccggcatctcattccatgccaaagccggccgctccgtcagcaccgaagccggctgcccccgcagcgccgaagccgcgtcatgccgcttccaagtccgatgccccgaagccgggtcatcgcgcgccgcgtccaggcgaatcccgccagcatggcaatcgtcctaacggcaacgccccgcgtccgcagggtggagaccgccgccagtccggtcgcccgacggccgttccgggagctcgcccccagcatggcaacgctccgcagggcggcaacaacgccaatggcgcgaagccgcacaccccgggaccgcgcccgggcaacaatccgttcagccgcaagcagggcatgcacaccccgactccgggtgatattccgcgtccgcatccgatgaaccgtccgagcgtcaacaatggcgaaggacgtcgtggtggccgtccgggtcagggcggtggccagcgtggcggcttccgtggtcgtccgggtcagggcggcgcgaagccaggccagtggggccagcatcgtccgggtcagggcggtggccagcgtcccgccggcggcggcaatcgtttcggtggcaatggcggcggtttccagggcggcaacagcgctccgagcaatggtccggcacgtggtggccgcggccgcggcggcgctgcaggcgcgttcggacgtcagggaggcaagtcctcgaaggcgcgtaagaaccgtctggcgaagcgtcaggaattccaggagatgaaggctccggtcatcggcggcgtgcgcattccgaccggcaacggacaggaagtccgtctgcgtcagggtgcgtccctcgccgatctggccgagaagatcaacgtcaatccggcggcgctggtcaccgtgctgttccaccttggtgaaatggccacggccacccagtccctggatgaggccacgttccagatcctcggcgaggaaatcggctggaacatcaagatcgtgtccgccgaagaggaagacaaggagctgctgcagcagttcgacatcaacctggacgaagaggaactgcaggaggacgaggatttgaagccgcgtccgccggtcgtcaccgtcatgggccatgtcgaccacggtaagacccgactgctcgacaccatccgccgcaccaacgtcatcgaaggcgaagccggcggcatcacccagcgcatcggcgcataccaggtgaccgtcaaccttgagggcgagccgcgcaagatcacgttccttgataccccgggccacgaagccttcaccgcaatgcgtgcccgtggcgccgaactcaccgacgtcgcgatcctcgtggtcgccgccgacgacggcgtcatgccgcagaccgtggaagccatcaaccacgcccaggccgcgcatgtgccgatcgtggtggccgtcaacaagatcgataagccgggcgccaacccggacaaggtccgcggccagctcaccgaatacggtctggttccggaagaatacggcggcaacaccatgttcgtcgacatctccgcgaagcagggcaccaacgtcgacaagctgctcgaagcggtgctgctcaccgccgacgccgagctcgacctgcgcgccaacccggatatggacgcccgtggcgccaccgtcgaagcccgacttgacaagggccgtggcgccgtggctaccgtgctggtgcagtccggtaccctccacatcggcgatgccatcgttgccggcacctcctacggtcgtgtccgcgccatgctcgacgaaaacggcaaccacatgcaggaagccggtccgtccaccccggtgcaggtgctgggtctgacctccgtgccgaccgcaggcgacctgttcctggtggcctccgacgaccgtaccgcacgtcagatcgccgagaagcgtcaggccaccgagcgtgcggcccagctggccaagcgccgcaaggtcgtttccctcgaaagcctcaaggagcagttcgccaagtccgaggtggatatgctcaacatcgtcatcaagggcgattcctccggttccgtcgaggctctggaagattccttgatgaagatcgaggtgtccgacgaggtcggcatccaggtgatccaccgcggcgtcggcgccatcacccagaacgacgtcaacctggccaccgtcgacaaggccgtcatcatcggcttcaacgtccgtccgaaccgccaggtggcggatctggccgaacgcgaaggtgtggagatcaagtactactcgatcatctacaaggccatcgaggacatcgaagcatccctcaagggcatgctcaagccggaatacgaagaggtcgtcacctcccactccgagatccgcgagatcttccgctcctccaagttcggcaacatcgccggcgtcatggttcaggacggcgaagtcaagcgtggtacgaagtgtcgtatcctgcgcaacggcatcgccaccgtcaacgacctcgagatctcctcgctgcgtcgtttcaaggacgacgtcacctccgtcaaggaaggctacgaggctggcatcaacctcggcaccttcaacgacatcgagatcggcgatatcatcgagaccttcgaaatgcaggaaatcgagcgtaagtagccgagtgcttcgagcttcgcatcgataaccaggtaaggaacgcccacagccggttcacgactgcgggcgttccgtgatacaacaagaacttttcaccaaaaggacagcaatggcaggaaccaatccccgcgccgcgcgcatcgcggcgttgattcagcgtgtgatcgcatcgtccatggaggcgcagctgcacgacaagcgactggccaacgtgaccatcaccgaagtgcgcgtcaccaacgatctgcagatcgcgaaagtctactggactcagctcggccatgaaggacacgagcagggcgaacgccgccgcgcgcagcaggccctgaaccaggccaaaggacgcctgcgttccctggtaggcaccaaggccggactgcgactcaccccgcaactggaattcatcttcgacgaagtgccgggcgaggcccatgagatcgaggacatcctcgcgctcgcacacaagcgcgacgaagaactcgccaagtcccgcgccaacgcgcaatacgccggcgacgccgatccgtacaagcacgacgagcccgatgatgacgacttcgacgatgatgacgatgtcgaggtcgaggattgggacgatgacgacgaagcctgacaactccggtctgctggtcatcgacaagccgcagggcgtcaccagccacgatgtggtcgcggcggtgcgtggcgccctgcacatgaaacgcgtcggccatgccggcacgctcgacccgatggccaccggcgtgctggtggtcggcttcggcaacgccacacgtctgctcaactacatcgtcgaccacgacaaaacctatctggccaccatcagactcggccagcgcaccaccacggacgacgccgacggcgaactgctgccgggggagggaactatcgccgaattcccttcacgacagaccgttgaagacgtcatcgcccatcatttcaccgggcgcatcgagcaggtgccgaactcctattcagccatcaaaatcaacggccagcgtgcctatgatctggcccgagaaggcaaggatgtggacctcaaggcccgtccggtgaccatctcggaattcagtgtttcggcagtgcgatacggctatgcttcgaccacatgcgcgggatcacctcttgccgatgccatcgaaatcgccccggaggaatcctggcatgccgaaaccgacgggcaaaacgaaccgaacatgcagccagtcatggaactcgacgtgaccgtgacctgctcggccggcacctacatccgcgcactcggccgcgatctgggcgccgaactcggcctcggcggccatctgaccatgctgcgccgcatccgcgtcgggcgtttctcggtggacatgccgaacgtcatgaccgcccatacggaagctaagaccttcaccaaccgcgaaggcatcgaagtgacacgcaaccgtgcggtgcttgacgatgccgagcatgccgttgaccacacactcgacctggtcgccagcgcggccgcttccatggacatgcttcccgtcaccgaacaggaggcgacggacctgcggttcggccgtagaatcgcccacgacatccatacgaccatggccgcgtacgttcccgaaaccaacgatctggtggcgatcgtggaacgcgccaaacgtggcgagaccaagccggtcgcggtcttcaactgaaacaatcaagaccggccggcacgcaatacgaacacgacaaacacacggacaatacgcaaagaaggacacatgaagacgatcacgcttacccccgatgccagcggcatggtggattggccgaccctgagcaacgacaagaagtccgtggtgaccatcggctcattcgacggcatgcatcagggacatcaggcggtcatccgccgtgtggccgaactcgccgaacaggagcaggcgttctccgtggtggtgctgttcgacccgcgtcccgcgctggtgcacgcttacgccgccaaacatgacggtcaggaaccgcccgcaggcacgcctgacacgcaggcgctgaccagtgtggacgaacggctgcgcgccatcgacgccatcggcgtggactacacgctcatcgtgcgctacaccatggcattctccgcgaaatcataccgcttcttccttggccagatggtcggcaaactcggcatgcgcacgctggtgctcggctccgacgccgccatgggtgcgaaccgcgccggaaacgtgaaggccattgagaatctggcgctcgccaccggcgtgttccagctggaggtcgtggacgattttggtccggggctgacccgagtgccggtcaatgcgaagccggtgatgccgtccgaacccggcgagccttccgaccctctggagggggcttccaaggccgaacgacgcgcatggagcaagaagcatcaggccaaggaagtgcgcacgtggagctccaccaatgtgcgctatctgctgagccaaggccgtatcaaggacgcagacgcgatactcggccacgcgcatgccgtggaaggcaccgtggtgcatggcgaggaacgcggccgcaccatcggattcccgaccgccaatctgagcgagaacgtcgccggatacctgccggtggacggcgtgtacgccggctggctggtcgatttgggggagaagtccgccgacggtggcgaagaagccggggagaagccggccgacggcgtatcgcagcagtatgacgcttcgtccgtcaacgcgcgcgtggccatgcagtcgccacaccgctggccggcggccatctccatcggcaccaagccgacgttcaacgaggacggtgacgccgaacgcgtggtggaagcctacgccatcaccgatgactggttggacctgtacggccatcaggcgcgcgtggaattcgctggattcctgcgcccgcagatcaaattcgattcggccgacgatctggtggtcgagctgaaacgcaacgtcgaggagacgaagcgcctcaccgcttgagacgaatcggttcgattgatttgattggttcgattgacgcgaatcattgacgccatctgtgttttgttacccaaacgggctttcccgggttgcaaaatgcggatggcgatgccgtttgggcatcggcgacctatcgcagaatcgcggccaacgcgtcctgcaacgtatccgcctgcaccacgcccattcccggcacggcgacgttcttgcgcagcgtcggcacaacggcggtggtgaaaccaagacgcgccgcctcacgaagccgatattccagtctcggcaccggacgcacctgtccggtcaacgaaatctcgccgatcgcgcacgtcgtgcggggaatcggtttcgatttcgcagcgctcgccaacgcggccacaatcgccagatcgcaacccggctcacgcgcctgaccgccggcgattgtggaaatgtacaggtcgttggccagcagattgatgccaccgtgacgatataacaccgccaccagcatggcgatacggttggagtccacaccgttcgccgcacgacgtggcgtcggcagcaccgacctggtgaccagcgcctgcacttcaatcggcagactgcgatgcccatccaacgtgaacgtcacgcacgtgccatccacctgcgtcgccgcagaaccattgccggttgataggaacaggccggacggatcggtcacctcctcaatgccctcgccgctcatatcgaaacagccgacctcgtcggtcggtccgaaacggttcttcacggcgcgcagcatgcgcaacgcggtttcggcatcgccttcgaactggcagaccacatccaccaggtgctccaacgtgcgtggacctgcgatcgaaccatccttggtgacatgacccaccaaaagcactggaatatcaagggttttggcggtgtcaatcagcgcgctcgccacttcgcgcacctgcgtggatccgccggagatgccatcgacgtcctgcgagacgatggtctgcgccgaatcgacgatggccaacgccggcttgaactgttcgataagccccaacaccgtggacagatccgtggtggaggcgagcagtagattcggttccatggcgccgatgcgcgacgcgcgcatgcggacctgcgcctgcgattcctcgccggaaatatacagtacggtattgcgctcggtggcgaacgccgtcagcctcgccacattgccggcggtttccagcagcaatgtcgatttgccgatgcccggctctcctgcgatcagcgtgaccgatcccggcacgatgccaccgccgagcacgcggtcgaattccgaaaatcctgtggcgattctggagatgttctccgtgcctatgtcggtgatcggcctcgccgcggacgatgcgaccggatgcgattgcgtgcgcgaggtccgtcctggagccgcggtacgcgagcctgccgcgggacgggcttcatggaattcctcaatggtgccccattgaccgcattcggggcagcggccgagccacttcgggccgctccagccgcattcggaacagaggaattgcgaggacgtctttgccatatcgccgacaatacggaggttttgggacaagacgttcgcgggtggcgtactcgttgcacagacattgcgctgaaaaccgtttcgggaactggattccatgacttcgaggggatggttgcgcgtcttatggctgtgaaagaatgacaagcatgtctgatacgcagaattcctcttcgcatggcaaattgattgccgccgtcgtagcagccgcgcttgtggttgtgcttgctctgatttccgcatttgtgtggcctggttgggccttgaacaagaacggacaggccggtcaggccggtcagacgagccagcaggcttccacttcgaacggtacggacggcgacaagacggagcccaccaaaccgtcgatcgatgccgtggcattgcccgacggggccagcgagctgctcaaggccatgccggattccgtattgaattacgcgcgtaccaaggctgacgccagcacgacgtggtccagcacctctcccgtcgaggaatacgcgttgacgtattccaccggcaagaaaggacaggacgtcacgctggaagtgggccagtggaacgacggcgacaaggcgaaatcccagtacgacacgctggctgaagccatgaccggcaaagagctgggaagcggcaacgtgaaggtctccggcaagacgactggcgcctacagcgccaaagccgatccggacgacgataccaaggccgttgccgtgtggcgcaacgatacggtggttttctatgccaccggcgcgaagaacgacgtccagcgtttctaccagcagttccccctgtaacgtcgacggaatcgtctcgatggcgaatcgcggccggctgatggaatatcacgcggaaaacgaaacgtgattttccaccatatgaatgcctgcgcgcgtattcgtccccgaagcagtgtagtattgggcaagttgcaaacttttaccctttgagtttaaggaacggaggctgagatgggctcggtcatcaagaagcgccgcaagcgcatgagcaagaagaagcatcgtaaactgcttcgtaagactcgccaccagcgcaagtagtcttcaggcgcgtgtgaagcgtccgctcaaacaaaatcccgcgattcctttcggagtcgcgggatttttgctatctgcgcggcggtgtcggccggtatattccgcaccagccgacacgcctgcctgtcaggatctcacttgttggggttgtccatcacgcgcgggccgttcggatcgccgacgatgacctggtccaccatgttcaggaacaggccgtgctcgaccacgccgaccgtggtgatgaggtcctgcgcgagctcctgcgggtggtcgatgcgctcgaggtgcagatccaccacatagttgttctcatcggtgcgcaccggctcgccgttcgcgtcgagacgcagcaccggcttgtagcccttggcctcgaacttcttgacgacctggcctgcgccgaacggaatcacctcgaccggcagcgggaacttgccgatggtgtccacgaccttggactcgtccacgatccacacgatcttgttggagttggtggccacgatcttctcccacaggagagccgcaccgccgcccttgatgccgttgaagttcttgtccacctcgtcggcgccgtcgatggtcacgtcgatatggtcgacgtcatcgatgttgacgatcttgatgccgtagccttcggcctgctcctgggtgcggcgggaggtggtgacgcccgtgaactcgaggccttcctccttgacgcgacgaccgagctcgtcgaccaggaaacgcacggtcgagccggtgcccagacctgcgatcatgccgttctgaatcagctttgcagcctcgatgccggccgccttcttcagcgcgtcctgctgtgccttgtccatgatcctccttcgatatggggttaagaccgtctccatactatcggatgcgttgattttcaaggcgcgaatggtcggttgcgggagcaggtgtctgttttggactgcggaaaagttttcacggaatgtttcacggtcctgcgtgaggtggcgtgcaaaaaagccgcgcatgaaatgacatgtggggagcggcttgcgtaaagcggctccccacatgtctcgctcagctatgtttgaccgcgaacggcgcctcgtccaataccagcgtgccgtcacccatcacatagccttccacggcgatatacccacggatgagacgtggattgccgtcgaaggtcgggctggattccggtgggggagtgaaccgcaccgtacccgacaccgacaggcccgatgggcttggacgatgcggcagtttcggcagatcctgcgattgcgatgaagctgcctgttccgatgccgattcttcgtcgtcttgcgattcgctgtgcgattcgttcgcattctgcggtacggccgtgctgtccgtgtccgtgccgtccgcgttgcccgtcaccggcttgtcgttctcgtcgccttcacggggaaaatagtcgggtttgaccagcatctgcgcataggattgatgcggttcaccggattcgtccgttttcccggattcgtctgtttctccggattcgtccggttcggctggaccgcccgcgtccgggaagctggattcgggtatgaccttcgtcgcttcggtctcaagcattgtggtggtttccgccggttcggtctcgagcacggtcgtttccaccgcatcatctgcgtcgtcatcggttgtctgtccgaaatccgcaaggtcgtgggaaacgccttccggctccgccagcatgctggcgatcgaacgcggcttcgtgctgttgctggaattagcggtatcggcaccggaatcgccggtgccggtcgtggcggaatcgccttgtccgcgtcccatgtggtattcggcggcgctgatcgcaccatccatcagcatcctcgcatcctcgggaacatcggtgccacgcgaatactcggaagccagtagcgactgccatccttccaacggcagatagccttcgcgcacatgcgaacggcaatcgcccgcatacgtgcgtgccagctcgtccactttctcgttgcccgcgttgccggcatgacccttgacccacacgaatcgcaccgaccccgccctatgtgcgatctcattgtcgatggcgcggatcaaatcggcgttcttcaccggtttcttctgcgaattcttccagccgttgcgcttccaaccctgcacccacttggtggagcagttgatcgcatactgcgagtcggtctcgatcaccaggtcttcggaaccgggatgcgctcgcaacgcctccagcacggcgcataattcgccgatctggttggtgccgttcgtcgcgccgccggcatcgcaatcgccggcatgctcgtgccccggcttgccgcctgccgcgggctcgtggtcggcccaggcccaacccatcggaccattcggattgccaagcgcggaaccgtctgttgaaaccgtaatcgtcatgcttctaccctacgaaagccgcgcgactcgccgcttgcccgtcataccgcatggcaacggcatatgcgattagtcgccgagacacagcatgacggaggcgcggaacatgccgtcgctgtgctcgaaggaggccgtgccatggtgccgttcggccgtctctcgtacggtggcggtgcccagccccgtgccaccatgtttggtcgagacgagatcgccgtcgatctgttcgatgctggtatcggcttcgccgtacgtgttgtccaccgtgatgaacagggccgccggagggccggaacgataccggatgcgcactttgagccgcctctcgccctgcgtttgctgggtgatggcctccgtggcgttctccagcagattgccgaccatggagcataattccgcgttgttgatgttgatgtattgcggcaccgccgctttgacgtccacatccgcacccaaatgccggacccaatcgcaatagtagacaagcaccgcgttcagcgacgcatgctcgcaatactgcattggtgccgtttgcagcagccggtgtttggacatctcatccagatatgagcggatgccatccatgtcttcagccgcggccaacgcctgcagtgagtggatgtggtgacgcacgttgtgcttgatctgacgcgcctcacggatccgctcgttcatgtgttgcagctgcaacgtctgcaaagcctcataatgctgtcgcctgcgggccgcgagcagacggtccgactgctgaatcatgtaccagatgaggaaatacaccaacaccatgaaacaggaatagaccaccgccacggtgaacgcgatttccagcatatgcgagtccagcagcgtggaattgtccgccggcatgcaccacaccacaatcgcggacgaaacgaacggaaacagccagataagctgccagaagcctttgctgatggatggggaatcgaatgtggctggaatcgaatcatgcagcggatgccaaagcgagaccagtacgacgacgtcaagcagcagcagattgaccagtcccggccagccgacgcggagattggttgaatccgcgccaagaacggccacatcgatgacgagcgacagatagtagacgatcgccaccatgtaggaagccgtggccacaatcagcaacagttgccgccatggcagttcggtcagccatcgcaggaccagcagcacaagcggcgcggtcggaatgaccgtccacagtgatgggatgcccagagtgccgcacagcacgccgcatagcaggaaccagaccagtccgatggacatgaacagtgtgccgttacggcgtggattgtccatgtgactccatgccatgatgaggcacaatgccaggccggacaacgcgttgagctgctctccgatggcgaagaacagacctgacggggtggtttgggcgatgccgttccggatgatttcgccgagtggtgcgaacatgtcagtcctccgtacgcatgcgggtgaacgtgtattccgcgtatgcgcggcaggtggtggtcaccgccgttttcgtgataggaatgcgtttgccgcctttcatgacgaactgcgcgttggtgatgccggacacgtagtcgaagttgacgagcacgcctcgcgcggtgcggtagaagttgtcgaacacggtgagccgttggtccacgtcggagaaattggtgcggattttggtctgggtgccgtccgcgaacgtaaattccacgtagtgcgcgttggacagggcgtatgcgatgagccgccggtccatggtcacggccggattgccgaacgccacatgccagctggaattcaccgtgccgggcgactgcgcctttgccagatgggtgaccggcggttttgccttcagctgctcttcgacgcgttccatggtggcttcgaaggttttgcgattgacgggcttgagcagataaccgctcgcctgcacctcgtagccgagcaccgcgaaatcggtgctggacgtgatgaagacgatcgcgcagtcgtcgttctgattgcgcagcagccgcgctatgtccaatccggtggtggcatgcggcagattctcgtcgctgagataacagtcgagcagcagcaggtcgtaacggctgttcttccagctttcgatgaacgatttcgcgtcggggaaaacgtcacagaccgtttgcatggcattcctgccggcggttgcgccgacgttccggccgttgaagtattccgcgcacatggtggcgatcagttcgcgttcggcagggtgatcctcgacgatggcgatgcgcacgttccctccttgctgtgccgtgattgcgcggatgacgttccggctctgcttccaagcgtaccgggagagggaaatacggggtgccgcggagcttgcgtttcatgccagaaaagcacgtttcgtgccatacggcggatatcgacaacgaaaaagacccgctccatacggaacgggtctttttcgcgctacgccttgattacttggcggaacgccgtatcactcggccagagccttgtccacgacctcggtggcctcggcgagcaccttgtccagagcctcaggggattcgaagctctcggcgtacaccttgtagatgttctcggtgccggacggacgggcggcgaaccagttgtccttggtggtgaccttcagaccgccgatcttggcgtggttgcccggagcctcggtgagcttggcggtgatgtcctcgccggccagctgggtggcctcgacgtcgtcgccggtgagcttggcgaacttctgcttctgctcgagggtggtcggggtatcgacgcgcttgtaccagctttcgccgaaacgctccacctgctcctggtgcagctgggccgggttcttgccggtcttcgcggtgatctcagcggccagcaggtccggaatcaggccgtccttgtcggtggtccacacgcggccgtccttacgcaggaaggacatgccggagctttcctcgccgccgaacgcgacctcgcccttgaacagcgggtccacgaaccacttgaagccgaccggaacctcgacgagcttggcgttgatggaggcggccacgcggtcgatcagggaggaagacacgagggtcttgccgatgccggcgttctccggccaatccggacggttgccgccgaacaggtattccacgcacactgcgatgtagtggttcgggttcatgacgccccagttcgggcagacgatgccatggcggtcggcatccggatcggtgccgccgaccagatcgtacttgtcccaagcgccgttgttgagggaatcgaccagacccttcatcgcgtacggggagctcggatccatgcggatcttgccatcatggtcgatggtcatgaagctccaggtcgggtcgacctgcggacgcaccacgtcgatggtcaggttgtacttctcgttcatgagcggccagtagttgaccgaagcgccgccgagcgggtcgatgcccaggcgtacgccggaggagcggatcacgtcgaagtcgatgacgttctccagatcggccacatagtgctcacggaagtcgaaacgctcaaccagatcggacttgacggcctgctcgaacggcacgcgcttgacgttcctgaaatcgccgagcagctcgttggcgcggtcggcgatggcgttggtgacgtcggccggagccgggccgccggtgaccggatcgtacttgaagccgccatcggtcggcgggttgtgggacggggtcacgacgatgccgtcggccaggccttcgccggtgaaacgctgggtgccgtcggcggcgcggttgtgggtcaggatggcctgggacacgaccggggtcggggtgaagtcgtcacgggagtcgatgcgcacggtcacgccgttggcgacgagcacttcgatggcggtcttccaagccggctcggacagggcgtgggtgtcgcggccgatgtacagcgggccggtgacgccggccttcttgcggtattcggcgatggcctgcgtgatggccacgatgtgggcctcgttgaatgaggtcttcagggacgaaccacggtgtccggaagtgccgaaggagacgcgctgctccggaacgttcgggtcggggacgacgtcatagtactttccaatgacctcgtcgacattgatcagatctgctggggtggcgggcattcccgcattttttgcaaccataccttcattgtgccacgagtttgcgcggaacgcggaaagccatcccacaatgtgcgatgaatacgttttctttttgacgtctcggcgtgtctccagtatggaattggggtttcagtgtcccgatgcccgacgatttgcgcatcgcacgccgatagtgtattgtttctaacgaattcgactcatgcagggttgcaagtcaacatttttagacgcaagacctggaatgtggcattggtttgccatgttccgggtcttttttgttgcaaaaaagccgcgctgcgtcatcgaatcccatcggaaggaaatagaaaggaatcaggatggctgactctctcgcatcgcagatcatcactgcgatcggcggacctgaaaacgttcgcagtctgacgcattgcgccacccgactgcgcttcgagctggcggacgcgtccaaggtggaccagaacgccctcgaacatatgaagggcgtgcttggcgcggtcccgcaaagcggtgaccgtttccaggtcgtcatcggcggcggcgtggccaccgtatacgaaaacatcatgcatctgcccgaaatggcgaacgccggtgccgcctccgcatccggcgaaggccagaagagcaacgccgacgtcaaggccgaggcccgttccaaggcacgcggcaaggtggcatggctggactccttcttcgagtatctcgccgactccttccgcccgatcctgggcgtgctgctcggcgcctccatcatcatcgccctggtcaacctgctcatctcactgaacgtcattccgaatgacgaggcctccgccggctgggtgttcgtcaaggccatctggaagggcgtgttctacttcctgccgatcatggtcgcctacaacgccgccaagaagctcaaggtcgatccgtggctgggcggcgccatcatggccatcctcatgaccccgcagttcaccagcctgatggacgccaagaccaccacgtgcgtggagaacgcggctctgggcaccaagtcctgcaccgccaacatcttcggcattccgatggcgttgagcgactacagcggcaacgtgttcgtgccgctgctcatggccgccgtgctcgccctcgtctaccacggattgaagaagatcattcccgaaagcgtccagctggtgttcgtgccgttcttctgcatgatcatcgtcggcgcgctgaccgccttcatcatcggcccgatcggcgtgtgggtcggcaacggcctcggcgtcggcctggcttggatgaacacccatgcaccgttcatcttcgccatcatcatcccgctgctgtacccgttcctcgtgccgctcggcctgcactggccgctcaacgccctgatgctcatgaacatccagacgctcggctacgacttcatccagggcccgatgggcgtgtggaacttcgcttgcttcggcgccaccgccggcgtgctcttcatcgccgtgcgtgacaaggacaaggacatgcgccagaccgctctcggcgcgctcgcagccggcctgcttggtggtgtttccgaaccgtccctgtacggcatccacctgcgttacaagctggtctacaagcgcatgctcgtgggctgcggccttggtggcgtcgtcattgccgtcctcggctggctcttcccgtccgtcaccgccgccggccagaccgtgcatggtgtgaccaccaccgccttcgccttcacctcgctgctgaccattccggtcttcgaccagatgtgggtgtacgcggtgtccatcgcggtctccttcctgacctccttcttcctgatcatcaccttcgactaccgcaccccggaacagaaggctgaagtgctggcccgcgccgccgccgatcagaaggccgccgctccggcggtcgaagccaaggaagccgctccggctgccaccaccgccaccgcgactgctaccgccaccaagaccgaagctccggccgctgccgccgccgcgaccaccgtggtgaacgctccggtcgccggccacgtgatcgccctggacgaaaccggcgatccggtgttcgcctcccgcgcgctcggcgaaggcgtcggcatccagccgaccgacagcgaggtcgtggccccggtctccggcgtgctgcagaccgtcgccgaaaccggccacgccttcggcatcaaaaccgatgacggtgtggaagtgctcgtgcacgtcggcatcgacaccgtgaagatgaacggcgagggctttgccgtcaaggtcaaggccgatgagcgcgtgaatgccggcgatccgctggtttccgtcgactttgctaaagtgaaggacgctggatacagcaccaccacgctgatgacggtgctcaacaccgccgccctcacctccgtcacgccgaagaccggcatcgacgtcaaggcaggggacgaggtgatcgacatccagcgctaacctgtcacacagaggcgaaaaaggggtcgacgtggacgttcttcgcgtattcaacaacaatgtcgtattggctagagacggtgatcgtgaggtgattctcacaggccgtggaataggcttccaagccaagccgggacaacatgtggatgacgcgaagatcgtccgtcggttcatccccgtcgatggcaaggatcccgaccacatggcgcaacaagtggccgggatcccgcccgaaatcatcagactcgtcacggacgccatgaaccgtacgggactgaaagaacaggcagacaagcagccaaccctggtcatggcgctcgccgaccacatctgcggcgcgatacaacgcgcgcaaagaaaacagaacatcgaatatccgctcgaagcggaagtacgttccctatacgccgacgaatacgccaaaggcgtggcgatggtcgacgcgatgaacacgtatttgggtggcgcgttgccccgcagtgaggcggtggcgctcgccttgcatttggtgaatgccggattctccggcggcgacctgtccgccacctacaccatgaccggcatcatccagcagatgatcgccgtcatcgaaggcgcgtacggcatcacgcttgcgcaggacagcgtcaatgtggcgcgattcatcacgcatttgcgttacctgttcgtacgcatccaccagcatgagcagctcgacgatgagccgcaaccaatcatcgaatcaatcaaaacctcatatccgaaggcttgccagtgcgcaaggcagcttgccgtggtggtgaagatgcgtcttggttccgaccttacggaagccgaaatcgcctatcttgccctgcatgtggcgcgcgtgaccaacggagtgaatcggcaggacgactgagtttccggtatcttccgatattcagcagcccgttccgcgcattcctgacggttcctaatcgttcgactgttcggccggctgcccgcttgcctgttcggtcggctgcggtttcgttggcgtagccgacatattcgcgttcaacgccagtatgccggtatcttcggaagtggcctccggcacgcgcacgcatagggcctgacgttccacgctgaaacggatgtgcttcgtttcaggcagcatatcgccatccacctgcgccaaaacaggcctctccaaagtgatttccgcgctgacgccctgcacctggtcgacggtggagttcgtggacagcggactctgctgagctttgccggtgatggtctggtgcagcacgtcgccgaacagattcgcccaaccgatcaggccgccggacgtgtcgatgatctcgtagtcgaggatgccatcgtcataggaagcttcgggcatcagcgaaaacatggggatctggccgcaattgcccgccatgaacgtgcggaacgtgagaccacgcgtggaatgcgtgctgccgtcggcgctggtgatggtcacattgcccttgtacttcggggcgaacagattcttcacgcccgacacgaaatacgccagccagctgatgttcttcttcaattccggatcggtgtcgtcgatcatcagtgcgtcgaaaccgatgccggcgatgatgaggaacgcatgcccgtggtcggtggtctcatcatccagaagggtcagacggcccacatccaccagacgggagccgtgcgacgtggccacggtgagcgccgcatcgatatcgtccacgggaatgcccatattgcgggcgaacagattgccggtgccgatcggcacgatgcccagcgcatgcccggtacccgacagcgcgctcgcgacggtacgcaccgtgccatcgccgccgacagccaccaccacatcggcaccatggtccaacgcttcgaacgcgcaggcgcgaccgtccttgtcgagctgcgtttcgatgaattcgatctgggtgagatgcttcgcctcgcagaactccttgatatgctgcttgcgctgttccgcctggggctttgaaggattgactatgaacgcgtaatgcacttggtcatcgtcacgcttgtcaagcttctccgcgagcgtacggtgcttgtacgcgcggtatccgaagaaggcggccgcgcatacggcgaccacggcgatgatgacgagcaggacgataactggcataggcatgcctctattgtctatgcgattgcgcaaaaagacgaattcgacatgaaaaattcggcgttccctcacgttatatccaaaaatgagaacgatggcgtcagtgtctgctttcggcactaggctgggaagcatgcttgatattcaattcattcgtgaacatgctgacgttgtcaaggaatcccagcgtaagcgtggcgaatcggtcgaactggtcgacgaggtgctgcgctccgacgaggttcgccgctcctctctgaaggaattcgaagctgcccgcgcgcagcagaaggagatcggcaagaaggtcgccgccgcccccgccgacgaaaaggccaagctgatcgccgcaaccaaggaactctcccagaaggtctccgaatacaaggccgcagccgacgccgcagccgaggaatacaccaccgccatgtggaagctgtccaacatcgtcgagccggaagctccggaaggcggcgaggatgattacgtcgtcgtcaagaaggtcggccagatccgagactttgcgtccgaaggcttcgagccgaaggatcatctgactctcggccgcggcgtggccggcatcgatatggagcgcggcgtgaaggtcggcggctcccgcttctacttcctgcgcggccaggtggcccgtatgcagatcgccatgctgaccatggccgtcgatcaggccgaggaacacggcttcaccctggccatcaccccgacgctggtgcgtccggaagtaatgcgcggcaccggcttcctcaactcccacgccgacgaaatctaccgcctgcgcgagccggacgaccagtatttggtcggcacctccgaagtggcgctcgccggcatgcacgagaacgagatcctgaaccttgagaacggcccgctgcgctactgcggctggagctcctgctaccgccgtgaagccggcgccgcaggcaaggacacctccggcatcatccgcgtgcaccagttcgacaaggtggagatgttcgtctacgccaagcaggaggactcctacaaggagcatgagcacctgttggccatggagcaggaaatgctcggcaaggtcgaggtgccgtaccgcatcatcgataccgccgccggcgatctgggctcctccgcggcacgtaagttcgactgcgaggcttgggtgccgacccagggccgttaccgtgagctgacctccacctccaactgcaccgagtatcaggcccgtcgtctgaacatccgcgaacgtatggaggatggcaacacccgcgccgtctccacgctgaacggcacgctggccaccacccgttggctggtcgccattctcgagaaccaccagcagaaggacggctccatcgaaattccgaaggccatgcgtccgtacatgggcggcaaggaagtcatcgagccgaccaagtgggaagcctgattttccaagacgttcgcgtctgatatgaatccgtgaaagcggcgttgcatttgtgccggcgccgcttttcgtatgttggacggtcccagtgccgtttgtgtcgttctgggcagatgcgtgtgcggttttctgttggaagcgacggggatggaggctgtgccaggtgtcgcacttccgcgcactgtggtatattggcgtttcgtgcgtagcagcgatgttaggcgcaaagggtagatgtctgagcggtctaaagagacggtcttgaaaaccgttgaggtgcaagcctccgcgagttcgaatctcgctctgcccgcatcaatcaagggcttaccgaaggatttttcggtaagcccttttccatgccgtttatggcgattgtcgttgtcgtggcggcaacgtcacacaatccgtcgatccgcggcccaacgggtgagctcggaacggttcgacagctgcagtttgcgcagcaccgagctcatatgggtctccacggtcttgatggagatgaacagttccgaagccacctccttgtacgtgtagccgcgcgcgatcagccgcatgacctcctgctcgcggttggacagccggtccagttcgtcatcgtggatcgggccgccgaacgcgccgttcgcgctcgggccgttctggaaggcggacagcacgaatcccgccaatttcggcgagaacacggcgtagccctcatgcacctgcttgatggaggacaccaggtcgtcgccggaaatagtcttcgtcacatatccctgtgcaccggcgcggatcacggaaccgacatcctgcggagaatccgacacggacagcgcgaggaagacggtatcgggggagtatgcgcgcgatttcgtgaggatttcggcgccaccgccgttctcgccgcccggcacatgcacgtccagcagcaccacgtccggtttggtctgcgcgatcatcgccactgacccctccacgtcggccgcctgtccgaccacgtcgaaatacggctgcaacgtggcgatcacgcccgcgcggaacatctcatggtcgtccacgacggcgattctgatgcgctgttcccgctcgctcattcctgctccttggttcgattgattcattgccgcacctgctgcatgtgccgtgttcattgcgccgattgcacgcccgtatcgccgtccgctgtggtggtcgtagcgctgtccgcatcctccgccgctcctgaaatcggcatgtgcatgcgcacctccgtgccccagccgggcctcgacacaatctccactgtaccgccgcggcgcttgatacgtccgatgatggactcgcggatgcccaggcgattcgctggaatggcgtcgacgtcgaagccgtcgccatggtcgcgtacgaacacctccaccagcttgtcgccggcctcgcagtagacggacaccggttcgccgccatgcgtcacggcgttgacgagcgcctgctgcgtggcatccaacaacgcgtcggtctgcgcgctcggccgtgcatcgcccaccgtcaccacctcgatcggcttgccgtgcgtgtcctccacatgcgctgcgatctgcttcaaaccggcgttgacggaacggtccgacgtggtgcgctcctgatatagccattcgcgcaactcgcgttcctgctgcctcgccagtgaaaacacggtctgctggtcgccggcatgcaactggatcagcgccagcgtctgcagcacgccgtcgtgcaggtgggcggtcatatcggcgcgctcctcctcgcgttccttcagcgcgcgttccgtgcccaaatcacgcaccagcgtcataatccacggcacaatcgccagcaacacgccgacaagcagcgccaaaccggcgacgagcatggtgaacgtggcgtgccgtgcggactgcataatgcgcacgtgggtggcgatgtagatcgcgtacgcgacgaaaatgaccgcgatgccgccgagcatcgtccataattggccgtccttcgcgttgaaccgcagccaggagacgccgacgccgaccacgccgagcagcaacggcacaatcagcgtgccttcaatgcctttcgccgccatcgccacgcataggcccagcataagcagtcccgccatggccagcagcgcgggtctcggcgcgttggcgaacatctgttccaggctttcggacgattgtgctccgctgccggattgcatgccgtccgcgttgccgtcgctgtcttgcgattgcgcgccgccgtttccgacgttccttaggtttcttacgttcctcacgttgccgtgggacagcggcgcgttctcgacgggctggctgccggcgatgacgtacgcctgctggaccgggtctccgacgggtacggtgatccacagaaaaatataggcgatcgcgcccgcaccgaagaaaaacgtggtgaccacgaaaatgaaacggatgagatgaacggacacgcccagatgcatgctgacggccttggccacgccagcgacctcgcggccgtacgtcgggcgcagcaacggcagtcgcgccggcttggacggcacgggacggccttcgcgcagggcctgcacgtagcaccagcgcatgtagaccgcgctggcctggtcgtactgttcctgcgtgtatcgcggtttggctaaggacttcatgcttccattgtgccctgtcggggatgccgattcagggctttcagctggtgttcagggcagattcagggtgttccccgatacgtatgacggctgcggattgctgtaatggagatatgagcaacgcaaacaacaatccgcaaggcggcagtgccgctggttctgccgaaccgcaatcgcagccacggccgccgatgtatcagccgcagccgaatcgcggcaatcgattcttcgcatggatccgctccagccggatcacgcgcggccgcaaccggtggatcgcaggcgtgtgcgacggcgtggcgcgccgcttgggatggaacgccaccctggtccgcgcgctggtgattctcacctcgctactgttcggcgccggagcggcgttctacgcattggcctggttcctgctaccggacgagacggatggccggatcctgtgcgaggagctggtcaacggccattgggattggaactgcgcgggcgcgctggtatgcgccgcggtggcgctgtgcctgcccggcgccggatggctggcgttcggcgtggccgtgttggtgttctggctgctggtgaaccgccagtcgtatgcggcgagctggcagacgccgcagcagggcggatcgtggcctgggcagcctgctcagcccgttcagccgggacagccggtgcggcctgcgcaatcgctatatatgccgcagccgatgtccacgaacacggccaccactgcaaacatgcccggcacgccaggccagccgatgccgcggccgacgtgtcccgcgccttccggctaccagcagtacgcgcgtcccgtccaatcgccataccagacgtttcagcagccggtgaacccgcctgcagcgtttgccgcggccaatgtgccgccgaccttcaccgctccgccgacggtggcggcgccgcagtcgaaacgcgcccgccgcaagccggccggaccgctgctggtactggtgacgcttggcttggcattgctggcgatcgccggatctggctggtacgccattacgatgccggttgattgggattacgccttgcgcgtgctgcgtctcgccacactgtgctgcggcggcatctgcctgggaatcggcgtggtgatcgtcgtgcttggttgcatgggccgtcgcaccggcggcctgcatccgctggcatggtgcgcggcgttcatggccgtggtgatgacgttctgcacgagtgcggtggcatgggaaagccgcgattggatgatgtcgaatgactaccaccgcacgacggtctccggcatcgtgacatggagcgacaccagcgacgcccagatgaaacgatacgaacagggactggtggtggtcggcaagaactacgccaacgatgtgctcgacatcgatttgagcggatatccggcagcgcatggcaagcacaaggtcaagctcaacgacggcacgtacggcgaaagctcatgtccgacagggaagctgaatctggtggtggtgaacgcccaggtggtggtcacgctgccggacggatgccagtggtcggtcagcgatccggacgacggctacaccaacgtcacggattacataggagggccggacgggattacgttcttcaacggcacgggcttcatgggcctgtccctcgatgagaacgatgattcgggactcggccatcatggcgtgaacaagggcgttccggcgctcaacggcaccaccgatttcgacgattccggcgatgatgatgcgggcgatgccggttcggatacggagaacgattcgcaggattcggtatacgccggcacggatctcgacaaggcattcaaaacgatctacgagaacaagtggtattggccgtcgatcgattcggacaaggctccggaggaaccggatctgtatgtcaacgtcgatggaacggtcggcggcagtgtcaccatgcagtacacgtccgacagcaagctgccagtgggaacgacggtcggtcaatcgcatggcagcgtcgatggaaagaacgtcgggaaaagcgccagcggaaaggaaacgaaatgagtgacgagaaaacccgtgaagtgccgttgaccgacgtcatgggaatcgcgggggtctcggacgagcccacggaaaccctgccggccgtcgacgatccgggcgaggcgaagaccgaatcgttccagaagccgttcgacggcggtccggaagcgcagaggaagttcgaatcgcaggacgaggccgaatcgctggaaacctccggacaagacatgcgcggaagctttgcgggccgttcggcacgtccgaccggttccgtcaaatcggctgatccagccaaatcagccgagccggtcgacccctccaagcaagtgcgcatcggcaaaacggacggcgagctggtaatccgcccgtccggaccaagcaccggaaccatcgtgctgggcgtgttcttctgcctgatcggcctgatgtccatgctgtgcctgctgcccatcggcgcatggcggtggatgccgaatccctcgacgctgttcttctacgtggtcggcggtcttggcgcgctgctgctcatcatttccgtggtctgggccgtcgtcgccgcggtgcgtctgcgccgacgggaacgccagtcagcagaacagtccccagaaagccagcagcgccaacgatagcgccgccgacaccaccacacacgtggccacgatgacatggccggatccgatgcatgcttttccatcttttcctatatcgcatcggcttccggctgcggcatcgtggccattattcatatccgcatcgtcatctatgcttgcaatcgcgcgattcctagcatgacgacggcacgcgtccacgatgatttccgccaacagccaggcgaacgcgacaaggctcagccatgtgagcatgacgatggcatgccagttcttggcaagcaccgccgaattgtcggtcaacgagatcgcatcaatgatgacggtgaccagatacgccaggaacacgccggtcgtgccgacggcaaggagggtgttgagcgccagtgcgacgcgcatgccggccgggaatcgatggtcggttattgcgattggacgtgtcgcattcggttgtgtggatggacctgtcggtgtggtcgcatccgttgaaaacattgaagtcgaatccgttggctccgctggttccgtcgaagccgaatcgtgcgatacccgccgtgacgcacggcgctcgcgcacccagccagcgatgagcagaattggcgcgccgcacatcgccagcagcgcgcagagcaggcaaaccgcgattgcgccgacaatcacacccatcgacttcaccagcgcgggcggggtcttcagcggtgccgtgaccgtctgattcggctgcgttccggcgatcatcggcgttgcccagccgttcgcacccgtgccgctcgtcaccgcgttgatccaatcctccagatcgtgcgtgtaatgcggttccaacggcagtcccggaaccgtctgattcgaaccggttcgaagctgatggttcgcgtcataataccgcagcgtcacattcgtattgccggcatggttcgcggcttttgtcagcagttgcgcgccctgctcgaccggcatggccgtatcttgcatgccatagttgataagcagcggcatggtaagcgatgtgcggtatttggccgcgtcaaaatccgcataggcgagtcccatgcgttgtgtgccaaggctggtgatgcgcggaataagctgcttgacggcatcgggtgcgcccgcggcggtcagataattggtggctgcgagcgtcatctgctgacggcccgaaacgactgggggagaggtgaggatggcgaaggcaagatccggatgctgttgcgtcagcacggtggcgatccatgtgccttccgattcggcgtagatgccggtttccgatctgctcacgcccggccattttctcaggatttccagcgatttcgcatagtcgtgcgcgctggacacgtagtcgcggtgcagcatggtgtagttgtcgagccgcttgtccggcacgagagtggtgatgccggccgacgccatcgcgttcgccacgtcgccgaacgcctccgacgatttgccggtgcccgaaccgtgcaggaacaggcatgcgggacgatctgccggcgcgtcgagcggctcgcgaacgatggcattcacggttttgccgccgtccaacgcgaccgtgatatgcgtttccttggtgcggtacgcgccctcctgcggggttttgagcacggcacctgtggccgggtcaacggcttggatagcggtattggtcgtggtgagcgtgatatggtccgtgaacggctcgacctgccatttcggcgccatcgcattgccgagcgcgcataggaccatggtcagaagaagcgccagcgcggtagtcgccgcgcaggtgacgagaattcgtttcacaatgcttcgcacggtacgccactctagtcgtattcggcgtacgtggcgcggaaaacacggaatcatggggaatccgcggaacgatcgcaattcctgcgccgcgagtcaatgctcccgtgccgtaaaacaatacgaaatcaggggaaaatcgcaataatgccctccacaatccacctgtggatatgtggaaacccgtcggtttcgccgcacctttccgccaaaccgacgctgagcgtcctccagtcgtcggtttgatattgcgatttccgccaaaccgacgcttagaccctcctcggcgtcggtttcgcggattgggggcgatgggatcgacgctgagatgggatttgggggagaaggatgggaaggttgggatggggctaggcgcgggcttcgtagcgacgggtgtagagcaccagcaggatgacggcgagcaggctgatcggcgcgcctgcgatgccggtgaaatggtaattcatcgccgtcgcggtcagtgccgctccgccgacgatggaaccgatcgcattgccgaaattgaaggcgatttgtacggcggcaccggcaatcagctcgccgccgccttcgcccgcctgcaccatcagcagttgctgtggcgatgaattgaagaacagcgcgaaaccgatgatgaacgtcagcaacgcggtggtcgcatgattaccgggcaacaggaagaccagcaacagtccgcacaaggcgatgccgtgcgatagcgccgcggtcgcgcccgccttccacaggtcggtcagcctgccgcccacgatgccgccgaccaccatgccgaggccggcgagcaccatcagcatcggcaccatcgtcgccgaccatccgccggttttctgcaaccacggcgacacgtagctccaccagcagaagatgcccgaattgccgaagaacacggccagcagaatcagccacgggccgggatgggtgaggaagcggaactgccccttgatgccggcgtccttgatcggatcgatggacggcacccacaaaatcaccacgacgatcgtcataagcgcccaggcggccagaatcgcaaacgccagccgccaggacatcgcctcggcgagcaacgttcccgcgggcacgcccagcatgttggccaccgtctggcccatcaccatcatggacacggattgcgcctccttgcccttgtcggcaagcgttttggcgatcagcgtggccgtgccgaagaacgcgccatgcggcaggccggaaatgaaacgcgccaccagcagcatcggcgagcagaaggagacggcgctgagcgtgttgccgaccaacgcgatggccatgaacaggatgatgagatgcttcggcggcaccttgcggccgaacaccaggatcagtgtgccgacacacacgccgatggcgtatgcggagatgtaatggccggccgcgggaatgctgacatgcatggcggtggccgtctggggcaggatgcccatcatcacgaattcggcggcgccgaggatgaaggcgccggaggccagcgccagaatgcttctcttcatggggattccttattttggattgtccgccgaaccagcacttggatggtgccaagcgtcggttcgatattgcgattcccgcgaaaccgacggtgagacggtgccaagcgtcggtttgatggaaaggcaaagaaaaaggcggaaccgaagttccgccttaattgtcgggctggcgggatttgaacccgcggcctcttcgtcccgaacgaagcgcgctaccaagctgcgctacagcccgtttggcaacagttggatatattacacgattgggcgctgtatgcaaggtcggcgtgtcgcgtgttgtgtagtggcttctcggtacacttggggcttatgactgagaccaacgaatcccaagagaatcagaacgaagaagaggccgcagttcccaccatgaccacggtggaacgcgccgaactgctgcagcagcaggatgctgcgattcgcgccaagatcaacggcggcgccgcgctggacgaggccgtggacccgtccaataaggaattcggcccgctggcccacccggagcaggtgcagatgcgtgtggccaagcgcgccatgatgcttaaggaaggcatccagccgtacccggtgacccttgacgtcaccgccaccatcgaagaggtccgcgccaagtatgacggcaagctcgaagcgggcgacgagaccgaggacgtggtcggcatcgccggccgtgtgctgttcctgcgcaacgcgggcggcctatgcttcgtgcagctgtccgccggcgatggcaccaaaatccagggcatgatctccaagaaggagatcggtgccgactccctgaagcagttcaagcagctggtcgatttgggcgaccacctgttcatcaagggccgcgtgatcgcctccaaaaccggcgaactgtccgtattcgccaccgaatgggccatcgccgccaaggcgctgcagccgttgccggccctgcacaaggagctcaacgaggacacccgcacccgcaagccgtacatcggcatgatcgcggacgagaagatccgcaacatggtgcgcaaccgttccaaggccgtcgcctccctgcgcaagaccttcgccgaccatgacttcctcgaggtcgagaccccgatgctgcagaccgtgcacggcggcgccgcggcccgtccgttcaccacgcatatgaacgccttcgacttggacctgtacctgcgcatcgcgccggaactgttcctgaagcgttgcctcgtcggtggcatcgaccgcgtgttcgaaatcaaccgcgacttccgcaacgagggcgtcgacgccacccacgccccggaattcaccatggtcgaggcataccaggcctacggcaactacgacaccatcggcgcgctcgtcaagcagctcgtgcaggacaccgccatggacgtgttcggcagccacaaggtgacgctgctggacggcaccgaatacgacttcggcggcgaatggaagaccatcagcatgtacgactccctttccgaggccctgggcgaggaaatcgtgccgaacggcggtccggacaaccccggcacctccgtggagcacctgggcgagatcgccgacaagctcggcgtggaacgcgacgacgtggagaaccacggcaagctcgtcgaacacctgtgggagcacttctacgaggacaagctgtacgagccgaccttcgtgcgcgacttcccggtcgagacctccccgctggtcaagggccaccgttccaaggccggcgtggtcgagaagtgggatctgtacgtgcgcggcttcgaactggccaccggctactccgagctcaacgacccggtcgtgcagcgcgaacgcttcgtggcccaggccaaggacgcgctcgccggcgacgaggaggcctgcgacatcgatgaggacttcctggaggccctcggtgtgggcatgcctccggcaggcggcatgggcatgggcatcgaccgactgctcatcgcactgaccggcgccaccatccgcgagaccatcaccttcccgcttgtgaagccgctgaattaacgcgaagcgttaattcatatcggcttcacgtgaaggcggatcaagagaacagcccggtgggctgttctcccgccgtaaccttccttttcggttgaagccactgaattaaggcgaagcacagttcgcaataaatttgatacggactaaagggactgacgacctactcggccgtcagtcccttctgtttttggctggcggcgggtccgcgtgcgcatcaaaaatcatgatgagcggcctccgcagtctgagcagccgccgattaagaatgacgatggtaaatttgaatccatatggctcgctcaacaatggggatgtcaggaaaactgggccgcatatagaatggtgtccatgcaaatatcgacttggattcgtggcgctcgccctcaaacgctgccgctgggtcttgccccggttctggtcggcgttgccgccagttggcggtgggatgctttgggtggcctgcggtcgtgcccggcttttccgggaggattgctggaagagcgtgatgccggtgatgtgctggggcattgtgcgttttctcggccgtggtttgcggtcgttgcgatgttgtgcgccgtggtggcggtcggtctgcaaattgctgtgaattatctcaacgattatgccgatggcgtacgcggcacggacgcccgacgaggcagtgacgccgcgggacctcggcggttggtcgcttccggaattgaccccagtcgcgtgttgctggctgccgcggtcaccgctttagccgcctgttccgccggactggtcgctgtcgtcataactggtcgctggtggctgatcgcgcttggcgcaacctgtctgttggcgggctggggatataccaacggtcggcatccttacggatatcggggtctgggcgaacttgcggcattcgtattcttcgggttggttccagccctcggcacgcagtatgcgctaagcgggtcgattaccgtgacgggagcggccggttcggtgatctgcggcctgctgtccgtcagcgtcatgatggtgaataacctgcgcgatctcgaagatgacgccgcgcacggcaagcgtacgctgatggtgcgcatcggcagtgggaagggcaaatgctggtgcatgcgtgcgctgggatgggctgctggtctgacggtggttttcgccatgccattatcggtgtatgccgaacttctggatctgctcatagttctgcctgcggaggtggatcgcgaacgttcatgcacggaatatggcatatgcgatgactggtcgtggggaaacgccgattggatgagccttgcggcgttcgtatccatcgcagggtgtgtggcgattgctactcgtgccgtcgcagccgtccggcatgaccagtggcgtcgggcgttgccattgtgctcgatgacctcgttggtcgcagccggcgcgttcgtgctcaatgcctgtcaggccggtttcatggtgtagctgcatcctgcatttacgatttcgtcattgagcatcggcgattgcctgatgatgcaaacggcatacaacagaatgaaaattgttgcatgaacgtaaccaaataatcgtcatcgacggttgtgttgggcgtgctaggcggtagactggcaggtatgacttacaaactagtactgctccgtcacggacagagcgcatggaataaaaccaatcagttcaccggctgggtcgacgtcccgctgaccgagcagggtgtcgaggaagccaagaacggcggccgcctgctcaaggagaagaacgtccttccggacatcgtcttcacctcgatgctgcgtcgcgccatcaacaccgccaacgtcgcgctggacgaggccgatcgcctgtggattccggtcaagcgcagctggcgtctgaacgagcgtcactacggcgccctgcagggcaagaacaagaccgagatccgtcaggagtacggtgacgagaagttcatgctgtggcgtcgttcctacgccaccccgccgccggagatcgatccgaacgacgagtacgcgcagaacaacgatccgcgctacaccggcgatccggttccggaagccgagtgcctggccgacgtggtcaagcgcgttgagccgtacttcaagtccgacatcgagccggagctgaaggctggcaagaccgttctgatcgccgctcacggcaacagcctgcgcgctatcgtgaagatgcttgacaacctctccgaagaggagatcgccaaggtcaacatcccgaccgcaatgccgctgctgtacgagctggacgagaacttcaagccgatcaagccgcgtggcgagtacctggatccggaagccgccgctgccggcgctgccgccgtcgccgctcagggccagaagtgagtttgttgcgattgggtgcgtgaatagtcgcggctgatcgcatgaaacacatacgaaaaggtgggaacctgcataccgtaggttcccacctttcgttattgccggcgcctttgtcggtaagtctttttcacgttgtatctgcgttttgctgatgtcgccttgcctgcgcggctcggcgggtgccgtgcggcgcaggcaagacggacaaaacggaatcgcaagaacgtcagatcacgccgtattccttgagcaatgtcggaatatcagtggaatccagcttcttcacgatctgcttcaacacacccctttcgatggggttgagcttcatatcggtgatcggtttgccgtctcgcagcatcaccgtggcgttgagcaggttgcgcacgtcgtagaccgaaccccacacctccggcacgccgcggtccacgtcgcacagcgtgtacacggcctccatgccggtgcgcatcgaatattcggtggtgaagatcgtgtcgcgcggcgtctccgcgaattggccgaggaacgcgaaattcaccgcgccatccggcaccacgtcggggcggtcgccggcggaacgcggcatgaagaacgcatcgatgtacggcatcatcaccggaaccgtgttggcgtggttcttcgccaggtcggcgatcttgtcggtcggcacgcccatgtggtacagccattcctcgcagatctcctcgccggtgcagtcctgcatcggcttcttcacatagttgccgggcttgtcggggaacagaccatacacccatacgcacagctggtccttcggctggtcgcggaactgctgctggcgattcagcgtccagctcatcagccaattggaatcctcaacggtgacgatgccgccggtcaccacacgtccggagaacgggtcgcgcttgcagatcttctggatgtacggcggaatctcgtcgtccaacgtggtgacggtggcgctcatccacttcgaatgctccgggtcggaacagaacacgtccggatgtccgaagctcggatcctgcgccgcgatgcgacgccacatatcccaaccgccgccgggcttgatctccggagcccacgcggccggctcggtctgcgaacccatcgacgagttctccacgcagccgccattggtgatgaacaccagatcgttctcgcccaagtcgatactgcgggtcgtgccatccgcctccatcagatcgatgcgcgtggccaacttcttggtcggcgagctgaacggattgcgcggatacgcgccgtattcggcctgcttcctcaaaatcgtatcctgcccagtgccggtgcgctggcgtacgggacccatgccgccgccaatcgcgaaatcgacgttctccaccttcacgttgtagtggaactgcacgccgaagccttccaaatacttgatcatcggcagaatcatcgactcgtactggttgtagcgggtgaaccgcaacgcgctgaagtccggcagtccgccgatatggtggatgtagcggcggatgtacagcttcatctccaacgcgctatgccagttctcgaaggcgaacatggtgcgccagtacatccagaagttcgtatcgaacacctcatcgtcgaagaagtcggagatcttcttgccgtatagttcctcgttcggtgtgaagaacagcttcatgatctccatcgacgccttgtcggacagcgcgaacttgccgttcgtgccgccgtccacgccacgcgccttagtggagcggcatagcgaatagttcggatcctccttgttgagccagtagtattcgtccaatacggacactccatccgtctcgatggacggaatggaacggaacagatcccacatcacctcgaaatggttgtccatctcgcgtccgccacgcatcacatagccgacgccaggaatgttcgcgccatcgcaggcgccgcccggaaccgggtccttctcgaacacgtggatgtggtcgccgggcatctgcgcgtcacgtaccagatagcaggcggcggacagcgctgcaagacccgtgccgatgatgtaggcgttcttgctatcgatcccctcgggcttctttggccgggcgaatgcttcgtaattgccgttggaatagtacatgacttcctcctttggatgccgctggacactattgtgccgcgtcgtgggacacaagtatacgggcatgaactggacgcgatgtctagtttttacgactatcggaggaatttcgcttataggtggcggattacgcctgcatgcgaaagtgattttgcctatatgtggcagatttcttttggaaaaggatgttcgagggcaggatttttacccccttatgatgttttggccgaggtcatctgccacatataagcgagatgggtggcttccaaacggaaaccacccatctcgtcaaggaaaatgcaagaagaggtgaggaaccctcagtcgatgtcggtgccttcgtcgcgggtcggctccttggacgggtcgaaaccggagacgatgaacaccacgcggcgggccgcggaaacggcgtgatcgccgagacgctccatgaagcggccggtcaggaccacgtcgatgagctgctggttggtgcccttccaatcctcggactgggccagttcgaaggtcttcttgtgcagagcgtcgagcttgtcgtcgttgagaatgatctgctcggcggtcttggtgtcgcggtcggtaagcatggaaaccacctggtcggccacattgtcaaggaacgcctgcatttcggcgaacagcggctgggcatcggccggcagcggggaagcaggataggtgcggcgggccgcttcggcgatgtgacgggccagatcgcccatgcgctcgaacgttgcggccagacgcagggtggagacgaccacgcgcagatcggtggccaccgggttctgcttggccagcagcttcacgcactggtcgatgacgctggattcgagggcatcgatttcgatgtcgccgtcgatgacggcctgggcggcttcaagattctggttcagcaacgcgtcgccggcaccattgattgccttgcgaacgtcttgcgccatgcggtcgaggtcatcggcgactgccttgagctcttcattgaagataacgcgcatatgcttgcctttcaaatgcttcacgtatgtcaatatcgggttcggatataacctctcccaagtgtattagggaattggcggattcgcacgtgacggacgtgttgttccgccaatgttcaccggcacgttcaccctgcgttcacgaaaatcgcgccacggccattcatcggggaacgtcagggtgtgcgagaatgaagacatgtttgaatccgtaggcacgtggtggcgcaatctgacacatcgccatggtgacgatcgcaacaatgatgatactttggatgacgcgacgaacacgttgctgtccatactgccgctggcctccatcgtggtcgacgagcatgacgaggtgatacgcgcgcatccggacgcctacgcccttggcgtggtgcgggacgacgccatcgccgatgacaccgtggcaagcgcggtgcacgaggtccgtgcccacggcggcaagaagcagttcagcctgaccacgaccacgttgcatgagccgaagaaggctccgaaagcagggaagccaaccatgcgggaggttgccaaacaggcgttgatcggccaatcgccagacaagccggtgaccacggtgtcccgcccgaactggctgaaggtgatcgtaggcaggctcaacgaacgctttgtggtggtgctggtttccgacgtgagcgaaaccgtccgtttctcccagatccgtgattccttcatcaccaacgtttcggagcagctcctcaagccgacgcagtcgctggaggagcttgcggacgcgttggaacatgactcggacaataaggccgcgattgaggggaacaccgtaaaactgcgccaatcctgcgctcgcatggaacatatggtgtccgacctgctgctgcttatcaaggcgcaggaaccgattctgccgacggcgagcaaccgtatcaacgtcatggaacaggtgaaaaccgtcgtcggcgcgcatcgcgacatggcgcaacggcgcggcatcgacattgaaatcgatggcgacgaatcgctggacatcaacggggaaggcgagcagattcaggccgcggtcgcaaagctgctcgaaaacgccatcgcctattcaccggacggcaagggcataaccgtatccgtcaagccgaacgaggacggcaccaaagtgctgctcagcgtgcttgaccgtggttgcggcattgcacagaaggagcaaagccgtattttcgaacggttctaccgtggcggcaaccagaatgggcattccgaggaaggtatcggtttgggccttgccatcgtcaagcatgtggcgttgacccaccatggctccgcttcggtgtggagcgctccgggacagggcagcacgtttacgttggagctgccggtcgccagaaattagcggcgattacagagcgttgggacacgccatatacggcaagggccgcttccgcaggttggtgcggaagtggcccaatgttgttaccggttatttcgcgattggctgaaccgccggtcgggttattcgccaagacggcggtagtcccaccggtcgaaatgctcccaaaccagcatgagcacgccgatcaccgtgccggcggcgcacatggtctgcaatcgttcgacattgatgccgaaggccagcagaatcatgcagatcaccaaggcgatggcccataatgcggtgccgaacgtgaacaccttccgcaggtcgacgcgcaccggtttgggggagggtttgcgcacgcttgggtcgataatcggagcaaatttcataccgttaccttacctcggtgcgcgcgtcacaggtgctcggccacgtaatcgacgcacttcgtaagcgcctcgacgtcgctcggctccacggacggaaacacgccgatgcgcagctggttgcggccgagcttgcggtagccgttggtgtccataatgccgttctcgcgcaacgcggcgaccacttgggaagcgttgatgctctcgtcaaggtcgatggtgaccacggcgttggaacgtgcgttttcgtcggaaacgaacggctgcgcgtaatcggacctctccgcccactggtacagcagcgacgcggaacgtgcgcaacgcgccgtggcccaggcgaggccgccattgtcgttaagccagcgcacctggttctccagcatgaccagcgtggccacggcgggcgtgttcagcgtctggtccttacgggagttctcgatggcggaggtcagggacaggaacggaggaatccagcgtcgcgcgcccggcaggctgacgcttttagcgatgccgtaggcgcggtcgatcgcagccggggaaagcacggcgatccacaggccgccgtcggagccgaacgccttctgcggggagaagtagtaggcgtcggtctggctgatatccacgttcagcgcgccggcgccgctcgtggcatcgatcagagtcagcgcgccctgctccttggaaccttcgacacgcttgaccggggccgccacgccagtggacgtttcgttgtgcgcccagcagtaagcgtccacatattcggtgagctccggcaggcgatacgtgcccggtttgcccgcgaagatctccggatcctcaaggaacggcgcggattgcgcggacttggcgaatttcgcgctgaaggagccgtacgtgccgaacgccgccttgcgggtgataagcgacgcgcaggcgatgtcccagaacgcgctggcgccgccgttgcccagcacgacctcatagccgtcgggaatctggaagaaattcgacaggccttcgcggatggagccgaccacctgcttgaccggggtctggcggtgcgaggtgcccagaagattgcgcgcgcccgcgtcgagcgcctggacctgctccggacggattttgctcggccccgagccgaaacgtccatcctccggaagcatgttggtaggaatgttcacagtgttcgtcatgtcatccaagggtagtcagaaggtcggattgcgcgttgatatggccgttttccggacgttcctccacccgtggcgaattatttgcgcaaggacggggtcttgatgataatccctatgtcggtgtacccttacccttgtgacggttctgtaaccgtgcgcggtcataagctgcgacggtttcgcaatccgcaaggagtgattgatatatgaggcatgcggcgcataaagctgccaaggtttcgcacgcgcaattcagcctatccaaggcgttgttcacggcgaaccggggctcccataccgccaaggccgtgcgaatggcacagctggcggaaggcggcgccgtagtcggactcgctccggaagtcgtggataaactgaatgaagtggctccaatgagccgccgtgccatgcgtgaggccgccaaagccgcttcccgcaaatccgcgttggtgacctccgcttcgttggcggcgcttgtcggcaccgcggcgaccgcgttggcgttcagccagcagaacgcatcccgactggtgcttgcggacgacggtaccgaaacgtcccagatcaaacgtgtgtccgatggagcggcatcccgttccgaaggacgtaccgcccttaaggaactggcttccaccagcaacaacggcggttggcagctgggagacaccagcgcctccatggacgccagcctgatgtccaagtccatcgccgacaatccgaacgtcgccgtcctgatggaccaagacagcagcgccttaccggctaacttcaatccgaaccatgccaccggagacgtcggcaacgcctacgagttcagccagtgcacgtggtgggtgtatgtgcgccgccatcagctcggtctgcctgcaggctcccacatgggcaacggttgccagtgggccgattcggcccgcgccttgggctattgggttgataacacgccgcgccatgtcggcgatatcatcgtgttcgccgcaggccaggaaggttccgactcgtattacggccacgtcgccatcgttgagaaaatcaacgacgacggctcgatcgtgacctctgaatccggcgcctccctcaatggcggcacgtattcccgcacgctcacgaacgtgggcgatttccagtatattcactactgagtttccctaccgacgaccgtgccccttttcttgtaagagggatgctgtaagctaaggattcgatgaagcatattaagcattgttccgtgattgctgcgctcgccgcggctgctcttactttcgccggggtggcacctgccgcgctggcagccaatgatggcgccacgcaagatgctgtcgttgctacccgttcgttcccgaagaccaacgccgtgaagaagaacatcctcgcggaggcatcgtccacccaggtcgaatccgattccgactggggcggtgtggaaagcctgaacgttccccaaaccaaatctcaagccgaaaaagacgtcgaagccgccgcagcggcagcggaacagcagcgtcagcagcaggcccaggctcaagcacaggcccaagccgcttctcgttccgccgctcgaagcgacctcagcagcagcggttccttcaccgtgacgccgcctgatggggccagcgtgtccagcctgctgacgttcgcgaaccagttcgtcggcaaggttccgtatgtgtccggcggcaataccccgtccggttgggattgctccggtttcgtgcagtatgtctacggccagatgggcgtttccctgccgcattactccggtgctcaggcgactgtgggtcgcgcggttggcagcctcgccgacgcgcagccgggagacatcatcgccaatgcgcagcatgccgcgatctatgtcggcaacggcatggtcatcaactcccagctgaacggcacccgctacgatcccatcgcatgggtgttccccagcagctacagcattcgtcgaatcttctgaagctttgacattgagctaagggcgtatttccgtgaggaatacgcccttttgctttgttattttccgcgtcgttacttgaaaaccgcatgtcgcgcggtatggtggaagtcaggtgcaacgcatagtcgcgttgccgcaacctgattcaagggaggtcgctcatgatcaatgacaaggcaatcctcgtaggtgtcgatggatcccacgccagctacaaggcgacatggtgggcagcgaattacgcgaagcatgcgggactgaccctgcagatcgtctgcgcatattcgctgccaagctatgcggcagtgtcgttcgatgccacgtatacggccatgggcgatgataatgccgcgcacaacgatgcgcaggagattctgtcgaaggccaaggccatcgccgacgagcagggcgtcgaggcatcgacgttgatcgtcaccggagatcccgcatccgtgttcgtcgaactgtcgcgcaactacaacctcatcgtcattggcaaccgtggcaagggtggtctggccgaacgactgctcggcaccaccagctccagcctgccggcatacgcgtactgcccgatcgtcgtggtgccgtacaccgacgacgaaggcaacctgatgcacttgaacaacaccatcaccaaggtggcagtcggctccgacgaatccaagtggggtctgaaggcgttggagatcgcggccgcgttcgccgattcgtggggtgccgagctggacgtcatctccgccgtgccgaacatgaagggctccgaggatgaaggcgtcatggcgtccttccaggaggatctggatgtgcgcatcaagccgcttgaagaggcgtacccgaacctcaagatcaacaagcagatcgtgcccggccccgcagccggcgcactgaccaaggccagctacgatcatgacgtcgtcgtggtcggctcccgtggtcgtggcggcttcaccggtctgctgcttggctccaccagccagggtctgctgcagcatgcggtcggaccggtctacgtggtgccgcgcaagtatgtggaagccgcggagacccgtctcgacaccgtgccgagctcgcctgccgacgtcacgccgaaggcgatcgacgacatcaagggcgtcgaggaagtgccggtcgacaaggccaagccggaagtggtcgaagccatcgaaacgaagatcgatccggaccgtcagtgacggtacggcaaatcgactgaaatcgatataaaaaccgcatagaagagggtggctgcgattccaacgaatcgcagccaccctctaactatgtgcggtacgtgcgctcagtgcttgacggtgacgttcatacgcactggcgtcggctcgacgtacgtatgcttgaccgtgcagcccttctcgatatgacggctgacgcgatcggcgagcttttcggcgtcctcgtcgctcaaaccggcgtcggtggcgtcgatgaccacctgctcgtcgaaaccgatgtaggcgtcggtatcggcatcatacgtgccgttcaccacgatcttcgcgcccttgccatcgcccagcgtatgctcgacggcgaactggctggacagcgcggcgcaaccggccagcgcgaccttcatcagatcgcccggcgtgaactggccacggcccttgccgaacttgatgtgcgcgccatcctcgctgaacgcgtcccaggaaccgtccttgttgcgctctacccacagcctcttgcccatggaaactcctcatgtcctgtggcgcgccgttcgcgccaatccgtgataccaatctagcgcatcgaaacggacgtgggggagtgcgttccgcaagatgaagcgatacggttttgtgattcgttacgattgcgctggaggccggcggacggccgggatgcgcgttggcggcacactcaaggccgttcggccaagcttacggccttacaacgcgcatcccggccgtccgcctccacgccaccggctaaacttgcctattatggctttgacttccgaacaactcgcagacatccgtactcgtattcccgcacgtccggaaacggacattcccatgccttacgaggatctggtacgcaaaatccttacggaaggcacgctgaaatccgaccgcacgggcacgggcacagtctccctgttcggccagcagatgcgtttcaatctcaaagacagcttcccactgctcaccacgaagacggtgttcttcaaaggactcgcctacgagctgctgtggttcctcaaaggctccacgaacgtacgttggctgcaggagcacaacgtgcacatttgggacgaatgggccgacgagaacggcgatttggggccggtctacggcgcgcagtggcgtagctggccggcaccgacaccggacgatccgaaccgcaccatcgaccagatctccaacgtgctcgacctgatccgtaaccaccccgattcgcgccgcatggtggtttccgcatggaacccggcggaagtggagaacatggccttgccgccatgccacgccctgttccagttctacgtggccgacggccgcctgagctgccagctgtaccagcgttcctgcgacatgttcctcggcgtgccgttcaacatcgcctcctattcgctgctcaccctcatgatggcccagcagacgggactcgagcccggcgaattcgtttggaccggcggcgactgccacgtctacgacaaccacatcgaccaggtgttggaacagctgagccgtacgccgtacccgtatccgcagatccgcatcaggaaggccgattcgctgttcggctacgattacagcgatttcgaaatcgtgaattaccagcatcatccgaccatcaaggcaccggtggcggtctgaggttgttgccgccgtctggcgcgtctgcgccagacggtagactactgaccctagttccgacttcaaggagtgagtgaaatggagcacgatagtagccgcagtggctatcacgaacccgagcccggacttgccgggcgtgaagacgaggaggattggggcgacgatttccccaaaaccttctctgtgaatctgatttgggcgcaggcctgtgacaaggaaggtcacgacggtgccattggattcgaaggcggcatgccatggcatctgcctgaggatatgaggcatttcacggagctgaccgtctcccatccggttatcatgggccgcaagacgtgggagtcgctaagcccgaagttccgtccgctgcccaaccgcgacaacatcgtcatctcgcatgacccgtcctatttcgcgccgggcgccaccgtggtggattcgctggatgacgcgttggatctggcccgtcaggaggccattccggatgacggcttggaccgcagtgaaatctgggtcatcggcggagccaaagtattcgaggaagcgatgccattcgccgacaaggcgtatgtgacgcagatcagcatgcacgtgaacgccgacacctacgcgcccgatatccacgcattggtggaatccggagcatggcgcgtggccgaggaaggcacgtggcagaaggcgcggaaaggaaacgaccaagtcgaaggcttccgtttcgtgacgtacgaaagaaaccacgaggagtaacttttcatgtataccgtgatgaccgtgtgcacgggcaacatctgccgttcacccatggctgaaatcattctgcgcgccgaattcgagcgccgcggcttggctgacaaggtcaacgtcgaatccagcggcgtcagcgacgaggaatacggcaatccgatcgaccgccgtgccgtcaaggtacttaaggaacgcggctacgagctgccggcgcaccatttcgcgcatcgcatcacgcgcgacgaaatcgaacgcaccgacctgttcctgccgatgaccgcctcgcacatgcgcgcgctgctccgtcagctgcctcaagccaagcgcagcgaagtgcacatgtaccgcagcttcgatccgaatctgccgaagccggccgcgggacgtgaggacagcatcgacctggtggacccgtggtacggtggtccacgcgaattcgaagtggcgatcgaccaaatcgaagaggtggcgccatatatcgtcgattgggccgaacagcagttgcagaactgattttttattgcgattgcggcatgcttgatggtttcaagcgtgccgcttttgttttttgcgatttattgcgatttattgcgatttttttttggggggggctggctgtgttgtgaagttgcgatttttctgatgttgcggtgtttggtgggattgaatatacggcgtttttgcgatgttgcgattgcggggtgtccggtggaggccggcatatgcgttgcaaggcacactcaaggccgttcggccgagcttgcggccttgcaacgcatatgccggcctccacctcgtttttattggcaggttgcgatgttgcttcgttctgtgggtaagttgcgttttttgatttttgtggggcgcctcgtttttgtgggcaagttatgtcttgacggttgggaagcgtgaattggcgtgggaggggagggtgagggtaaaagaaaaaccccggcggattgggctggggtttggtggcgaccacggccggacttgaaccggtgacctccgccgtgacagggcggcgctctaaccaactgagctacgcggccgttgtttcagccttgcgactgacaacagatagaaatactacggcaaaaacgcaattatgcaaaactgcggcgtgtcacggtgtgttgggcgtggcgcgccgcagtttcgcgggaaaggagacgaatctcagtcggtctgcttccaggtgtcgacgtcgatgtggtgctccgggttggcctgccatgcgtcccaagcggacttcacaatgtcctcgacattgtacttggcgtgccagcccatctcctcgttgatgcgcttcggggagccgatcaggtgcggcggatcgccggcgcggcggcccatgacagtctccttgaacggcagaccggtgaccttcttgacctcatcgacgatctggcgcacggaggtgccctcgccggtgccgacgttgaacgcgtcatacttgcgctcgtcgcggtccagatacttcagcgcggcgatatgcgcgtcggccagatcggacacgtggatgtagtcgcgcacgcaggtgccgtccggagtcgggtagtcatcgccgaagatcgccggggccttgcccttcttcagacggtcgaacagcatcgggatgaggttcaggatggccggatcctcaagttccaccgggccgcagccggccacgttgaagtaacgcaggccgcagaagcggatgccatacggttcctcgcaggcgcgggccatccactcgccgaacagcttggtctggccgtacgggttgatcggcagcatcggcacgacgtcttccggcaccacatcgaccggcggcacgccgtaggtggcggcggaggaggagaagacgagcttcttggcgccggaatcgcgcatgccgatcagcacgttgagcatgccgttgaggttctgctggtagtaccacagcggcttctcgacggattcgccgacctgcttgcgggcggcgaaatgaatcacggaatcgacgccttcggccttcatgatctccgcgaggcgctcgccggcgcccggagcggcgatgtccatgccgtacaggcgggagccttcgatgcgggtgggcttgccgtagctcagatcgtcgacgacgacaaccttttcgccggcctgatgaagtgcgtgaacgacgtgggcgccgatgtatccgcacccaccagtgacgagaactgtcatgttctggcctttccttcaaatgagcggtgaactttgatgatttgaaaaaatgtcaaccattgttcactttttgctcagatttgttaccttttgaacaatttgagtatagcacgtgaacacgaacgcacataactcgttcgttcctgcgtttcctctataaattagggtatgcaacaagacgaaaacacgccgaataatggccgtgaaatagaagaaaacgtgccagacgtacaaccgacagtcgatggcaggcctgctctttacggccgcaaagtactgtccttcgtgcggcggtccgcccggctcgacgcgcgactgcagcgggcctgggacgcctacgccgatacgtatctgctgaacatcaacgcgggcgaagggtccctcgacgtgcgtgagggtttcgtgttcgaccaagcctatatccgcgaaacgtggggcaataccaatcctctgatcgtggaaatcggctccggacaaggcgagaacgtcgttgccgccgcagccgcccggccggacgtcaacttccttgctctggaggtctacgatccgggcgtggcgcacacgctgctgctcgccggcaagcagaacctgaagaacctgcggatcgcccagatcaacgcgccagaactgttcaaggcggccgtcgacggctcgatcgccgaagtgtggacgttcttccccgacccgtggccgaagatgcgccatcacaagcgccgcatcgtacagcccgagctcgccgcggacatccaccgcgcgttgacggacgaaggcgtgtggcgcatcgccaccgacatcgaggattacgcgctgcacgtccatgaggtgatggacgagctggacggcttccataacgacggcgcattgaccgtgagcctgcccgtcgagcacgtcggcaaaggcaacgcggatgaggcggccgcattgcgacacgccgatttcgctgaatccgagcgattcgatggccgtgttttgaccaatttcgagaagaagggacttgccgccgggcgcgtgattcacgatttcacctatcgtcgcgtgtaatgcgataaggcttggaatttcagtgttttacgaggattcctgtcttattgtggcggtgtgtgacaccggcgcgacacgccgaggtttgcatgtcggccagattcgcgtatagtagggcaagttgtcaagcggaaacgctgaaagcgcccccttcgtctaacggttaggacaccagactttcaatctgacaacgagagttcgactctctcagggggtacgtaccttggaaacaaggtggcaatggccgcgtagctcagttggttagagcgccgccctgtcacggcggaggtcaccggttcaagtccggccgtggtcgctggaacagcgcaagttgttcatggctctgtagctcagttggtagagcgaacgactgaaaatcgttaggtcagcggatcgatgccgctcggagccaccatggaaaccccggagagattcggggtttattgttttgtgtcaggtttttcttcactgtttcatggtttctgtggtatcgatgcaattatctcttgttatcgctgctcctaactaagagggaattttgttcctagtgttgataaattacggcgcaggtggataaacgattgtcgtggacggcaaatccgtggacgagaccatgtgggtcttcgaaatgggagggatcggctcgcttggagcgaattatttgatatccggcgatgtctcgtctggttttcttctgctgggtggaaagctcgtgtaatactgcggtgtcgttggccgcatgccggtcgaaaatgggtttatgatgggagcgttggctttacggcaaaggatgccggagcccatgaacacacagtcgcttaaaggagagcactatggtctatcgcatgattttcaaccagaccgcgtatttcggccgcggagccatcaaggagattccgggcgtcgccaggtcccatggcttcaccaaggcgttcatcgtcactgatccggtgctgctggagaccggcaccgtcaagaaggtcaccgacgttcttgacgaggcgggcatgccgtatgaggtgttcgacaacgtcaagccgaatccgccggtcgagtgcatccaggatggcgtcgccaagttcgcagcctccggcgcggacttcctgatcggcctgggcggtggttccccgcaggacacctgcaagggcatcggcatcgtgactgccaatccggaattcgccgacgtgctgtcccttgaaggcgtggccgacaccaagaacccgtccgtgccgattttcggtgtgccgaccaccgctggcaccgcgtccgaaacgaccatcaactatgtgatcaccgacacggccaacaagcgcaagttcgtggccgtcgacccgcatgacatcccaatcgtcgccttcgtggatccggacctgaccgactccatgccgcgcggcctcaaggtggccaccggactcgacgccctgacccacgccatcgaaggctatatcacaccgggcgcgtggagcctgtccgactgcctgtccatgcagaccatccgcatgatcgccaagaacctcgccaagagcgccgatggagacattccggccggcgaacagatggcctacgcctcctacatcaccggcatggcctactccaacgtcggcctcggtctggtgcacggcatggcccacccgctgggcggccgcctcggcgtggcgcacggtgtggccaacggcatcctgctggccccggtcatggaatacaacaaggactacaccggcgagaagtaccgtgacatcgccgacgccttcggtatcgccgacgcctacaccggcgacatcgaaaccgtgcgtgaagaggccgtccaggcggtgcacaagctcaccgtggatctgaagaacccgaccaagatctccgaagttggcgccaccgaagccgacctggagccgctggcccatgacgccttccacgacgtgtgcacgccgggcaacccgcgccaggccacccaggaagacatcctcgccatctacaagagcctgatgtaggtccgactgcggtaggcgcaatcgcaaaaccgcaatcgtaaaaacaaaacggacggcatcgatcgcatggtcggtgccgtccgttcgctatccgcggaaaatacgccgcgaataatcgctatacctaatcgctattcctcgtgcttctcgctccactcctcatcagtgggagtgtcgtcatacagctcatggccttcctgttcggccaattccatctgctcgttgatccacgcggcctcggccggattgatatcagcggtgttcaacaccttctgccacaccggatacagcagatgcatcacaggatataacgcggtgatgaggatttccggcttgtgcttgcggtaatgctgcggatgcgcgttgaacgtgttcttgaaacggcgcatatagttgaggaacgatgccggagacgtgtccatacgacgtgcgctgatgcccgcgatcatccgcggacaatacacggtcttgagatccttgcccaacagatgcagcgagatgtcgatgtcctcatgcatcacatccgccttgtcttggcagacctcgtcggcgatttcgcgccaggcggtggcgcgcagggccatgttggaaccgaacagcagaggttgcccatcatcggccctataaatacgtttgcgggtggaattgtccccgcgaagcccgaaatgacggctcggcaaatcgtaatacatcaccggaccggtggcgcccatcgcatccggatcctcggtgaaaatgccggacaccacctccacccagtccgggcggatcatgcagtcggcatcgaaacggccaagaatatcgccggtggcatgattcaaaccataatcacgcgttggaatcagaccctgctcatcatcctgatgcagcagcttcaccggcgcttccggatggtccttcatgaactgctccaccacggcaacggtcgaatcagtggaacggttatcgacgacaatcacctcatgaggcatcacggtctgccgggtggcgttgagcaggcaatcgttgatacgctcctgttcattccaggcggggatgacaattgaaacgttcagcatggtttcaagaataggttccagcccgtacacggtgcctgtctacaataaggagccatgagcgaacgcgaacagcatatggatacggacaagaggacgggaacgtccggacagtgcggcaataccgacgaaatgcgttgggatctcggcacgctgttccctgcgaaaggcgatccacgcagacctccggaatggctgggtcgcgcgctgctgtacatcgccatcgccatcgtgctgctctccttctgctggcgcagttggggcaaaatcgaatacctcgtcatcgacgtcgtcatctcgctgttcctggcgctcgccgtggagccggtggtgattccgctggtcaagcatggctggaagcgttcgttcgcttcgattttcgcgttgctgatgttgggtgtcctgctttgcgtgatgttcggtctgttcggcaatctgttcgtgcagcaggtcatcgctttgtgcaacggtctgccggccctctaccagcagatctgcgatttcgtggcgcaatacacggatttcaagcttcctgagatcaacagtctcggcggtgagattctgaagaacatccagacctcgtgggtcacggatttcgcgggcaccgccatcagcacggtgtccggattcttcagcttcctgctgaacctcatgacggtgatcatgaccacgttctacatttcggcggccggcccgaagctgcgccgcgcggcctgccagtggatggctccctccgcgcagcgccggttcctgttcgtctggaccgtcagccagacgcagatctcatcgttcctgttctcacgtgccatcctcgccgtgctcaacgcgttcttcacctcgatctgcctgatggcgttgcacgtgccgtattggatgccgttggcgttgttctgcggcgtcgtatcgcagttcatcccgatgctcggcacgtacatcggcggcgcgttgccggtgctgttcgcctggggcagctgtggtttgtggcaggcgatcgccgtggtggcgttcatctgcgtctaccagcagatcgaaaacctgatcttcgcgccgaagatctcccgccgcaccatggacgtcaacgatgcggtcgccttccttgccgtcctggccttcggctcgctgttcggcgcgatcggcgcgttcctggcgctgcctatcgtcgcctcgatccagacgatcgcccgcacctacaccaagcggtacgatctggtcgattcgccgctgatggacgatccggttccggacaagaagtcgaagctggtggaaggcgccgaagtcatcagcgagcacctgcacgccgtgccgcgcgccgtgcaggggtcgagcgcgcatgtgccgattcccgacgacgtgcgcttcctgcaggagcaggcgtacaatatcactcggtccgacgagaccggggatgccgacgaatcgcagaccgtcgccattccgaagcacgtgttggacggggtcgatcgcaagccgctgcggggaaccgcggaagcggacggagcgcagacggaagccggaccgcaggtagcggacgggtcgcaatcgcagggaacggatgacaatccgagaagtaggtggcgttaatggtattgctgagcgtacttgatgtcgtgctggtggttttgggcggcgccggcatgctctaccaagcggtctgcatcgtcatctcgctgttcgccaagccgatcaagttccccgaagcgccgatgaacaaacggtacgcggtgctgatttccgcgcgaaacgaagcgaacgtcattggcaacctcatcgactgcctgcattcgcaaacctatccgagcgagctcatcgacatctggctggtggccgacaactgcaccgacaacaccgccgaagtggcccgaaacatgggatgccacgtcatcgaacgattcaacaaggagcaggtcggcaaaggctacgcgctgacctatctgctcgaccagatgaacgagtcgggcgcatccgacccgtatgacgcctttttcgtgttcgatgccgacaacaaactcgacaagcactacatcgaggaaatgaacaagggcttccaagccggtttcaaaatcctcaccagctaccgcaattccgtgaacctgtccgacaattgggtgtcgtccggttccgcgttgtggttcatccgcgaatcgcgcttcgtttccgcctcccgcatgtggctcggcaacagctgccacgtgggcggcaccggcttcatgttctcccaggagatcatgcgtcgcaacaacggctggaaattccacctactcaccgaggatctggaattcaccatggacagcgtgctgcacggcgaccgcatcggctactgcggcaccgccatcctgtacgacgagcagccggtcaccttcgcgcaaagctggcgtcaacgcctgcgttggagcaagggattcctgcaggtgttccgctattacggaccggcgttgatcaagcgcgcggtcagggaacgtgatttctccgccgtcgatttcacgctgctgctgtgcccgttcaccgtgctcggcatcgcacgcgtgctgttgggcatgctgttcgctgcctgcggtttcgtgacatggcaaagccagctgaattcgctgaccggctggacatccggcattgtgatatcggtgatcggcatgatgggactcgccgcattgaccatcgtggcggaacgcgatcacgtgggcgccaccaacaaggagctgctcgcctacgtgctggccttcccgatctacatgctgagctatgtgccgatttcgttccaggcggtgttcgccaagtccgaatggaagccgatcgagcataagggctgaggcttgcccgcggcggtgtgaacggtcatgagatgtttcgtggcgatccatacggtgcggatggtgaaaagatgacgaagagagggtgtggtttggctatggatgacgctggcgattaccgctatacgcgacgacgccgagcgatcacggtggcggtttccgtcgtggccaccgtcgcactgtgcgtcggctatgcagtggccgacatgtgcgatgtcgcaccgggcgtcctcacattgcgccatgtcgaacattcgacggtcgccgctgccggccgttcgatcgaggcggccgacgtgatcgccgacatcgacgcttccaagaccatcgatccggccgctgcgcgcgcgctgaccgacgcgttccgagcctcagccgccggcttcggcggcgaattctccatcgccatcgccgacgcgtcgggcaacgtggccgcggaaaacaacatcgacgtgccccgcacgccagcatccaccatgaaaacgttgacggcgtatgcggccgccgtcgaactcgacatgggcaagaccctggacacgcagacctatctggaacagtcccaggacggcaccgcgcgtctggtgctcaaaggcaacggcgacatgctgttgggagccggagcgtccgacgcgaaccacatcaacggacgtgccggattgggcacgcttgccgggcggaccgcacaggcgttgcggcagcgtggcatcacctccgtgacattggcttatgacgacacactgttcggcaacgaccgctggccgcaaggcatcgccgaactcgacacggaccacctgtactacgccccgacagcttccatggccgtggacggcggcaggaattggaacgggacaggtccggccaatcctgatgtgttctcggcgtatccggcattgagcatgcagccggcgcgtgacgcggcgctggtgttccagcagcggctggccgaacagggcatcacggttcagggatttgtatcgcaaggcacggttgcgggggcatcccatccgcttgcctccgtgcgttcggcgtcgttgaacgagattatggcgttcaccatgcggcattccgacaattcgctcgccgaggaattcggcagactgctggcgttgcaggtcggcgcggacaattcgccggctggcgcggtgcaggctgtgaaaagcgtgctggagcgcaaaggcatcactacgaccgggctcgacatgcgcaattgttcgggacttacggaggattcgaaactgacggcgcgcaccctgctcgaagtgcaactgcgcaatctggctgcgggatcgggggcggccgcagccgaaggaatgtccgtcatgggcttcgtcggcaccgctgagagccgtctgaacgatactgacgaagcggggctgatccgtgtgaaaaccggcagtctgggcgacgtgacctccatgaccggcaatgtgtcgcggttgaacggcggagcgttgaccttcgcggtgatcgtcaacaatcccaccgatttcgcggcggcgaaggcggccatcgacacattcgtggccggtctgccgaagctgtgaacggccacgtgtgaatcttcccagcggatattcagcatatagccagaaacacgtcattcgcatgtgccaagatggtgggcatgcgaatcgctgacgtacaagaagacattgatcacgagctgatcagcaaagaagagatctccgacatcatcaaccgtgccgcggcacaagccagtgaagactatcgtggcaagaacccgctgctggtctgcgtgctcaagggagccgtgaacacgcttgcggcgttctcccaggccatgagcattccggtccaaatggatttcatgagcctgtcgagctacggttccggcacggagtcgagcggcaagatcacggttcgtcaggatctgtccacggatgtgcgaggacgccatgtgctgattgttgaggacatcatcgattcgggcatcaccctggcttggctggtcgacgagctcaagcgccgtggagcggcttccgtggaaatttttgcgcttctggagaagccggcacgtcgcaaggtcaatgttgatgtgaaatacaagggacgtgagattcccgatgaattcgtggtcggtttcggcttggattacgacgagtactaccgcaacctcgattcgatcgcggtgctgaagccgtcagtctatgaaggaggtcaggcatgagtttccctggtccgaaccagccgccaagcaatggcggcggcaacaagcccaacgggggcaataacccgttcaccaatccgtttagccgcaacaatgacggcaagaacggtggcagcggggcgaacggcaacaagtccaacggcccccgtccgttctggcagtcgccgtggctgtgggttgtggtcgtggcattgcttgccgtgaccatgttccagcttttcgccggtgcgggctcgcaaaccatcgacaccaaggatggcatgcaaatcctcaacggcaacaccgtagagtacgcgacgatcgtggacaacacccagcaggtcaagctcaagctgtcgagcgattactccgccaccgacccggacaccggacgtacgaagaactacggcaagaacgtgcagttctactacacgtatgcgcagtccgcggccgtggtcaaggccgtgcagaaggccgatccggccaagggctggaccgcgtccatgcagcagaccagcatttggacctacctgctcacctcgctgttgccgttcctgatcatcttcggcctgttctggttcctgatgagccgtatgggcggtgccgccggcggcatgttcggcatgggcggcaagaagaacagcggcaaactgctcgacggccagaccccgaccaccaagttctccgacgtggccggcgaagacgctgccgtgcaggaggtcgaggaaatcaaggacttcctcaaggacccgtcccgttacaaggctttgggtgcccgcattccgcgcggcgtgctgctgtacggccctccaggcaccggtaagacgctgctggcgcgcgccatcgcaggcgaggccggcgtgccgttctactccatggccggctccgacttcgtggagatgttcgtgggccttggcgcctcccgtgtgcgtgacctgttcgatgaggccaagaagaacgctccggccatcatcttcatcgatgagattgacgctgtcggccgcaagcgtggcggttccggcatgagcggtggccacgacgaacgcgagcagacgctgaaccagctgctcgtcgagatggatggcttcgacaacgatacgaacctcatcatcatcgctgcgaccaaccgtccggatgtgctcgatccggcattgctgcgcccgggtcgtttcgaccgtcaggtggccgtcgaagcacctgatttggaaggccgcgaggcgattctgaaggtacacgccaagggcaagccgttcgtgccggacgtcgacctgcatatgatcgccgtgcgcacgccgggcttcaccggcgccgaccttgccaacgtgttgaacgaagccgcgttgctgtgcgcccgtgccggcgcccagctcatcgacaaccgcgccatcgacgaggccatcgaccgtgttcaggccggtccgaagcgtcgttccaagggcatggctctcgacgagctacgcaacaccgcatatcacgagggtggccatgcgctggtcgcggccgccatgaacgacaccgatccggtgaccaaggtgacgattctgccgcgcggccgtgcactgggctacaccgcggtcatgccaaccgaggaccgttactccatgtcccgcaaccagctgctcgatcagatggcgtacgccatgggcggccgtaccgccgaagaggtcgtgttccacgacccgaccaccggtgcttccaacgatatcgaaaaggccacgaacatcgcgcgtcagatggtgctcgactacggcttctccgagaagctgggcgccatcaagtggtccgacgacgagcaaagcgatctcggcgcgctcacccacaagtactccgcgcacaccgccgaaatcatcgacgaggaagtgctcaagcttgtggagaccgcgcataccgaagcatggaacgtcatcaacgagaaccgcgacatcctcgacgagctggtacgtcagctgctcgtcaaggaaacgctcaacgagaaggagcttgccgccatcttcgccaacatcaagaaggcgccgaagcgcgaggtctggttgagcgacgagaagcgtcccgattccgacattccgccggtcccgattcccgacaagctgaagaaaagcgcaggattgaccaactgatgagcgataccgatttcgataccctcttcgacgacaaggcccgtgccgctcatgcggccgggcctgtcggctatgacgaggaaggcgtgcgccaggccgtgcgcctgttcttgaagtccatcggcgaggatccggaccgtgaaggtctgctggacacgccggaccgtatcgggcgcgcgtgcaaggagctgttcgccggcctcggacacgggccagaggaagttctgaaaacccgtttcaaggtggacaccgacgaaatggtcctcgtacgcgacatcgaactgttctccgtctgcgagcatcatctgctgccgttccatggcgtggcccacgtcggctacatcccgcagaacggccaagtggcgggcttaagcaaactggcacggttggtggaactgtacgcacgccgtccgcaggtgcaggagcggctcacccagcaggtggccgacgcgttgatggaaggcatcgacgcgcgtggcgtgatcgtggtcaccgaatgcgaccacatgtgcatggccatgcgtggcgtcaagaaggcgcagtcccgtaccgtcacctcggcggtgcgaggatgcatgcgcgacgcggccacgcggaccgaggcgatgagcctgattctgtcgaaccattcgtaagtgcgctttaccgggcggaatcggacagaaccgaacggaagaacggaatgaatgaaggaagaaaaccgatggcgattgatatgaaggcgattcatgatagccagcgcacgttggtgatgggcgtgctcaacatcacggaggattccttctccgacggcggcctctggcttgctccggaggcggccaaagcccatggcgaggcgatgatgaaagccggtgccgacatcatcgacatcggagcggaatccacccgtccgggagccaaacgcgtcagcgaagccgacgagaaggcccgtgtgctgggcgctgtggacgcgctgattcccgaaggagcggtgctgtccatcgacaccacgcgcgcttcggtggcgttggccgcgctcgaacatggcgcgcagatcatcaacgacgtgtccggcggccagttggaccgcgaactgccgcatgtggtggccgaccattccgactgcctgtacatcgtgcagcattggcgtggctggcttgccggcgccgcgggcaatgtgccggacgccgacacctcccgctacgagcatggcgtggtgaatgacgtgtatgacgagctgatgcgtcaggtggatgcggtgcttgaagccggggtgcaggccgaacaggtcatcatcgacccgggcctgggcttctccaagccgggcgtggagcataacctgccgattctggcggcgcttgaccggttcaacgcggctggctatccggtgctgatcggcgcgtcccgcaaacgtttcgtcggctcgctgcttgccggcgccggtgtgaccgagccggacatggcctcaaaagacaacgccaccgcggccatcagcgccctgtgcgcggaacatggcgtgtgggccgtgcgcgtgcatgacgtggcgaaaagccgcgacgcggtcgccgtcggcaacgcatggcgcgagtatgcgaacgcgtgaccgtgcgaatcgcagatagtcacaacatcgcaatcgcggaaataataggaatacggaacgtaggaacggcaaaggaaggctggtatggatcagattcgactgacgggaatccgcgcgacgggcaaacatggcgtgctcgacttcgagcatgagcgggcccagaccttcgtggtggacgccacgctgttcctcgacctcgctgccgccggccgttccgacgatctgaacgacaccgtcgactatggtgcgatcgccaaaggcatcgtggccatcatcgaaggcgaacacgtcgatttgattgaaaagctggccaatcgtatcgtcggcatgattctcggctttccggccgtgtgccgcacgcaggtcaccgtgcataagccgaatgcgccgatcaccgtgccgttcgacgatgtcagcgtgaccgtggaacgttcccgtgaaacagttgacagtccatcgcgtgagcggtcgtcggaacatgggcaggtgcatcatgccatcatcgccatgggaggcaatcagggcgatgtgaccgccaccttgcgtgacgccgttcggtgcattgatgggcttccctccacgcaggtgacgggggtgtcgccgctctatcggaccgacgcatggggcatgccggaaggtactgcggaattccgcaatgcggtcgtgtccgtggataccaggctttcggccgccgaactgctggccggtttgcagcgcatcgaagcctcgcatggtcgcgtgcgcaccgaccattggacgtcgcgcacgctcgatttggacatcatcgactttgacgggcaggaaagcgccgaccccgacctgacgttgccgcatccgcgcgcatggcagcgggctttcgtattggggccgtggcttgcgcttgaaccggacgcagaactcgggggagcgcacgccggttccgtggcgcaactgctgcacgaaacgtccgaccgcgaccatatcgatgagatcgcggacgattggatggttgccggagctcaggatcccatagttcgcgattccgacattgggacgtctgcagatgacgttgatgcgattgacgatgccgattctgttgaatccattgattccattgaacttccggaaggtacggcggcctccaaagcagccgctgcggccgcggcgaaaccgggaccggcatcccgtcgagcggtcatttccctggatagcgtttcaactgatgcggaacaccagttccgtcaggcgatcgtggccatcgacgcgcttcccggcaaccaggtggaaggtatttcgccgctgtaccatgtcagccaggtcgacgactatccggacaaaatggccgccgtcatgcagatttccacgcgcatggacgcgcgtgagcttatcggtgcgttggaatcggtgtcatcctccatttcggatgacctcgacctcgaccttgtggacatggaaggcgtggtccgcaacgaacctgattgcatggtgccgtggccggccgcacgtgagcatgcggccgtgctcgccccatggttcgacatggatccggacgcgaaactcggcagggatccggtcgcgttcctgctggcgatggctccggacgccgcgcaagtgggcatgctgaccgacaattggattatcggagacacgctatgagagcacgcagaaccccttggtggtcattcgtccttgcggccgcgcttggcgtgctggccggcatgggattggcgaaatacggcgagatttcaggcctgccgttggttggcgcaccctggatcgtgccggtggtgctggccgtgttgggcggtgtggtgctgtacatggctctgcagattcataaatacacgaccaaagatcccgtcaaacgcgcgcagctcaagccattggacccgcagaaggcgttcggcacgctggtggcctgcaaagcgctcggacttgcgggcgcggcgttggccggctggtacggtgggcagatcatcatgagtctgccgcatggtgaggcggaattctatagccaagccatcatcgaatgcgtggtggcctgcgtggtatgcgtcgccgacatgatcgtcggcatcgtgggggagtggctgtgccgcatcccgcctatcgacgggcaggaaagtccggccgtgaaaaaggccgcacagcgcaatcgctatgcggccgccgccacgaaggcgtctacaaaatcggctacgaatcctgccacgaaatcgaaagtctgaacgtcagaccttctttaactccgtctcagtccttcttcggcacgcggaacatcgcttcctgcgccatgcaggccaccagctcgccatcctgtgtgtagaccttcgcttggcccaagccgcgtccgtgcgccgcggtcggcgtgtcttgcacgtacagatgccactggttgatgtcgatgtcgcggtaccaccacatcgaatggtcgatggacgcatacgaaatgcccggcgtggcgatgcttaagccagcacggcgcagaatcggctccagcatgatctggtcgcagcccatcgccagcatcgcacgatgcatgacctgcggcacgtccaccttgccgtcggccttcatccacaccatctgcttgccggaatcctcgctggcgctcttcttgtcggcgccaagcatgatggtgcgcgtcacatggcgaatatcgaacggcgacttctccgcataatacttggcgaacggcgactgttccgcatacggctccatcagttgcttcgcgctggtcaggctgtcgggatcgggaatgttctcaggcatcgggtcggcgaattcgatgccttcctggtcatgttcctggaagctggcgattgccgtcaaaatcgagccctgcgcctgcgtgacattcacgcgacgggcggagaaggaacgtccgtcacgcagattttccacgtcgaacagcagatcctgacggatatcgccggccgaaatgaaatagccgtggatggaattcggcagacgggatggagcgacggttctcgacgcggccatcagcgactgcgcgatgacctgtccgccgtagactcggccagtggggaagtacaggctttcgccgttgatatacgtatggttgcgatagtttgagggcgtgcccagctggagcacctttgccagtcgctgcagcggcgtcatgtctgtctgcgtcatgatggcctcgattccttccgcgtgtggatagctctttatgctggcatcgagtctatccatacgtagtaaatttcgtcggattgttttgtaacgagtacgtgagaagaatgaacggttggttagcggcaacggttgacgtatggcaaagcgccaccgctcgtaatgaagggtggcgctttgctgaaatctgcgcttaacgcgactcgattggatctgtctgcctttagcgggtcagcttgcggtgcaggcggtgcgggcgggccgcatcctcgccgagacgggcgatgcggttctcctgataggcctggaagttgccttcgaaccagtaccagttggccggattctcgtcagtgccctcccatgcgaggatgtgcgtggccacacggtcgaggaaccaacggtcgtgggagatcaccacggcgcagcccgggaaggcgagcagcgcgttttcgagggattccagggtttcgacgtcaaggtcgttggtcggttcgtcgagcagcagcaggttgccgccctgcttcagggtcagcgccaggttcagacggttgcgttcgccgccggacagcacgcccaccagcttctgctggtcggaacccttgaagccgaaggacgccacgtaggcgcgggtcggcacttccacgccggccacctcgatgaagtcgagtccgtcggacacggcctcccacaggttcttgttcgggtcaaggccggcacggttctggtcgacgtagctgatcttcacggtgtcgccgatcttgagcgaaccggaggtcaacggctccaagccgacgatggtcttgaacagggtggacttgcctacgccgttcggtccgatcacgccgacgatgccgttacgcggcagggtgaagctcaagtcgtcgatgagcacgcggtcgccgaacgccttgtggatatgctcggcttccagaacggtggaacccagacgcgggccggccggaatctggatttcggagaagtcgagcttcttgttgttgcgtgcctcctgctccatctggtcgtaacgttccagacgggccttgttcttggcctgacgggccttcggcgaggaacgcacccagtcgagctcgctcttcaggcgcttggcgagcttggcgtccttggcgccctggatctccatacgcttggccttggtctccaggtaggtggagtagttgcccttgtatggatacaggtggccgcgatccacttcgcagatccattcggccacattgtccatgaagtaacgatcgtgggtgacggcgatgacggcgcccttgtactggtgcaggaactgctccagccacagaatcgattcggcatccaaatggttggtgggctcgtcgagcagcagcagatccggagcctcaagcaacagcttgcacagtgccacacgacggcgctcgccaccggagcacacgctcaccggcgtatccggatccgggcactgcagagcgtccatggcctgctcgagctgggagtcgagatcccagccgttggccgcgtcgatatcgttctgcagcttgcccatttcttccatcagcgcgtcgaaatcggcgtccggattggccatttcctcgccaatctggttgaaacgcgccaccttttcggcgatcgggccgaatgccatcttgatgttctcgccgacggtcttggtgtcatccagcggcggttcctgctgcagaatgccgacggtgaaaccaggggtcaggtaggcttcgccgttggaaacggtgtcgaggccggccatgatcttcagcagcgtggacttacccatgccattcgggccgacgacgccgatcttcgcgcccggcaggaagctcagggtcacatcgtcaagaatcactcggtcgccgtaagccttgcgggccttgatcatctggtaaataaactcagccaatgttgtgttccatccttaagaaacgttggaattccagcgttttgcgtatgtcggtcgacggaaaatcgcacttgttcgccgtgctgtggcgcgttgccggcgcgactggttgcggacgaatcgcaagtctgctgcgaactcatcgaagccaagtgttttcggaccgtgtccatacgcaaagtaccatcgccgattatcccatatcccgtctacacagagtggcggttactcgtaggaggcatgggcgccattcgacgaagggcgatccggcatgttcgataatccgactttggcgaaaatcggcgaaacccatggcaagtcggtcgcctaggtgattctgcgctggctggtgcagcggaacatcgtggcgttgcccaagtccacgcatcgggaacgaatggaacagaacatcgatgtattcggcttcacgctgagtgatgaggagatggcggccgtcaccgcgctggataccaagaccagcctgttcttccgccatgataccccggaggccgtcgatatgttcgttggtttcatcaaggaacgcgcgggacgggaatgacgctgacatactgagaaaaaggaagtcccgatgttgcccccgtaggtgctgcggcggcgattttccttggtttttccgcgcttttcgagtacggggtggtgggttggctgttttcggcgggcggctattgattggtgggcggcaggccggcgatcaaatgatcacgccatcgcagtggtcgatctcgtgttggatgatctgcgcggtgaaaccggtgaacgctgcgtggcgctcgcggaatttccgatccatataatccacttcgatgcgctggtatcggacggtgcggcgctcgccctggagcgagaggcaaccttccgccgtatcgaacgcgccgtcttcggcggtgatgtgtggattgaacatcacgaaaatgcggccgccgaaatcctcatccacaaaagcgatgatgcgcttgggaacgccgatcatattggccgccatgcccacgcaaccattgcgatgcgcgtccaacgtgtctttcaggtcctgtgccacggccagatcctcttcggtgttctcggctgcggcggacggctggctcaaaaatgggatggacgtcatgatctcacgctgcatgtgattcctctcgttggatgttgccggtctgccaatattgtagcgtcgcatggctgcgagacggacggctgggcgaacctgtccatttcctgaccgttcgcgtcggcttcgggatgtgaggtgcaacgtgtgcggcttggactggtgcaatatgcttggggtcatggaagatatgttgcaataccgcgaatatatggcgcaggctcttgaactggcccgcaagggtgcgggatgggtggacccgaatccgctggtaggcgtggtggtggtacgtgatggcgaggttctcgccaccggataccatgaccggtatcgtggcccgcatgcggagcgtatggcgttcgactatgccgacgcgcacggcatcgatctgactggcgccacggtcatcgacacgcttgaaccctgctgccatgtcggatcgcagccggcgtgcactgacttgattctggcgcacggcatcgcacgcgtggtggtcggatcggttgacccgaacccgattgtggcgggcaaaggccttcgcatccttgaggaagcgggcgtcgaagtggttcgcgacgtgatgcgggaggaatgcgacgccatcaatcgccatttcttccactacatcaccacgggaaagccgtacattgtggacggcagaaggcgtgcgggtgaatcggactctgagtatgcggtccgtcggcgcgaactatatgccacatatgcggcggtgcttgccggaactgaatcggacgttcctgacgagtctttcgcgcatttcaacggaccggtccaagccgtcggcgcagacgaagtggtgattggcggccacaggccgttactcctggaggccggcgcgctcgcctgcacggatccagacgaatggctgcgtgagctgggcaagcgcaaaatcgacagcctcatcgtggaaagcgacgaagcattcgagcggttgtccatggcttgccaaaaagactgaagcgccattcgtgcgttgttggccgtgtatctcgcttatagatggcggattcgtctgcttgtccagtgctatctcgcttataggtggcggatgaattttgcgaagaggccttagagggcgtaaatcataccctctaagaccttaatgacgtagaggcgccgccatctataagcgaaatagcatcgggcggctttccgattccgccatctataagcgagatacgtgagactgatatgtccagcacccagcaagcatagtggcgagcacatggtcgggcatggcgcgcatggcctcaggggactcaagctcactcggatcgcaatccagcagcactaggtctgccgcatctccagcttgcaacgtcgtacgccccagggcggtggacgaagcgagagcggtttcgaaatccagacattgctcagactggaaaggctctcgatcggaactctccgtgccgaacaccgctgcggaaatggccagccacggatccaacggcgcgaccggcgcgtccgatcccataagcagtttgattccagcccgatgcagactgttgaacgcgtagggaattccggcgggattgccccaaaatcgtgtgatgacgtcacggtcgtccatggcgtgctgtggctggatgctcgcggcaagtcccaattgcgcaagacgtggaatgtcgcgttccttgagcatttgggcatgctcgatggagccgtgcgcgtgggtacgttccgcgcagtcgagcacgatggtgttcgcttcgtcgccgatggcatggcaggcgatgtcgaagccatgctcggtggcgagccgcatatacgattcgatttgctcgggggtgtagctcagtgtgccgtaggtttccggcgtaatgcccgaatacggtgtggagcagtaggcggatcgggtgttgagcgagccgtcggaaatcatcttcatcgcaccgacatggcccaagccatggcttccgggaagttcgtcgccggtatgccagccgtcgtcgatggcttgctgaagtcgttcggggtaaacgccggcttcgatgcgcaatccgtcaagcccctgcttgaagcggtcaatccacgtgtcgatgttctcggccatctcatagtcgcgcacgccgaccacgcctttgccggcggcgtcctgttccgcgttgcgcagcaatcgcatcagctcgtcagccgcaccggggcctttgtccagcttgcagtaagcgtcgaaccattcaagctcgccgacgagtcccgactcgcctacatgcacgccgagcttacgagccgcggctgaattcacccagccgcaatgcatgtctgcgcttgacagcgccacgggctggtcgcccgacaccgcgtcgatcgcagccaatgtcggttgggcatcatcggcccacagggagtgtctgaaccgcatgccgaccacgtactggtccgggtcgagcgtgccggattcgcggcgttcctccaagtgctcgcgtagcaggctcattgcctcatcggcgctgcgggcatcaatcagatcaagccgccccagcgtgtacgaccactgcgtgaagtgcgtgtgacaatcccacaagccgggaatgatccacgtttttgaagccttggctaccgacttttccgaagaccgtacatccgcgatccgcccttgctcaatcgtgatgtcgacagactcatcggaccccacgaaacacacattctcaatcacatacggttcgcccatacatcctcgattcaacaaaatgacctcattgccagccatagtatccttgcaatgcttgcgattgccacgctcgtctcaatcggctatgcgcactttgaattcctccgctgggatacggttatccgcatcagaaaaagaagggcgcagttatccacttatccactgtttgccagaagccggtaggcagcgcggcgacatttcctctactttggcgctatggacaatggagcacaatattcggaaagcctcgcacggctgaggacaagaaccatcgaacaatgtctcgaagcgcagaggcgcaccggaaggcggctggtgttcgcgcttgataccgcactgagtttacaaggcatcgaactgcctcgctaccggcgcggagggcttttggctgatacgctgcacgcggtgattgaaagtaacggcgtgcgaacgatactgcaggggatttgttttgtgctttggtctggacctcagacgcatatgccgattcatcatggtcgattgcgatgcacggattccgtgaccacatgggccatgcatgccaatcggcttgaagatgaagaattggtggttttgggtgattcgatgatgcggcgtgatggacatatgaaaaaggccacactggaggagtttcggatatatgtcgatagcttgtccgatttgtccaactattcaggctccgacagattacgtgcggtgagaggagtgtcgaaaatgcgtagggctctcaggctgatgcgggagaatacagattcttcccaggaaacgagaagtcgaattgttctgttgcgttatggtttgccttgtccggaagtgaactatgccattcggctcaaaggctattctcatgtatttttcgcggacatggcttatccgaatttgaaaatcatcattgaatacgacggcaggcatcatgcctcgcgatggttggctgacagtaaacgtcgggaagcgttggaggatgaaggatggctgtatatccaggtgacggcggaaaatctcagggatgaggattctcaaagggaattggcggaacgtgtggcgcagaggatgtcattgcgtttgggggagcctgtgcggctatgtgggcgaatgacgattgctcagatagccgatggtcggaggaagggcaaccgtctgtgaggcttgggcaagcccatatctcgcttatgaatggcggaatcgggctgcggcatgatgctatttcgcttatagatggcggatgaaatccacaaaaaggccttaagaggtatgaatattaccccctagggccttagcgattcaagaagactgccatctataagcgagatagcatcggtcgggtgaagaaatccgccatccataagcgagatggcggatttctgcggctcactgcacggcggcgagggcttggtcgaggtcggcgatgatgtcggccgcgttttcgatgccgcagctcaggcgcaccaggtcgatgccgacgccggcctcctcaagctgctcctcggtgagctggcgatgcgtggtgccggccggatacagcgtgcagctgcgcgcatcggccacatgcgtggcgatggacaccatcttcagatggtcgaggaacgcggagaccttctcgcggccgcccggcacgccgaaggagatcacgccgcaggtgccgttcggcatgtacttctccgccagcgcatggtacttgtccgtttcgaggcccgggaagctcacccagctgacgcgcggatcggcgtcgagccacttggccacggccagtgcgttcgcgcagtggcgctccatgcgcacgccgagggattccagatgcatgcccatgatccacgaattgattggcgccggagtggagccgaagtcgcgcatgagctgcgcggtggccttggtgatgtatgcggccttgccgaattccttcgcgtaggtgacgccatggtaggagtcgtccggagtggtgagtccggggaatttctccgcatgagccatccagtcgaagttgccggaatccacgatcgcgccgcccacgcaggatccgtggccgtccatgtacttggtggtggcgtgcgtgacgatgtccacgccgtactggaacggacggcagttgatcggcgttgggaaggtgttgtcgacgatcagtggcacgccgtgacgatgcgctgcgttcgcgaacttctcgaagtcgagcacgataagcgccggattggagatggactcgccgaacacggccttggtgttcggctggaacgcggcctcaagttcctcttcggtgcagtccgggctgacgaaggtgcattcgacgcccatcttgcgcatggtcacgttgatgaggttgaacgtgccgccgtagatggcggaggaggcgacgatgtggtctccgttgttgcagatgttgaacagcgcgaagaagttcgccgcctggccggacgaggtgagcatcgcggccgcgccgccttccagctcgcagatcttcgcggcgacggtgtcgttggtcggattctgcaggcgggtgtagaagtagccggattcggacaggtcgaacagtcggctcatctgttcgctcgactggtatttgaaggtcgtggcctggatgattgggggagtgcgggattctccattgcccggctgatagcctccctgcacgcagatggtgtcgacgttttcgctcatatgttccttctttcgattccgcgcttccgtgtgccgcgcaggtgttgcgccgcgatgcgaacaaacaaacaaacacactgtatcactgcattgataaatggcttgattccaatggaaacgccgtatagtttaacgaattgacaaacttaggtaattcaatttattatgtagaccaagacgggcggaaagcccgctgcgaaataaagctttacgtaagtaaaccaagcaaaggagcattccatgggtctgtgggatatcgataagattccgtacgtcggtcgcgaaaaggggccgcaggagggtcttgctttccattactacgacgccgacaaggttgttgccggcaagaagatgaaggactggctgcgcttcggcgtcgcatggtggcacaccttcgaccaggagctggtcgacccgttcggcaccggcaccgcccagcgtccgtggtacggcaagtattccgatccggaggacgaggccctggccaaggtcgactacgccttcgagttcttccagaagctcggcgtcgagtacttctgcttccatgatcgcgacatcgctccggaaggcgacaccctgcgcgagaccgacaagaacctggacaaggtcgtcgacaagatcgaagagaacatgaagtccaccggcatcaagctgctgtggaacacctcctccctgttcaccaacccgcgcttcgtctccggcgcctccacctccccgttcgccgacatctacgcgtacgccggcggccagctgaagcactccctggagatcgccaagcgccttggtgccgagaactacgtgttctggggcggccgtgaaggctacgagaacctgtggaacacccagatgaagcgcgagcaggagcacatggccaagttcttccacatgtgccatgactatgcgaaggaaatcggtctggacgcccagttcctgatcgagccgaaggccaaggaaccgacgatgttccagtacgacttcgatgccgcaaccgccatcaacttcctgcgcacctatgatctgatggacgtcttcaagctgaacctggaaggcaaccacgccaacctggccggccacacctaccagcacgagatccgcaccgcccgcgaggccggcgtgctcggctccctggacgccaaccagggcgacaagctcatcggctgggatatggatgagttcccgaccgacctgtacgagacctccaccgtcatgtgggaagtcctcgccgaaggccagatcggccctcacggtggtctgaacttcgacgccaagccgcgtcgtacctccttcaccgccgaggatctgttccgttcccacatcgccggcatggattccttcgcagcaggcctcctggtcgccgccaagatgcacgaggacaaggtcatcgagaacctgcaggccgagcgctacagctccttcgattccggcatcggcgcaaccgttgagaacggcaccgcctccctggcttccctcgaggagtacgctctggacattccgcaggccaagctcatcgaagccaccaagtccgatcacctcgagtccgtcaaggccacgatcaacaactacatgatcgacgccctggccgaggcgtgagccgaaaacccaccagggttttaggtagcctcgggcgaagtccgagacggtagtcgagggcgagcaatgactgggcgcgtagcgttccggaattgcaggaccgaggcgtgagccgaataaggagtttccgttaggactcctgattcatcgctggatcaaacagtggggctcgactgcgacagagccggatgtggtgtgccgaagcgtcggtgttccggcacaccactcatctttccttcctccttccttaaatttccttcgcacgcaagtcgtttgccggctagatcgccggtgagcggcttgtttgcgttgttagaccaagcgaaaatttcgattattcgcaatgatgtgatgtatccaaacgttcccgaatgaggcgtacttatgaccacaacgattaccatcgccaatcccattcttcacggaatgcatcctgatccgagttggatttgggatgatgatcttcggcaaatcgtgcttgtgacctccaccttcgaactggttccaggcttgcctatttacgtttccagggatatggcccactggaaacacgtgtcggatgccatagatgaggagttggcaagacgtttgctcattcctttcgtggatgactcgggtggcgtctatgcgccgacgctgcgtaggattcgtggcaaatacgtgattgcctgcaccatcgctcgcatcaatggacgcaaagccatcgcggaaggatgctcccaggccgaattggatgcggcccaggcggcggaaggcaacttcgttcttgagtcggactcgatcgacggaccttggcgtgggccgttctggatcgagggcgccgaaggcatcgatccagacatattcgaggatgaggacggcaatgtgtactggacccaaacccgccctgcggtcaacccgcaatgggagggacaaactgaggtctggactcgacgcatcaatccgaagacctggacctttgtcaatgatgggcgtccggcgggaacgggcaagacggtactctggcgtggatacggtgtggaggcggtatgggctgaagcgccgcatctctatcgcgtgggcgactatgtgtatttgatgaccgctgagggcggcaccagtttcgaacacagtgagatggccatgcgcatatatgcgccgcatggtctgcttcaggcgtttgacgtatacgagcgggaagcgtctgaagcgggggaacgtattccgcagatccgtgacggggagcgctgctatctgggcgttgcggttcgtgccttccatgcggataagaagaatccgattctcacccatcggcatctgggcctatcggaatcgttgcaatgcgtggggcatgcggatttgatgtttcatccggagctgggctggtggatggtgtgtcttggtgtgcgggagacgcggggaaagaacgacggtgagttgttgagctatctggggagggagagcttcgtcacccctgtctcttgggagcataatccagccgattggaagttggatggtgccggtgcgtcatccattcatgagggtgatcccggatggccggtaacttgtgctggacttggtcggctggccgacgagattacggttaccgtcaatgatgaaggtggcattgccattgagcctaggattaagtcctcgttctcaggcgatatggaacctgttctggtgaatgtggcggatgattcgacgaatggtatggtggtgcgcgacgaacgcgatatcagctaccgcatgatagcgaaattgccgacgctcatgccgatccccatgaccggttctttggtggtccggcagaattccacgcattacgcggtgttttcgatgcgtggcgcggatgtgctctacgagacggtgaatggagatgattcgcaagccggttccgttgccgccctgcgggctgatggcacacgtccggcggtgcttttcgatgacaaccacttgttggtcatcgtggctgaagggcttgatccggctgattcctcggctttcgtgagccgagggcaggtactgctcagtattgacgctcgtttccttagcaccgaatgggccggtggattcgtcggttgcatggctggtttcatggcatagaatctgaggagtttgaaaggatggttcgttactggtacttcggaggaccatccttggggcgggtcggaaccggaaggctaggggcgtgtggcgtttcttcctccggttgcacatgcgcggtttgtcttgctggtcacccttcaagttgctgtgtgctgttgcgcatcaccagggatgttgacatgatgatgtgcggttgaagcacgtcatcggtggacagtgcttcgaccagcatgcgtacggcggctcttgccatatcttgaagtggctgtcgcacggtagtcagggccgggccaaggaacgcggcggtctgcacgtcgtcgaatccgaccacggatagatcctccggaatacgtaaccccaattgccttgccgcctcgtagacgcccatggcctgcagatcgctgcccgcgaagattgcggttggacgattcggcctttccagaagtgagatggcctgcgcgtaaccgccggaagtgctgaaatcgccttcggtgatgagttcggggtcggcttcgattccatgttctgcaagcgctgacgtgtatccgtccagccgtgccttggagcacatcatctcctccggtccggtgatgatgcctatgttggtatgtccgagtgcgagcaggtgccgggtggcgatcacgcctccggtccagttgtccgcttgcactgacagcgtgtctgggtctgggttgccgaatgggtcgaacaagacgaaggggatgcctctggaatgcagcttgtctcgttcgatgcgtgtcaggttcgagaagacgaggatggcgccatccgcctgtctgcgcagcatgttgtctatccaagacgaatccgggtgctgccggttgcctccttcggtggtgatgacgcttagatcatgcagtttggcttcgcggatggcgccacgtaacacttcgagagcccagacgttgtcgaaatcctggaacacgatttcaatgattcgttggcttttcgcgctggtcgctttacgggagtatccatatcgtttcaacaccgcgttgatggattgtcgagtcgcttcggaaacgtcggccctgccgttgagtgctttggacacggtggagagcgaatagccggtttccttggcgatatcggacaatcgcaccgaggttttctttgtcgtattgcgcatgaggcaccccttctttattcttatcatatccgaaaatgcaaacgaaagtttcgttttgtgattttcgaaagtttcgacatgtcgataatgctttaaagcgttgaaatctcaatggaaataattagttctatgattttactaaaaacttgactttgtatgaattgtttagataacctatggttacaacgaaaacgaaatggaaactttcgaaaagggatcaacggttgattccttcatcggacatggaacacaaggcagtatccgctacagccgcgtttccccgatacgatccactcgaaggagtccttccgtcgttgccatcattttgtcgatgatgatttggtcaataaggagaagacaatgaagttcaaaaccattgcagctgccactcttgcggtggcgaccatgttgggcatgggtgcctgcggctccagcactggtgccaaagacgataagaccattacgttctggcataacgcaacagctggtgacggcaagcagtattgggaggatatggccaaagcgttcgagaagaagactggtgtcaaggttcagattcaggccatccaaaacgaggatttcgaaggcaagctgaccaccgctatgcaggatcccgcctccggcccggatgtgtacatgacccttggtggagccaagaccaaggacatgattgacgccggacagaccatggacctcactgataagatcagtgacaccgtcaagaagcagatgtcttctgcgctggagtccatgtcctatgacggcaaggtctatggtgttccagtcactgtgcagcctggtggcatctggtattccaaggatctgttcaagcaggctggcatcgatgccgcgccgaccaccttcagcgagctgaagaccgatgtgcagaagcttcgcagcgctggcatcgatccgatcgcactcggcggcaaggatgcttggccggtcggtcactggtactactggttgtccatgcgcgaatgctctccgaaggcctacgccaagggcgtcaatgacaaggacttctccgactcctgctggaccaaggccggagatgatctgaaggatttgttggatgcgaatgcttttaacgaaggattcctcaccacgacggcccagcagggcgccagctcgtccgcaggtctgctggccaatcataaggctgcgatggagctcatgggcacatgggagcctggagttctcaaggacctgactccggacaagaagccaatggctgaccttggcttcttcgccttcccgaccgtggacggaggaaaaggcgaggaaggtgctttgatgggcgctgtgaccggtttcgctgtcaatcccgaggctccggacgctgctgttgatttcgtcaatttcatggctgagaaatcaaatcaggagaaatacgccactgcgttcagcaccattccggcttccgacgaagcttacgatgcggttaccgatgaaaatcttaaagccatcatcgaagctatgaaaaagtccgatggcatgcagctgtggatggataccgctctcggcggaaatattggcaacgctcttaattccggagtggtgaatctgctttccggacaggggacttcggctgacatcgtcaaggcgatgaaggacgcagcggccaagggctgacagtgaacatggctggttgaaggccaaaggagggtggatagacagattttcatctgccctccttcctattcgagaaacgtatctggtagtggagaaaaccatgtcaagtacaagcaaagacgcggtgacgctgcgcgctaagcggtccaagaaaccgtccgatggcaaaatgcgtcgtaatgttgagattttcgtactgtccgcacctgcgattcttctgttcgtctgctttgtgattctgcctatcgtcttgggtgcttattacggcttctatcagtggaagggctacggacttccctccaagacaggtaaattcgttggtctccagaactacatcacagcgcttaaggatcccgcgttccaggcggcaattctgcataccttcgaggtcgtgatcggctcgttggtcatccaggctccgctcgccatcctgttcgcattgctgctgaaccagaagttcaaggggcgtggtctcatccgcaccctcatcttcgtgccgtatgtcgtttccgaggtcatcgtcggcacaggatggagcctgttgctacagaagaagggcgccatcaatgagattctggccaacttcggcatcaatggtcccgattggctggccgacccgaagatcgctatttggacgctgctgttgctgatcagctggaaatacgtcggtttcgccgtaattctgatgctcgccggcatgcaatccattcccgaggaactgtatgaagcagccaaggtggatggggcgagtttctggcagatgcagaaaagcatcacgttgccgttgcttgctccgacgttgcggatctgggtgttcctttccatgattggctctctgcagcttttcgatctggtctatatcgtgtggggcaagtatgtgtcgaccaccgctggtgtgtccaccatggccacctacatggtgcgtgaaggtcgtggagccggcaactatggctatggttccgccgttgctctgatcatcttcgtgatctctttgatcatcgcactcgtctatcagaagttcgtgctgaaccgtgacttggacggtgctgttactgaacagaaagaagccgagaagcgtgccaggaagcgcgcaaaagaagtgcagcatcgtgaggttgctgccctggcaagtgaggtgaagtgatgactgccgcaacaatcgcaggacattccaacaaaagcgagtacagcaagaagaatggttaccgtaagtcgtccaagacgccatggggcaacccaatcgtctacttcttctccctggtgcttgtggccatctgcatcactccggtgctgtacattatcttcggcggtttccgtaccaattcgcagatcaccaaccatccgtccgggatgccgaacccatgggtccccgacaactacaagacggtcttcgaaagtgatattttctggacggaactgaagaattctaccatcgtgggtatcgccaccatggtaggcgtcgtggtgcttagcatcatggtgagctttgtcatcgcccgatacaaattccgctatgcgccgcttatgtacgcgttgttctctgctggtctcatgttcccgatgaccgttggcattacacctttgtatctgctgattcgcaatctgggtctggccaactccctgtggggtctgatccttccgcaaattgccttcggacttcctcagaccatcatcatcttggtgccgttcctacagtcgattcctaatgagcttgaggaggcctgtcttctcgatggatgctcccgccttggcttcttctggcgcatggtcattccgctgtccatgcctggcgtggccaccactggaatcctcaccttcgtgggaagctggaatgcctacatgctgccgctgttcgtgctcagtgatgccaacaagtacacattgccacttggcgtacagatgttcagctctgaacactccgttgacaccgcacaggtgttggccttcacctctctggctatgattccggccctgatctgtttcaccatcttccagaagaagatcgtcggcggcctgacaggtgcggtcaagggctgacggaatgtgacaacccacgcccggaagatgttcctttccgtcttccgggcttcatctcttatgcaagaggtacattatgaagatttccaacccggtgctcaccggttttcatgccgatccttcaatgattcgcgtcggtgacacttattacattgccaattccactttcgaatggttcccaggcgttcgcctgcatgagtccaaggacctggtgcattggaacattcttccaagcccgttgagccggtccagccagcttgatatgagaggaaacccctcttcgggaggcatctgggctcctgacctaagctatgcggatggcaggttctggctgatctacactgatgtcaaggtggtcaatggtgcattcaaggattgcactaattatttggtcaccgccgaggacatccacgggccatggagcgagccggttcgtatcaacggggtcggttttgacgccagcctgttccatgacgacgacggccgcaaatacttggtgcagcagacatgggatttccgtgaataccaccaccagttcgacggtatcacattgacggaattcgacgtcgacaccatgaagctcaagccagaaacggcccgcaccatctgggatggcacctcggtgaagatcaccgaaggtccccacctatacaagaaggatggttggtactacctgtttgccgcagaaggcggcacggtgtatgagcatcaggaatctgtggcgcgttcccgtacccttgacgaatgctccttcgaagttatgccgaatggcccgttcatcggtaacttcgacactcctgacacctatttgcagaagcagggccatggagcgttggtggagaccccgtccggcgagtggtattacgcctccctatgcggtcgtccgtggcgtcatgataccgaaccggcccatggcacccgcggatggtgcacactcggacgcgagacctccatccagaaagtcgaatgggatgaggacggttggccgcgcgtggttggaggtcacggcggacagcgttacgttgatgctccgaaagatgccatcgagactttggccccaacaacgcgtgacgaacatgatgagttcgattccggcgagctcgggccaaattggaacactctacgcgtcccgtttaccgacgccatgggcacggtgggcggtggcaaactggcattgcgtggtcagggctcgctgtgcaacctgtttgacttgtctcttgtggctcgtcgctggcaggcatttgatttcgacgccgaaaccaaggtgcgtttcgatccgaagaattacatgcagatggcaggcctgaccaactattacgatgacctatgctggtcatgggcgtttgtcacttgggatgagaaacgacatgcaagggtcatcgaagtggctcagaacgatttcaaccaatatacgtcgttcctcaaggatgacgccatcgtagtgcccgaagaagctgaggcggtatggctgcgcaccaaggtccgcacggaatactattcctacgaatattcctttgacggagaacatttcaccgagattccggtcaagctcgatgcgaagatcctgtccgacgattacgtgaaccaacgttacggcggcttcttcaccggcgcgttcgtgggtctcgcctgtgttgatctgtctggctatgacgcgaaagccgaattcgactatttcgattatcgggagcttcccgacaaccggtagtcgatgccgacgggcggcgattcgccgcattcctgccgcccgtcggttatttggtgaaatgaacgcagactcaatggggagaatgctgagatgactttgcgattgccgaaactacttgacgacggctgcgtgctgcaagccggtgtggacatgcatatttggggcaccggcgatcccggacgcatcgtattgacacggcttgctgacgagcggcatatggtgcaggtgaaagacgacggaacttggaacgcgccgtatggtccgatcgaagctggagggccgtacgagctgaccatatgctacgaggacggagcggagcgtatctcacggcagtgctatgcgggagaggtgttcctgtgctccgggcagtcgaatatggaactgcctatggcttgggtgcgcgccgactatccacaggagtgggaccgtgatcccgatccattgctgcggcagtacaaagtgattcccgattacgatttcaaaggtcctcgcgacgatcacgaccgtgcgttctggcagggctgcgatgcggatacgcttgatgatttctcagcgctcgcatattttttcggtcgcaggatccgccagtggctcggtgtgcccgttggtctgttgaacatttcattgggcggctctccgatcgaatcctggatggacattgacacattacgagcgttccccgaagcgctcgccagtcttgaaccgtaccttggcgatggtgtggcgtcgaaaagaagcttcgattccgttgccgagcgggaccggtggtaccaggcgcttggatacgaggccgtggccgatgcccaccatgaatggctgccattgatcgcgtgggactgtccggaatccaagaacatcgagccgcgcgacgtggcatggcatgacatacgcctgcctggatggtacaaggatcgcggacttgccggtttccgcggcgagattaccatgagaaaaaccgtgttcctgcctccgtcggatgcggggaagcccgccctactgcgtctgggcaccatgaatgatgccgaccatacgtgggtcaacggtgtgttggtcggtgggcgaagcaatgtgtatgagccgcgggactatccggtcgcagccggcgtgctgcgcgccggcgcgaacgaaatccgcatgcgtctggtcgttgaacggcccggcggccgtgtgacgcccggcaaacggatgacactgaccatcggagacgatgtcttcgacctgtccggcatttggcagtatgccgtgaccgccgaagccgaccgcgattgcccattcgaggatttcgtcagatggaagccgaccggcctgtacaacgccatgctcgccccgtgttttccatatgcggtgcgggccgtgctgtggtatcagggcgaatcgaataccggcgactacgccatgcgttatggcgatgagctgaaagccatgattgaattgtggcgtggcaagtggcatcagccggatatgccgttcctgatcgtccagcttccgaaattcggcatcgacgccatcgaggatggtggttggccgcttattcgagaacaggaatggagagtggcggacgaacttgaacacgtggctgcggtggtgacgcttgatgccggtgaaagcaatgatttgcatcctcatgataagaaaaccatcgcggatcgtgcattcaatgtcgcgatggatcttgtgtatggccagcaggctcagcctcagccggttgttgaaaccgcagaggcggacgatggattgttgaggatgcactgcgtgtggcggaattccatgggcgaacagatgcaatcgcagaatcgccatctgatgacgttggatggtgacgttccgcgagaaattgatttcctgtggcacgactgcgccacttcggtgcgggctgaggcatggctggatggttgcgatattgtggcgcgcataccgtcgcgcatgccggacgaggtgcggtatgcgtggagcaacagcccggaatccggtctcatctgcgacggggacggtgttctgcttccgccgtttcatctgccgttgcccatggttgattaggagcagtcatgcgcagacaagtcatgattcgtcaaggatgtgtcgacggattctccgatgcggatcctgtgatcaccgtgtttcggggcattccatatgccaagccgcctgttgatgagttacgctggcgtgagccacaacctgctgaagcgtgggatggcgtgctcgaagccggtgatttcgcgccgatgccgatgcagccgctgcccggctcggatgagttctacggcagggaatggcagattgacgctgacactccgatggctgaggattgtctgtatctgaatatctgaacgccggccttacgtggatgcggcagtggttccgagattcgtacggattcccgttgcgatggtcatgggctgcctgtgatggtatggctttacggtggagcgtttcagactggatctacctgtgagaaggagttcaatggagagcagctggcccgtcagggcgtggtggtggtctccattgcttatcggttgaatgtgtttggttttttcgcgcatgccatgttggaaaaggaagcggttgatggacggccttgtgcgaatttcggatttcttgaccagcggatgggcattcagtgggtaaaggacaatattgccttgtttggtggcgatcctgcgaacattaccgtgttcggccagtccgcaggggccgcaagcgcgttggcgcaaagcgcctcgccgatgaacgatggtctgttccaacgcgtcatcatgcagtctggaggcggaactggtctgttcaatcgccatctgtggtctcttgaggatgcgcagcgaaatggagcgcgttttttgaagtatctggaagttgaatcgattgccgaagcgcgttctgttcctgcgactgatctgctggaggcggcggtgacttttcctgcttgcgattggtctgggcagggtgatgatgtcgtatgggctccgatgactaattggattccctgcgtcgatgggacattccttgtcgagcaataccgtgatgcgcttattgcgggacatcgcgttccgtgtgatttgttggtggggaacacgaccggcgagttcatggttccgggccctgatggcactccgtatccggagggtgagtgcggcaatctggatatgatcgatgcatgggtgtcaggcggcggctcggaaccatacaggtatcgattcgatgtggatatgccgggggatgatgccggtgcgtttcattcgtccgatttatggttttcgttcgggacgctccctgcgagctggcggccgtttcgaggctggcattacgatttgtcccatgcgatgaatcgatattgggtgaatttcgcggcgacaggtgatccgaacggttccggattgcctgagtggacggcatgcggacctgatggtcaacgatatatgctgttcggtggatgccacgatacgccgggtaacgtttcatgcgtcatggtcaagtaagtgaatatagtatggtgtgagcgttcactatagtgcggtggaatgtgatgaaggagacggatatgacgcaggagacggaagcgctgatcgcgtccgacgaggatctgaccaaactgttcgccggcaagccgacgcaatatcgcaaatcgaagtcgctgccgaaattcacaggcgaggccatgcgcgcctgcgcgaagatcaaccgcatcttcttcgatgatccggacgaggcgtaccgtttgtttcacgagctggtcccggacgcgggggagggcgtgcagttcacgccgccgttcaatgtcgactacggcatcggattgaccattggccgcggcacgttcctcaacaaggatttcatggtgtgcggcggcggatatgtgacgctcggtgaggattgtctgatcggtccgcgctgcaccatcgccacacccaaccatgccaaggacgctgccacccgcctggcgggctgggagcatgccagtgccgtgaccatcggtgataacgtgtggttcggcgccaatgtgacggtcacgccgggggtgaccatcgggtcgaattccatcatcggcgccgggtccgtggtgacacgtgacattccggagaacgtcatagccgtgggcaatccagcgcatgtgattcgtgagattcccgaacatgaccctgccttcgccgatgtggaaggtttgctgtagttttgcaaacgtttcatagggtgtgttgacggcaaatcgatttctccagccatgcgatgcaggtgagcgcgtaaagccttatacggaagctgtcgttcatattgtcgtttctatgagtatggttcatgaatcagcatagggccgggaagccccattgttgggaagcttcccggccctatgcctgaattcctgcggtgatggatcagccgcgggccttggcgtaggcttcgtatacggcttcggtcggttcgccggtctccacgccgtcgatggtgagttgccatgccggaggctcggtttcgccggacagcacccaggcggcctggcgggccgcgccgatggccacgtattcgtcggtggcgggtcgggtcacgtccatgcccagaatgcttggtgccagcgtgcggatagcttcggacttcgcgccgccgccgatgagcagaatgcgcgtgatgctagcgcccagggatcggatgagctccaggcagtcgcgctgggagcacagcagtccttcgacgaaggcgcgggccaggttctcgcgtgtggtgttggccagagtcatgccggagaaggtggcggtggcattcgggcggttcggcgtgcgttcgccgtcgaaatacggcaccagggtgatgccgccggctcccggcttcgaggcgaaggccagcttggccagttcgtcgtaatccacgccgagggcggcgcggccggcgtcgaggatgcgcgaaccgttgatggtgcaggccagcggcaggtagtgcccggtgcagtcggcgaagccggatacggcgccggtcaggtcgtaggttgggttctcggagatggctgcggccacgccggaggtgcccagggaaatggacacgtcgccgacggccatgcccagtcccagcgatgccatggcgttgtcgccgccgccgggggcgagcaggcagccgccttcgacgttcttgccggcgatggccggatcggccttgacgggggcggcgtcgcgcggccccagcacggtgggcagcacgatggcctcggcgtgcgattgcgcggcttcggcgccttccgcggcctcgagcaccatggcgatcaggtcgcggcggtattcgttcgacgcggcatcgtagtagatggtgccggaggcgtcggagcggtcggtgaacagggcttcaagatgggcgtcctcgccttcggtgaccgggccgtaaccggcgatgcgccagctcagccagtcgtgaggtaggcagatggcggcgattttcttggcgttttcgggctcgttctcggccacccatgccaccttggtcagcgtgtaggaggcgacgggggaggagcctacggccttgacccaacgctgcttgcctcgggcgattgggtcttccggctcgccgtcttgtgcgggcgctgcgccgagcttttcgatcagagccgcagcctggggcgccgaactggtgtcgttccacagcatcgcatcgcggatcacattgccttggttgtcgaggatcaccatgccgtgctgctggccgccgacggccagcgcggatacgtcgtccaggccgccggcctgctcggcggcctcttggaatgcgctccaccagtatgaggggtcgacggatgtgccgttcgggtgtttggcctgcccgaatcgtacaagctcgccggtttcggcgtccgtcacgcgtaccttgcaggactgcgtcgatgtgtcgacgcctgcaaccagagtccttgccatagtttgtgttgcctccttgcatgtgccgttcgccggtggcgcacggttaatagttagatgaataaactatactatagtagtgtagcatcaggaaaggctctggaacatcggttcggggaattcatgctgatgcggcaacacggcaaacagggcagggacgggaacggctatggcatctcttcgcaggatcaatcaggacgatctgcgcaatcacaatctttcggtggtgatcgacacgctactgcgtgcctccgggccgatgagccgagcggatcttgccaaggagaccgggctgaccaaggcgacgatgtcgttgctggtgtcgctgctgatcgatgcgggcgtcgtcaaggagggtgagccgcagaactcggccagctatgggcgcccgtccacgccgttgatgctgggaggcggcaaggtgtgcggcgtcggcatgcaggtcaacaccgacggctatggatgcatggctttggacatcaaccacgacatactcaggcacgaatgggtggatgccgacatgagcggcgtcgagccggacgtcgtattcggcaagcttgacgccatggccaaggcgatggctgaggatctggaatcgaaacgatgcatcatcgcgggcgtctcgtgtgcgctgccgggcttggtcacctccgacaagaggctgctcatggcccgcaatctcggttgggagaatgtcgatctgaccacgttcgacgttatgcgagggtatgacgttaccccgtgcaatgaggcgaagctggccgccatcgcgcagattccgggatatgcctgtgcgcgtgcggacgtgttcgatggcgtggattgcgccgactctttcctgtatctgtcgtgcgatatcggcatcggcggcgcgatcgtccgtgacggtgagatcgtgtcgggaagccacggtttcgccggtgagatcggtcacgtgtcggtgtctttggacggtccgctgtgcggatgcggacgacgcggatgtttggaaacgtatgctggccgtcgcgcgctggtcgaggcttccggagtggccgaaaagaatgcggcttcgagcggtgaggcactggagcgtctgttggacgcatggcattcccatgatgtgcggaccgtggaggccgtcggacgggccatcgacgcgctggcctcggccatcggctccgcactgaatctggccgatgtcgataccgtgctgctgggcggttggtggaccgatttcgggccgttcttctacgaaacgctcgaaaaccgtttggaatcgcaggtcttgggggcgtcggacatgcaggtgagcgtgtccatcccgttggtggccgaccatccggcgttgtacggtgccgcggaagtcggcttgcgcaaattcatcgacaatccgctgacgttcatcaccgacaaagcatgattcctgagcgccgccgcaacgtcactcgtgcgcattgacatattgcggattctccactttgcccgttccgccataccgtttgaagccccacagcagaatgagggatttcgcatacgccacccaggcgatgccgaagaggatggcgagaacgcgtatgagcggtacgaaatatgacaggccggccgcgagtacgtcgatgacgacgaggacgagcgagcaggggaaggctcgccaggggaacatcgccgatagcgagaagagcctgccggtggtgttggcgaagcgtgcctgcaacggtgcggcgtattcggcgaacagcgccacgaccacggcggcgatgaccagaagaatcagcggtatgtaggaggcgttggtatcccacgccttccagaacgacaggccgaagaggatggcggtggcgaggatggcgacgagcacccaggccgcaagtccctgtttgaactcgcgtttgaagcgggtgagatattccttgacgaggcggatgtcgtcatgctcgtcataggcgaacattgtggaatacaatgccgcgcgtgccgggccgatggtgacgtttgggatcagcgtgatgaggtagaccagattaagcccgacgaaacgcagcagggtgtccatgaaacgccagaagggcgcgttgatgttgaaccgcatgaatcctcctcgatgatgtgttcggctattgccgatagtactgtgccgtattgtgcgacacgccctatttataagattataaatagctctccaagagcacttagtttgttggaataacaatactttagcgccgatgcggcaagggttttgcggccactgccgtcgctgcaggaagccgctgaaatggacggcgccggcacgctgaccgtgttcacccgcatcatcctgccgatgtgcacgccgattctggcgaccgtgggcatcttctcggccgtgaaccagtggaactctttccaggacaccctgatctacatgaccgattcgaagctctactcgctgcagtacctgctgtacacctacatcaaccaggcgtccgcactggcgaatgcggccaaggcgaattcggcgaatgtcgccgctctggcaagcgccgcgacgccgacctcgatccgtatgacggtttccgtcatcgtggtgctgccgatcatgttcacctacccgttcttccagcgcttcttcgtcaagggcatgatgctgggcgcggttaaaggctgattaacaacacaacgattcttttccccataactgaatatcagaagaaggaatacaaggaggtttccgcatagaactgaagaaaatcaccacccgcgcgattgcggctggcgttgcggctgctacgctgctgtcgctcgcggcctgcggcagcggcagcaacagtgccgacaccaaggacgacggttccgaaatgaccgtcgaggtcttcgactcgctggccagcagccagggtctgcaaaagagcggctggttcgccaagatcgtcaaagacaagttcaacatcaagctgaacatcatcgcgccgaacgtgtccggcggcgataccgtgttcgatactcgctccgcttccggcaaccttggcgatctggtgattgtcggtaccggcaacgggcgtctgaacaagctggtcaaggccaagctcatcgaagacatgaccccgtactactccagcatgaagaatgtcaagaagtacgattccgcggtcaagtccatcgccaagcaggccggcaaggatggcgtgtggggtgttcctcagggtgtctcctcccagtctccgaccgacccgagcgaaggcaacgagtcggctgccgcaccgtacatccgctgggatatctacaaggagatcggctacccgcagatcaaggatctcgacggtctgctcaatgtgcttaagcagatgcaggacagggctcgccaggataccggcaaggacgacatctacgccatgtcactgttcaaggatcgggacggcgatgtgatgcagaacgccgcatccatctgcagctggttcggctacaccaaccagggttccgtgttcatctccgccgacggtaaggacgtgcagcccgccaccaaggagggcggcatctaccagcaggccctggagttcctgaacaaggccgaatccatggggctggtcgatcctgattccaccacccaggactgggataccatgcggaccaaggtcaccaacggcaagaccatgctgtccatctggagctggctgggcaagccgcgtatgaactccgacgagaacaaggccaaaggcgtcggcttcatgctggctccgcttgagaacatgaaggtctattccgacggcttccagcctgacggtgatggcgccaccatcgtggccatcggctccaaggccaagaacaaggcccgtctggccaagttcatcgactggatgtattctccggaaggcatctacgcctcttcctccaactccggtggcgccgcctgcccgaaggatctgggctgcttcaccaccgacaaggacggcaagaacccgaccctgaccaagttcggccagcaggccatgaccggcgaccacgccaacctgaaggtctccgccaagcttggcggctccagctacgatgacggctactctaagctgaacttcaaggccgtgtctcagaacgacatcgacccgaacaccggcgaggcctacaacccgctgctgtggaagtccaaccaggatgagaccgagctgttcaaggattggtccgcccacatggagaacgccaccaacgacatcgactatctgcagaaggcaggcaagctctccatcgcagccggtgcgtcctacaccactccacaggaggattccacggtttccgccacccgcagctccgtcaagtccgaaacggtgaacgcctcctggcaggccatcaccgctgcgggcaagttcgagaagacccttgacgaagcccgcaccaagatcgacaacctcggctacaaggaagtcctcaaggtcgaccagcagaacgccaaggacctgatccaggcccgcaaggacatcgtcaagcaggccaagtaattcctggcgttccggctggagcgttttcgcttcggccggaacgcctcgcctaatcacataaccaacaaggggcgtcggactcttcgaaccgggccgacgccccgcaactcttccggttccgcatattccgacggacgtcgtcgtctccttcttgcctgtcggaacttttccgctttttccatgtccactttcctccatgctttcgtgaggagcgcgttcgatgatgaatctccacaccgtcgaatcgcaatgaaacgaaagaaaaacgcatgaccgtaattactgaagccaacaaaaccaaagccagggaactgacggcgcaactcacgctggacgagaaaatcgccattgtgcacgccgcaggcctgttccgcaacggcaacgccgaacgactgggcattccgccgctcaggatggatgatggtccgatgggcgtgcgcgccgaactgcataacgacaattgggcgccgctgtacaacacccgtgactatgtgacctacctgccgtccggctcggcggtcgcctccacatggaaccccgacctggcccgcatgaccggtgaagtattgggggaggaagcccgaggccgaggcaaggacgtgattctcggcccttccatcaacatcaaacgcagtccgttgtgcggacgcaatttcgaatacatgagcgaggatccggtcctgaccgccgcgcaaggtgtggcctacatccaaggcgtgcaggaatccgacgtggccgcctgcgcgaaacattacgcggtcaacagccaggaaaccgaccgattggacgttgacgagaccgtaagcgagcgggcattacgcgaaatctacctgccggccttcgaagcggcggtacaagacggcggcgtgctctccgtcatgggcgcctacaatctcgtcaacggcaccaaatgctgcgaacacaagcagctgctcgacgacatcctgcgcgacgaatacggtttcgacggtttcgtcgtttccgactggagcgcggtgcgcgacaccaaagccagcgccgaagtcggcatggatatcgaactgtccgtcacgccgaatttcgacgattactacttcgccaacccgctgaagaaagccgtggaagacggcgacgtcaaggaaagcgacgtcgacgggaaagtcgaacgcgtgatcgccgtcatggacgcgctgcacatgctcggcgacgcgcacgcaagccgcaaaccaggccgttacgcgacgctcgaccacgcggcgaaggcattggacatcgcccgcgaatccatcgtgctgctgaaaaacgacgcgcacctgctgccgctcgacgaacgcaacatgacccgtctgctggtcatcggtgccaacgccgaccgcatccactccaacggcggcggctcggccgtcatcaaagcgctgcacgaagtatccccgctgctcggcctcaacggcgagctcggcggcaacgtcgaaatcgaatacgcgctcggctacgacgccaaacagatcaaccaggacgaaagctggcaggaggaaagccttgagaattccaagggttccgatgccaaagacgtgaatcgcgcgcgcgaactgcgtgacgaggccgtggcaaaagcccgcgcgtacgcggccgccggagatccggtggtcttcatcggcggactcgaccacgaacatgatctggaaggccgcgaccgcaccgacatgcgcctgccgtagggccaggacgagctcatcgaagcgctcaacaaggcgtggtgcgccaatttctggagccacaccatctacgattggggcgacgtggtgcccgcccgtcggctacggcgacggcatcagcgacgccaaatgcgtggtgtccgggctgcagatggactatcgccgcttccaaagccaggcgcagttggcctgctatacgaacgagcgtgacgcgatccgcgaatacgacgcgaccacgccgatcaccacgaacctcatgggcacgttcaaggatctcgactacttcgagtgggccaaggagatggacgtggtcagctgggacaactatccgggcatggacaccccgccgagcttcaccgccatgtgccacgacctgatgcgcggcatcggcggcaacaagccgttcatgctgatggagcagaccccgaaccagcagaactggttcccgttctgcaaggtcaagcagccggggggaagtgcgtaagctcagctggcaggccgtggcccatggcgccgacaccgtgcggttcttccagatgaagcagtcccttggcggctgcgagcgattccatggcgcggtcatcgcgcatgacggcaccgaggagtcccgcgtgttcaaggagaccgcggccttgggtgaggaactggaccgcatcggcaggcggatcatgggctcgcgcatcgaatcccgtgtagccatcatgttcgactggcagagctactggtcgcttgaaggctgtgtcggcccgaccaccggcttcaactatcccaatgaggttcatcgcttctaccgtgcgttgtggcgtcgcaatgtgccggtggatatgatcgccagcaccacgcctcttgcgcggctcagccagtatgatctggccatcgccccggcgctgatcaccgtgttgcctggtgtggctgaaacgttggaagcctatgtggcggatggtggcaccttcatcaccggctatatggccggcatccatgatgagcatgatctggtggtgccaggcggctacccgggcaagctgcgcaggcttatgggcgtatgggtcgaagagatcgatgcgcttgcgccgggcgaaaccatcgaagtgcatggcggcacggttgatgccaagggcgagatcgtggcgagcattattcatcgcgaaggtgccgagcgtcttgctacgtacggcggcgacgaattctatgctgggcattccgcgctcaccgtcaatgcgtatggcaagggcaaagcctattttgtgggcactccgttggacgagaccggcatgagcgcgttcatggctccgatcatcaaggagctggatctgaagtcgcttgataccccggaggatgtcagcctgtccgtgcgctatggcgatggcggcacccgctacgcgttcctcatcaacaacagcgccgccgacaagcgtctgtgcctcagcgaactcaacggtggcacggagctgctgaccggcaccgtcatcaacgatctgatcgagcttaagccgtatggcgtggatgtgattgcgttgcggtgatcgcaatgctgtagaccacgttagacggagcggaacgactccactcgacgaagccgaatatgaagaaggccgatgcccttgatggacatcggccttcttcgtcaggaaccggtggtatggcgccgttccgcgttcatcgggtggctgcgatcacaccgccggtcatcatcacgcctgcttcttcttcagcagaatcgcggcgcctgcaatcagtgccacagccgcggcgaccgccatgccgagcacggaggagccggtcgaaggggtggacgtgacaccggtcggtgttgtggatggcttcgtgtctgtggcaggctttgccggggtcgttggcgtcgtcggttcaacagcgtccttttcgaacacagcctggatggagacgctgccgtcaggcatctcgaaggcgttgttctcgatggagacgttgcccttcagcacgttccactctttgaagtggtagcccttgttcgcggtggccgtcagcgtgaccttgctgcccttggccgcgcgctcgacatccgcggaggcggagccgccttcggtcgcggagacgttcacggcgtactgcgtattgcgcacgcgccacagctgggtaccgtagaacgggttcgcggtgccgaccaccatgtagtcgtcggtgtcgcagaagatgcgcagaccgtggttgaacgggtcgccgaagccgttgtcggtaacggtgccgacggtcacgccctcattcgcggcggaacggtcggtgatctcgaacaggttgaagccgcgcttggacttggccaggtacggcagggacttggcgtaggccttgaggttggccttgctggtcagcttgaccagcatctcgtacaggcccttgaacttgtcgggaatgatgtcggcgatgctgaagaacgcgtccgtgacttcgccgtagttgttggcgaaatcggcggagcccttgtcggacagctgggagccgaggttgtccagctcgttgttgatgtcgaagagctgcgaggcctcatcggaggagccggaggctgccaggctgcccggaacgatgctgccgtccttgatgccgtcgaccagttccttggtctgggcggcggtcaggctgatcggcttggcggacgagacggacttggcgtcggtggtctgcggctgcgcggcggaggcgtccttgccggcctggatgcgggcccagtcgaccagcgcctccggattgtcggtggacggcatggtctgggtggtcaccttggcgttctgatcgttgctctgcgtggcgatggcggaagccgggtcggtcgggcccatgccccacagcaggcgcaggaacacgcgcaggtagtggacggtgttgttccaatccttctcgttcatgttgagaatgtcaccgttggtgaactgtgcgatcggttccagcaaggtggtggtgttcatggtggacaggtacatcttgccctcgtgaacggtggtctgccaggtgtattggttcatgtggttgtcgtagccgctgcccagaccggtggaaccgcccttcgggaaggtgtcgttcttgtcgcccacgagcatctcgacgttctcgttcttgtccatgcggtataggttgacggactgttcgaggttggtggcttgggttacgaagttgcttttggtgacgaagccctgcagtgcgctggacacgtcgttgtagtcgccgatgtacaagtggtcgccgtagacctgcagggtgcaggcgccggcgctcacacggcttttgtcaagaccgtagtagtacttggcgcccttggcggtgtcgcctacgagcggacgccaggtccaatcggccttgttggtggaatcgcccttgttctcgcccacgtaaatggcgaaggagcgcatggttccggtctcttcgttcagggtgctggtgtcgccggtgcagaccacgacgtacagcttgccgttgaactcctgcacctgatagataccgccgccgccgttgacatcctgtcggtggatggcgggcaggttgtcgaagctcgccatgtcggcgatcactttgtaggagttcggatcggacggggtcttggatgccacaagcagcgccttgcccttgccgtccgcggtcggcttgaggtcgccggcgatcagcgtattgccgaaggagccgatggcacgggtggaggtgaacacgttgcccttgaccagggaacggaagccatccacgtcgacgctgtcatacaccttggtgagcttgtcgttgttggccgggtcgacttcgtagatgcacgggaatccgttttgataggccatggcggtctggatctcctgctgggtgagatccttgttgttggtgtccatgaccatgccctcgaagtacagcttgccgttcatcttgaaggcgctgcggaaggtcgggatcacgcccttgcctccgtcgatgccggtgctcttggacatgaggatcttggtcttgccggtcttcacattgaacttgaacagcatgccgccggcgctcttgccgtcgggttcgccaaggtacatgttgcccgcgtacatggtctggatgagtgcggtggcctgcttggaggtcaggccgaggcttgtcatatcgcggttcagaatggcctgcacgccgaggccgccgtacatggtgccgatgtagacccagtcgccggaggatgctgccgcatagctgtaggactggccgcggtcgccgttgccggtggtgctcaggccggcggtatagggggcgatggtgccgtcgccggtgtaatcgaccacgccatcggcctggctcaggccctgatcggcgtggctgaccttttcgaaggtcatgccgttatcgttctgggaattgtaggtgtattggggagtcaggccggcggagtcgtccgccatggcggtggccgggattccggcgagagccgttgcgcaagcgacgattgcgccaaggcatgcgattgccttgtttctcatctatttctcctgtcttcgcgcgacgtggaaaacgtcattgatgggggcatctagggggctgcccgccgtaagcggcgggagtcataaaagcgtgtattgcaagagcctccaataggcaaccgtatcgataaatattgacaagttgttatggcatatgttgcacaatggcagacgaatatgctatgacgcacttcgattccgccattgcattggtggtacgcaaaggggtgttggctgagcgtatcgggggatggggcggaagcgcttaagtatgggcgggaacgctatactgtaccaaggcaggatttttattaaagatgggttagataacgatatgactgcaaagaagcgcatccttgcgttcgaaatcggaacgttcttcacccgatacgtggtgttcgaggacgggcgcatgggcattccgggtactatcgcgactccggtcgacggcgaggagcccttctaccaggcgctcgcgcatattgtttccaagcagcgtgcccctcttgacggcatcgccataagcgtgcccggcttcatcgacacggagaagcaggtcgccgttaccgccggcgcgctaagcatactgtacggccatgaaatcggcagaaaactgcagggctatcttgacgacccgatccccacatggatggagaacgacgccaactgcgcggcaatggcggagaagctgagcggcaacgccgtcaaactcgacgattttgcgctgatcaccatcgacagcggtgtgggcggtgcgttgttcctggacggcaggatccgccgaggcaaggattggcgtgcaggcgagctgggcatgatgatcccgaactatgagaccggtggattccacaccatgcaggattacctgtcgaccatcgtgctggcggaggagtacgccaaggaattcgacgtgccgacaggctccatcgtgccggccaccctgttccatcgtctcgatgagccgcgtgtgcgcaagatcgtggaccggtggatcgactatcttgccatcggcattttcaacatcgtcgccgtggccgaccccgaatgcgtgctgctgggcggtggcatctgccgtgaacagcaattgctgccgctggtcaatgcggcgctcgacaagatcccgcagtggagcgatttccacacggttgtcaagcgctgccggcacaccaacaacgccggtctgatcggagcctactacgccttcgaaaccgaggtcgaaggcatggagaaggtgccgatccgctagtcgcggatgcttccgatacgaaaatcggcgggtccgcttcccgtgaacggccccgccgatggcgaatatgcacaagagcggtgggcggtcgatatcgatcttccgctgtaatgctctgctgatcttcggggtcagagctactgccgtgccgacaaggtaagcggcagcaggcaggattcgttcttcgggtcgtgctccgaggggtcgcggaagccctgccattcgctatcggggaagatgatgtcggagatgctcatccattgctccagcagattcatcgaattgtcacccagccaacggtactgcagaccgtccatggcgctcatcgccagggtgtacaggtcgtagaaccgttcctcgtccacgtccggcggcagcagccagttcatcgagcaaatcatctcccattggcgcaaatggcggccgatgaagaaatcgtgggccgggtgcgaggggttcagcgcctcgccgttcagcaccgaatacagctgcacgagctcggggcgctgcagattgtacagcacgatgttcaggcaatagcgcgggtagtagtagacgcggtgcccgtcggcgtcgacgatggcggccgtcaccgcgttgtattcgtcggcatcgatggtgtcgtagcattccgacagcaccatgttgagcagatcgtccttcgaggagatgtaatggtacaacgccgcctcggtgatgcccagctcgtcggagatgttctgcaacgacatgccccagaaccccttggtggcgatgattttgacggcggcctgcaggatttgcaggtggcgttcctcctgactcatacgcttgcgtttgacgaaggtcttgtcgcccagcgtgtccctggcggtagtggcccccgtagcgttgccgatgcgtgaggcggccggccagttgctctggtcattcaggaatccatcccatgccgcgacgctcatagccagctccttacacccctgctcatcgtgtccctcataaaaccatccaatactattacgccctctggcctctaggcgaagagtcgccgtagccacgcgttggccaacaccggccattgctggacgcatggctcgatgccattaaccccctgccacgccgtttccgcagtgccaagcgccagaccatgcccgccttgggggaacagatgcgcctcgaccggcacgccggccttcttgcaggcatcgaccaacatcagcgtgttctcgaccggtacgcaatcgtcggtgatggtatgccatacgaatacgggcggcgtcttcgcgtcgatatgccgttcgatggacaccgcgtccaacgccacctgattatcgctgttgtcgccaagcagacagtcgaagctgccacgatgcgcgagcgggcctgaagtgatcaccgggtagccgagcatcaatgcgttcgggcgcaccgcgtcagggtcatagccatgtgcccgcatggtgtcgtcacccgccgtggtcgcaagattggccgcaagatgaccgcctgcggaaaatccgattaccgcgatcttactggggtcgcaatgccagtcgtccgcatgcgcgcgtatgcgctgcactgcttccgcggcttccagcaaagccgtggggaagacggatggcgcgacggaatagcgcagcacaaacgcgttgcatccggccgcgaggaactgcatggcgatcggttcggcctcgcggtcggaggtcatggcatagccgccgcccggaatcaccagaacgctggggcgttgacgtttgggatcgatctcctcgctgttgtcgagaacgtaccggacgaacgtggcctcactgccatcgatgccggtgatgatgtcttcacaatactgcatatcgctaccttagacggattgtgtgtgcgaatccatgcggccttctatgcggcacacggattcgcactgttctgatcggttcctgccttccacaaggttgcaggaaaccgatggaggatcgccggaacaacctatatgcaagatgctccggcaatccatgttcatgttgaggagagtgtaggcccgccccgtttgtgagcacgttctgatgctcacatcagaacgtgacctcgacatcgacggatttggcatcgctcaaagcgggaaccacattaccgccaatcttcgctccgtcgacgctcaccgtgcgctcgccggtgcgcttcatggcgatgcggtaggtcacgccgcggaacacgcgcgtcacggtcagctggtcgaaccgttccggcagatgcggttcgatggccaggccgtcgagcgtcggtcgcacgcccagcagatactgcgacacgtccacgaacgtccacgcggcggtgccggtcagccaggagttcttgccctcgcccggggtcgctgcctcgggaccggccaccatctggcagtagacgtacggttccaccttgcgcacgtcggacttgtcctcgacatacgccgggcagttgcgctggtagacggcgaatgcctcgtcgtcattgccggcgatggcgttggcgatggagatccacgggttgttgtggcagaagatgccgccgttttccttgtatccgcgcggataggaggagatttcgcccaattcgatgcggtaggtggagtaggcgggtgcgaggatggcggtgccccaatcgcaggtcaggcgttccttgacggacttcagcgcctgctgcgccttgccgtcatcgaggccgatgccggccatcacgcacatgccctgcggttcgatgtagatctggccttcggtgtcctcatgcgtgccgaccttgcgcgagtaggcgtcgtaggcgcgcacgaaccattcgccgtcccagccggcggttttgacggccttggaaacctggccgatttcggcgcgcacgctggccgcctcggacgcgatttcggcgtcggacatgccggccagacgtccataatgctcgaggatgtcggcatattggctgccgtacagcacgaacatgccgccgatgaacacggattcggcgacgccggtgtcgttgttctccacggtctggaagctttcgcccggagtatcggagaaacagttgaggttcagacaatcattccagtcggcgcggccgatgagcggaatgccatgggggcccttatgcgtaatggtgaagttcactgaacggcgcaagtgctcaagtagcggctgttcggagccctcgacgttgttgaacggcaccggttcggtcagaatgctcacgtcgccggtttcggcgagatacgcgtacacgccggccacgagccacagcggatcatcattgaagccgccaccgatgtccgcattgcccttcttggtgagcggctggtactggtgccatgcggaaccgtcctccatttgggtggaggcgatgtcgatgatgcgctcgcgtgcgcgttccggaatgagatgcacgaagccaagcaggtcctggttggaatcgcggaagcccatgccgcgtcccatgcccgactcgtagtaggaggcggaacgggacatattgaacgtgaccatgcactggtactggtgccagatgttgaccatacggtcgagcttttcgtcgccggaatcgacgctgtaggtggtcagcagttcggaccagtaggagttgagctccttcaaggcggcttcgacctgttcgacggtggcgaaacggcggaacagctcatgggccggcttcttgtttatgatgccgaccttggccggatcgttcggatcctcccatttctggtccttggccacttcgatatagcccagcatgaacacgagcgatgcggtttcgcccggctggagttccagacgcacgcggttggcggcgatcgggaaccagccgtacgccacggaatcgtgagccttgccttcggcgatgacctgcggggtgtcccagccgttgaactggccgaggaactcgtcgcggctggtgtcgaaaccgacgacgggcgcgttgacgccgtagaatgcgtaatggttgcggcgctccttgaattcggtcttgtggtacagcagcgtggcatcggttttgcgttcgatctccacctcgccggtggacaggttgcgctggaagttggacgagtcgtccacggcattccacaggcaccattccacggagccggtcacgtcgatgacggccggctcgtcggtggtgttcgtcacgtcgagccgattgatttccgcattggtgtgcagcggcacgaaggcggtgagcttggattcgatgcctcgcttggaagcttcgaacacggtgtagccgatgccttgacggcacttgtaggaatcaagcggggtcttgcatggaaggaaggtcggcgaccaggtttcgaccggcttggcatcggcggaatcggagtccatcaggctcaggtaatagcagcgggagccgttgtctgccggcacgttgttataccggtagcgggtgatgcggcgtagtttggcgtccttgtagaagctgtagccgccgccggtgttggaaatcagcgagaagaagtcctcgttgccaaggtagttgatccacggcaggggagtcgccggggtttcaatcacgtattcctttgcggcatcatcgaaatgaccgtagcgcatgggtgtcctttcgtcggtgaaatggctgtgacgaggtgtactgtatgggtatatcgtccattgatttaattaataggttagcatgttatttacaaacttataaataacgatttgctggcgtgttgccgtcggtcttccaatggtcatctgtcgacgctgccgcaatcgggcagaggttggggtatacttcctcccgttgccctcgtagctcagttggttagagcagcacccttataaggtgtttgtcctgggttcaagtcccagcgagggcacatgcggacctgccggaagcggcgggtcctttgcatatccgcggattgcagtccgtacgccctgcgtgcgacggcgcataccgtgtcccggccatcgcctacactccataaggttatccggttcacgccttgccatcggggcaatgcgacccgggtcccccgaatctctaggagacaaactatgaagcagggtatccatcctgattaccacgcagtgcaggtcacctgctcttgcggcaacaccttcgtcacccgttccacctacaacggcgatcacatgaccgtcgacgtgtgctccaactgccacccgttctacaccggcaagcagaagatcctcgacaccggtggccgcgtggctcgcttcgagaagcgttacggcaagaaggccaagtgagtcttattgcttaggcaatgaaaacgccagtccattcgtgggctggcgtttttcgttaccgacgtgccgtcgcccacctccgacgaccgcacttccgcgccaccttatatgatggacaggttgagtaaggttcagcgacgagtgattccgctgaagcgcagatacgaagaaaaggcgtacattggcagacgaacaattccccgcggccgtcaccgcgcttgaggaataccacaatatcgaacagcagatggccgagccggaggtcgcatccaatcccgacaagatgcgcaagctgggtcggcgccacgccgaactgggtgccatcgtctccgcctacaccgcatacaagcaggtgaaggacgatctggaggcggcccgcgagatggcgtccgaagatcccgatttcgccgaagaggccaagcggttggaaggcgagctgcccgcagccgaagagaagctgcgcaccgcgctgattccgcgtgaccccgatgacgcgcgtgacacgatcatggagatcaaggccggcaccggtggtgaggaagcggcgctgttcgccggcgacctgctgcgtatgtacatgcgatacgcggaaaagcgcggctggtcggtcaccgtgcaaagcgagaacaccaccgagctcggtggcgtcaaggacgtgcagctggccatccgcgccaaaggcactccggcgccggaggacggcgtgtgggcttccctcaagtacgaaggcggcgtgcaccgcgtgcagcgcatccccgtcaccgaatcgcagggacgtatccagacttccgccgccggcgtgatcgtcttcccggaagccgacgaggacgacgatgaaatcgaaatcgatccgaaagacctcaaaatcgacatcttcatgagctccggccccggcggacagtccgtgaacaccacgtattccgcggtccgcatgacgcacatccccaccggcatcaccgtgaacatgcaggacgagaagagccagatccaaaaccgcgcggcggcactgcgcgttctgaagagccgcctgctggccatgaaacacgagcaggaggccgccgaggccgccgatatgcgccattcccaggtgcgctcgctggaccgttcggaacgtatccgcacgtacaacttcccggaaaaccgcatcgtcgaccatcgcacgaactacaaggcgtacaacctcgacgccgtgcttgacggcgatctgcaggccgtgatcgacagcgacatccaggcggacgaagccgatcgtctcgccaaccagaagtaaggcgattgggtggcgacggtattcgaaacggtgcgttccgccgcggacgaactacgcgcggcgggcgtcgacactccgcagcacgacgccaaactgctgctcgccgaagcgttccatacggacctgcagcacgtggacaaagccatgctcatgggcgatggcgtcgaacgtctggccgaaaaagaagacgcggaaccggcgatggaacgtttccagaccatgctggcccgtcgtgtcaaacgcgagccgttgcagcacatcaccggccacgcgccgtttcgctaccttgatttgaaagtcggtccaggcgtgttcattccacgtccggaaaccgaactggtcgtgcaggaaggcgtcgactgggccaccagaaacggcatgtaccgcgccaaagtggtcgatctgtgcgccggcagcggtgcgatcggcctcgccttcgcttcggaagtgccgggcagcgaggtgtgggccgtcgagaaaagcgctacgaccgccgagtggacgcggcgcaacctcgacgagaccgcgaaacggtattccgcaatcgccggcaattatcatctggacatcgccgacgccacgcaaatgccgacgctaagccaacttgacggcaccatcgacatcgtgctcaccaatccgccgtacgtgccgcttgccgacattcccgaacagccggaagtgcgcgattatgatcccgatctggcgctatacggcggttcggcggatggcacgctcattccggaacgcatcatcgcacgcgcggcgaaactgcttcgtgcgggtggacttatggtgatggagcacgacatcacgcagggggagcggcttgccgccttcgcacgaacctgcggcttcgtcgacgttaccgtgcataacgactacaccggacggccacgttatctgacggcggaaaaacagccggcacagtaacttatattcttttgcgccatgctgacggggatataaccagaagttgagtctcactataagaacattttatgcaggccgccgtccgtcaggctataaagaacaatcggaatgcacagagagagaacgggcgtccgtcatgagtggtcgccgtggttccgcgcacggggtttgagatgaacatgattttttccaaggtgcgtgttgaaaggaatgtgcagcgttttcaagaaaagaggaagaacggaatgaacgcgaagttctccgccaagtgcgtcgccctgatcgcggcaggcgcaatgtcgatgtcccttgctgcctgctccggcggcagcatggacgattccagcagctccaacggtagcgcggccaacagcgataccatcacgctgggttccgtcaccaccaactccggcaccgccgccgcatacggcgaggccgaggtcgccggcttcaagctggctgtggatgagatcaacgccaagggcggcatcaacggcaagaaggtcaagctcgagtccatggacgacaagggcgacgccaccgaagcctccaacgccttcaacaagctcgccggcgacaacagcgtgctcggcgtggtcggcccgaccatctcctccaccaccgcggccgtggctccgctggccgaccagtccaagctgccggccatcgcaccggccgccacctccgactccatcgagaccggtggctacatgttccgcacctgcttcaaggactcctaccagggtgagatcgctgccaagttcgcagccgagaccctgaaagtcaagaaggtcgccgtgctgtacggcaccggcgatccgtactcctccggcgtgggcaaggccttcgccgctgccgccaagaaggccggccttgacgtcgtggccgaagagaactcctccagcgccgacgacaccgagtactcctcccagctgcagaagatccaggccgctggcgccgagttcctgtacgctccgtactactactccgtcgctggcccgtacatcatcccgcaggcccgctccgtcggctacaagggctatgtgatgggtcctgacggctacgacggcctgaagatgaccgacgacaagtcgctgtacaacaaggtgctctacaccacccactactctccggacgacacctccaacgccaaggtgcaggacttcatcaagtcctacaagaaggccaacaagaacgccgatccgaacaccttcaccgcactgggctatgactccgtgtacatgatgaagcaggccatcgagaaggccggcaagaacgccacccgcgaaggcgtgcgcaacgccatcgccggcatgagcttcgaaggcgtgaccggcaacttcacgctcgacaagaagggctccccgaagaagtccgtcgtcgtgcttgagctcaaggacggcaagccgcagtacaagaccaccattcagcctgccaagtgagcgtcgcttgcctgaaggcctgaatctgtgaagaggaggggaccgggaaaccggttctctccctttcgcgtatcaagacgaaaataaccatattcagccgctgggcttcttcagcggccaagccggacggttatgtcaaaagtccggcatcatcaacttttgaaaggaggaatgatgggcgatcagatcatcatgttcatcagtcagatcttcaacggtctgaagatcggcagcgtgtactcgctcgtggcactcggctacaccatggtgtacggcatcattcgtttgatcaacttcgcacacggcgatttcatcatggtcggctcctacgtgctgatgcttaccattccggcgatcgtcgcattcggcctgcccgcatgggtggccgtcatccccgcgatcctcatgtgcgtggcggtgggcgtcatcgtggagagggccgcatacaagccggttcgtgaaaagggcaacagcatgacggccctcatcaccgcaatcgcaatgagccttctgctggagaacggctcccaggccatcttcggcgccgactaccagaccgtgcccaccatcatccagattccgacgctggcgatcggcaagctgaagatcgacggcgcgaccatcatcaccatcgtgctcggcgtgatcatcatggtcgcgctgcagctgttcgtcacctacaccaagcagggcaaggccatgcgcgcggtctccgaagacaaggaggcctcgatcctgatgggcatcaacgtgaactccaccatcacgctcacgttcgccatcggttcgggcctcgccgccgtcgcatcgctgatgtactgcgtttcctatccgcaggtgtccccgatgatgggcgcgatgctgggcctgaaggccttcgtcgcggccgtgctcggcggcatcggctccatcccgggcgccatggtcggcggtctggtgatcggcgtggtcgaaagcctgaccaaggcgtacatcggcaccatcaccggcggcgtgatcacgtccgcgttctccgacgccattgtgttcggcatcctcatcatcgtgctcctggtcaagccgtccggcctgatgggcgaaccggaaaccgagaaggtgtgacctcatgaagaaatcaatgctttccaccaaacagtcctatctgatgtgcgcggtcggcatcgtcgtgctgttcggcattctgatgggtgtatgcgaatccggcatggccagcacctacatcaagggcatcatgatgacaagctgcatcgccatcatcatgaccacctctctgaacctcaccatcggcgtgctcggccagctgacgctgggctgctgcggcttcgaagcgatcggcgcgtacagcgcggccctgctgagcaagctgctcgtcgccaacggcgttgcgatggatccgacgctgcgattcctgctgacgacgctcgccggcggcgtggtcgcctgcatcttcggcatcctggtcggcattccggcactgcgtctgcatggcgattacctcgccatcatcacgctgggcttcggcgaaatcatccgcgtgatcatccagaacctgaaggtcgccggcggcatgggcctcgacaagggcgcggccggccaggcgctgatcggcatcgaccgactcgccaacctgtacgtcgtgttctggatcaccgtcgtcaccgtcgtgctgctgttcatgttcgcccgctcccgttacggccgtgccgtcaaggccatccgcgacgacgagatcgcggcaagcgcgtccggcatcaacatcacctacatgaaggtgctcgtgttcgctatctccgcgttcttcgcgggcatcgccggcggcatcttcgcccagtacatcggctcgctgaaccccgcgatgtccggatggctgcaatcgatcaactacgtgatcatggtcgtgttcggcggcatgggctcgctgacaggttccatcgtctccgccatcgcgctgacgatcctgccggagctgttgcgcgccttctccacctaccgcatgctcgtgtactcggtggcgctggtgctcatcatgatcttccgcccgcagggcatcttcggcaactgggaattctccctgaccaagaccatcaacaagctgttctacccgatgaaggtcaaggcgcacggcaagtcgaagcaggctgaatccaccgccaaggcagccaaggacaccgccaagacggacgaaaccgtcgagacggccgccgacaccaaggaggcgcaggcatgagcgagcccatcctgaaagccgaacatctcggcatcaccttcggaggcctcaaagccgtatccgacttcaacatgaccatcaactccggcgagctcgtcggcctgatcggcccgaacggcgccggcaaaaccaccgtgttcaacctgctgaccggcgtgtaccagcccacggaaggcgagttcttcctggacggcgaacgcatgaacggcaagaagacatatcaggtggtgcgcgccggcatcgccagaaccttccagaacatccgcctgttcggccagatgaccgtggaggagaacgtgctggtcgcgttcaacgaatcgttcagctaccacatgggcggcgcgattttccgcacgccgaaattctggaagcaggaacgcgagatgcacgccaaagccatcgacctgctcaagatcttcggactagaaggcctggccgaaaccgaagcggcgaacctgccgtacggcgcccagcgcaagctggaaatcgcccgcgccctcgccaccggcatgaaactgctgttgctcgacgagccggcggcaggcatgaacccgacggagaccgaggacctgctcaactgcatcaacaccatccgcgaccgcttcggcatcgccatcctgctgatcgagcatgacatgagcctggtgatgaacgtctgccagcgcatccaggtgctcgactacggacgcaccatcgccgccggcacgccggaggagatcgccaacaacccgcaggtcatctccgcatacctgggctccgacgacgataccgacagcgacgatgccaagcacgaaagcgaggaagcctgatgctggaagtcaagaacctttccgtttcatacggtgccatcgaagccgtcaaggacatcagcttcaccgtcaacgccggcgagatcgtgtccctgatcggcgcgaacggcgcaggcaagaccaccacgctgcacaccatcaccggtctggtaccggcgaaatccggttccgtgatgtacaacggagtggatctgctgaaaacccacaacaacaagatcgtgaccctcggtatggcgcacattccggaagggcgccacgtcttcacacgcatgagcgtcgaagagaacctggagatgggcgcgttcagcctgaaggaccagtcggacctcaagaaggacctcgacatggtctacggcctgttcccccgtctgaaggaacgccgtaaccagaaggccggcacgttgtccggcggcgagcagcagatgctggcgatgggccgcgcgctgatgagccatccgaagacgatcctcatggacgagccgtccatgggcctgtccccgaagctcgtcaaggagatcttctccatcatccgcaagctgcacgagcagggcatcacgattctgctggtcgagcagaacgccaagatggcgctgtcgatcgccgaccgcgcatacgtgctggaaaccggccgtatcacgatggaaggcgacgccaaggaactgctcaacaacgagcaggtgcgcaaggcgtatctgggcgcctgattcgtgccgtatccgccttgtcggcttggacgcatccaaaccgacagggctttttctatatccgatggaatattcgccggtcgtgttccctccattcgggcgcgccatcgagccatgccttacaataggtaagttgactggctgaaagggaggtgtcatgagcgagatttgcacagtaaacgacgaatcccttgcccgggccgttgaaatcatccatgatggcggattggtggtcatccccactgacacggtgtacggcgtcgcctgcgatccgcgtaacatcgaggcgatccgcaaggtgttcgcagccaaacaacgaccgaaatacaagtcgttgcaggtgttgctgccgtcaatcgaaagcatggagaagctgcatctgaccttgccggtgccgctcaaccgtctggccgccatgttcatgccgggcgctttttcgccgatagcggaagcggaagacgactgttcgcttgccacgttgcgtcatgatccgacaaccggcaaagccacacagggcgtgcgcatccccaattccgcggtcgcgctgcgtattctgcgagccaccgggccgttggccgccaccagcgccaaccgttccggcgaggaaagcgcacaaacggtgcaggaagccgcggacgcgctgggagatgcggtggatctgtatttggacgggggagcgactccgggacatgtgtcgtccacggtggttgcagccgacccgcacgagcgcgacggcatcgcgattcttcgggagggagtgattcgcgagctggtcatccgtaaggctttaacactgaatggcggtgctttgggcgcatgagaatctacctgttcattgccgcggtcgcaggtggcgtcacctatctgctcacgccgctgatccggcacatcgccatcgaaatcggcgcagtcggcgaagtgcgtgcacgcgacgtgcataccgtgccgacgccacgcatgggtggactgggcatgcttatcggcttcaccgtggccatgctgttcgcctctcgcatccctttcatcgaaggcctgttcgcccaatcgcatcaggcatgggtgattctagccggcgccattatgatcagcctgctgggcatggccgacgatttgtgggaccttgactggatgctcaaactcgccggtcagctgctcatctccgtgtttgtggcctggggcggcctgcagatcatctcgttgcctctcggctcgctcgtcaccgcgtcgccgagcttgtcgatggccatcaccgcgttccttatcgtcgcgtccatcaacgcggtcaacttcgtggacggtcttgacggcctcgcttcgggcatcgtcgcgatcggcggcatcgccttcgccatctattcgtacatcatcgcaagaagctcgccgtcgtacgcatccatggcaacgctgatcgacatcgccatggtcggcatgtgcgtcggcttcatcctgcataactggcatcccgcgaaactgttcatgggcgactccggttccatgctgcttggctacctgatcacctgcgcgtcgattgtcatgaccggccgtctcgacccggcatccatccacgccagcatctacctgccggtgttcatgccgattctgctgccgatgctggtgctgttcctgccgatcctcgacatgtgtcttgcgattgtgcggcggttgagcaaaggccagtcgccgatgcatcccgatcgcatgcacctgcaccaccgcatgctgcgcatcggacacaccgtgcagggcgcggtgctgattctctgggggtgggcgtcgctgatcgcattcggctcgatcatgattctgttcttcaaagcgcagtatgtgctgattggcttcctcattgcggcggcgctgctgacggtcgccacaatgtacccctatctgaagcaccgcattccggagatccgtgaggagaacgcggccgccgaatcggacgctcagcatgcgtcggtcggacgcgcccgcggcggcaatgcccgcggcgaacgctgaccgtttttcaacgcgtcaggcatccgcatcatccgtctaaaatatgatgaaacgctttgccaaacggtataagtagcttttattgagattgataatttcggctttcagagccgtgtcgcagtaagtcagcacacgttcatatagtgtgtttatggctacaattcctgatatgaatgcagattccacgttcgccccactccctccggttttcgcccagcttggcctcgcctatgacgatgtgctgctgctgccgaacgagacggacgtcattccgtccgaggtggacaccaccacgcatcttacccgcaacatcacgatgaaggtcccagcgatctccgccgcgatggacaccgtcaccgaatccgacatggccatcgccatggcccgtaacggcggcatcggcgtgctgcatcgcaacctttccatcgacgaccaggccgcccaggtcgacatcgtcaagcgttccgaatccggtatgatcagcgatccgctcaccgtgagcccggacgtgaccctggccgacctcgacaagctgtgcggccgtttccacatctccggtctgccggtcgtggacaaggacaacaagctcgtcggcatcatcaccaaccgcgacatgcgcttcatcgcatccgaggattacgaccgtttgaaggtctccgaagtgatgacccgcgagaacctcatcaccggtccgtccaacatctccaaggaagacgcgcacgacctgctggccaagcacaaggtcgaaaagctgccgctggtcgacgccgaaggccacctgaccggtttgatcaccgtcaaggacttcgtcaagaccgagcagtacccggacgccaccaaggatgagcagggccgtctgcgcgtcgccgcaggcatcggcttcctgggcgacgcctacaaccgtgcttccgctttgatggaagccggcgtggacgtgctcgtggtcgacaccgccaacggtgaggccaagctggctctcgacatgattcgccgcctgaagtccgattccgcgttcaatggcgtggacatcatcggcggcaacgtcgccacccgccagggcgcgcaggccatgatcgacgccggcgtcgacgccgtcaaggtcggcgtcggcccgggctccatctgcaccacccgcgtggtcgccggtgtcggcgtcccgcagctcaccgccgtgtacgaggccgcccaggcctgccgcgccgctggcgtgccgtgcatcgccgacggtggcatccactactccggcgacatcgccaaggccctcgtcgccggcgcatcctccgtgatgctcggcggcaccctcgcgggctgcgaggaagctccgggcgagaaggtgctcctgcacggcaagcagtacaagctgtaccgtggcatgggctctctgggcgccatggctccgcgtggcaagaagtcctactccaaggaccgttacttccaggccgacgtcacctccaacgacaaggtcgttccggaaggcgtcgaaggcgaagtgccgtaccgcggaccgctcaacgccgtgctgtaccagatgatcggcggcctgcaccagtccatgttctacattggcgcgcacaacatctccgaaatgccggaacgtggccgcttcatccgcatcaccgacgctggcctgcgcgaatcccatccgcacgacatcgtcatgaccgccgaggcgccgaactactccggccgtcagtgattggcgaataccgcgcgaaacgcatacgacgcgactaaacgctagataatacgaaacccgtccggtggcaggaatgccgctggacgggtttcgtgcgttttcggcagctattggtctagtgacgtttagttaattgagccatgccgatggcaccgtatgaacgtcaacttacgcgttccgtggtgccacgcagcaccagcgacgtcggcatgacggtgaacggctcgtcaagcgtctcgccattgagcagcgcaagcgtcttacgtgcagcgatacggccgatttccgccggatcctgatgcatggtggtcagatccaatgcggtggcggtgtcgtcatcatcgaatccgaccagcgacacgtcctgtggcacgcgccatcccatgcgccgcagctccttcagcaggggagcggccacggcgtcgacggagacgcagatggcggtcggctgctttggagcgctgagcagctgcgcgacgatgccggaatagatgtcctgctcgctgcgagcatcgatatgggatagtgacggcatgacgatgatgtcttcatccgcgtaaccgcaagcttgtgaggcttcgctgaatcccttcttgcgcagcctgtcggagcagacgaacggcgtggtgttgatgggctgttcgatgtaggcgagcgtcttatgccctaacgatttgaggaaccgtacaatcgtcgccatggaagcctcgtcgtcgatggcgatgccggcgtcgagaccgtgcgtgctcggcgcgttcatgccgaccaccggaatggtcagatcgccaagcacctgcttcttcgcctcgtcgaagtcaaatgacgcctcgatgaccgcgtcgacgttgcggttgcccggaagattttggaaaaacgcatccaaatcgtcctgcgtccacacgatgtaaggaacgatgtcgtatccggccttcgacatcacctcgtaaatgccttcgaaggcgtgggcgttgaaccagctgctgatttcgttcggcagcagcacggcgactcgcatggttttgccggacgccagggacgacgcgcttttcgaaaaggagaaatgcaggcgcttcgcctcctgctcgatgcgttccctggtttcgggactgaccctgtcgagcccgcgaagcgcgcgggacacggtggagacggacactccggctgcctgggctacgtctgcgatggtggttcgtggcatggtcggatggctccttagggtggactatgcgggcggtcggttgcccgcgactgcttcactctatcacgacacgctgcttttgtaaaaacgcttgcatggcttcaggtgttgttattgcttgctttttgaagtgctgccaccttgttctgcctcctgtggtttgcgcttttttgcacaagcgttattattgattatgtcaagcaatgcgataacagcaacgaagctacacaacacaacataaccatcgtaggaaaatcaacgaaaatcgttctacgtacggagttgtgatacgtgcgcacggtgcacaagcgtttgtatgaaaggggacaacatgaccgaagtcaacgatccgtcgctgtggtggaagcaggccgtggtctaccaggtgtatccacgttccttcaaggattcccgcggcgagggcctcggccagatcgccggcgtcaccgagaaaatcggatatctgaaggaactgggcgtcgacgccatctggctgagcccgttctacccgtcccagctggccgacggcggctatgacgtggacgactaccgcaacgtcgatccgaaactcggcaccatggacgatttcgacgcgctcgccaaagccgcgcatgccgacggcatcaaaatcgtcgtggacatcgtgccgaaccacagctccaacctgcacgaatggttcaaggccgcgttggccgcgaaacccggctcgccggaacgcgaccgctacatcttccgcgacggcaagggaccgaacggcgacgagccgccgaccaactggcagaaccacttcggcggccctgcatggacgcgcgtgcccgacggccaatggtatctgcacatgttcaccaaggaacagccggactggaactggaaaaacgaggacgtgcgcgccgatttcatcaaaaccctgcgtttctggcttgaccacggtgccgacggcttccgcgtggacgtagcgcacggcctggccaaggatctcgaccgcgatgatctggacgattatgtggtctggtgcaccaacgatcagcccgaagacggctcccatccggtgatcgaccgcgacgaagtgcacgacatctaccacgagtggcgcaaggtgttcaacgagtacgatccgccggcgttcgccgtggctgaggcgtgggtccgaccaagccgccagcatctgtacgcctccccggacgatctcggccagatcttcaacttcgagttcgccaagaaggattggatccgcgacgacatgcacctcgccatcgaggaaggtctggaaagcgccgaacggtccggttccaccgccacttgggtgatgagcaaccatgacgtggtccgccatgccacccgctacgcgctgccccaggtgccgaccggcgaataccaccgactgccgctcgactggctgctgcgcgacggcaccacataccgggaggaccgcgcgctcggcaccaagcgcgcccgcgccgcgatcatgatggagatggcgctgcccggctccgcctacgtgtatcaaggcgaggaactcggcctgttcgaagtggccgacattccgtgggatgagctggaggatccgtccgcatggcgcacctcccgttccgccagcaccaaaggccgtgacggctgccgtgtgccgctgccgtgggttgcggccgacgctccgcagctggacgatccgaacgatgagttcggccatggcggctccttcggcttctcgccggcagacgcgaaggccgagccgcatctgccgcaacccaagtggtacaaggatttcgcggtcgatgtcgaatcggccgacccggattccatgctgaacctgtaccgccgcgtgctggcattgcgacatgagttgcagaccaccgacctgagtctcgaatggcttccggaagaccagcccggcaaggcgcatgacggcgccaacggtttcccgggtggcaccatcgcgtaccgccgtgccaacggctgggcctcgatcaccaacttcggcgaagaaccgatcacgttgccgcaaggtgaagtgctgctgacatcaggaccgcttaccgacgacggcaagctgccgcaagataccagcgcttggctcaaactggccgattgaccgcacgcaggatgccccgatctgagggtgtccgtgccggataccgcactcgtgcgctgaaccatcgaaccggcagcgcgctccagccgtccgcgtccctccatttgggcgcggacggctttcctgtttccaacgaccgttttccaacgatgacggtccgacgtacctaccctgcggtatcttcatatgttcggcctgcgcagagggcgcgaccgcggaccaatcgaaagaggcaacgatggtagatgcacacgatggcgaaacatacacgtccgaaggctcacgtctgatctggatcgactgcgagatgaccggcctggatatcttcggcggcgacgagctcgtcgaggtttccgtggtgccgaccgacttcgacctgaacgtgctcgacgaaggtgtcgactatgtgatcaagcccagtcagaaggctgtcgaccacatgaatgacttcgtgcgcgccatgcacacccgttccggcctgatcaacgaatgggaacacggtctgagcctcgacgaagcgcaagccaaggtcatcgaatacgtcaggaaattcactccggccggcgtcaagccgctgctcgccggcaacaccatcggctccgacaagaagttccttgaccactacatgccggaactcatggagaacctgcactaccgcaccatcgacgtgagcactttcaaggaactcgcccgccgctggtatccggccgtctacctcaaccgtccgccgaagaacggcggccaccgcgcgctcgccgacatcatcgaatcgctcgacgaactgcgttactaccgcaaggcgttcatggccccggtgcccggtccgagcgaagcggaggcgaaggccatcgcctctgaaatccaggaaaccagcctgctcaacaaggactgacagcacgactccagcgagaggaaccgcatgaccgcagctgattggaccaccatcggccaaccgcaggatatccgccttgtggtcgccgacatggacggcacgttacttgacgaacgaagccgaatccccgacggattctggcccatgctcgcccggctcaaacgccgtggcgtcgaattcgtgcccgcgtccggacgccaatacgccacgctgcgcaacatgttcgccgacaaagccgcggagattctcgacgggggagaactgtcctatatcgcggaaaacggcaatgtggtggcgctcgacggcaaagtcgtggaagtgcatggcgtcgatttggacgtcacgcgtcacgtcatcgacctggtcgccgacgccgctgcctccggcgagcataacgtgggactggtggtgtgtggcctcaaatcggcatacgtgcagcgttccgacaagccgttcctcgatgaagtcggcaaatactacgcggcgctgagcatcgtggacgatctgcacgaagtgctcgacttcgcgcaggaaccgtccgcctacacccctgacggcgacgccgaaatcgttctgaaactcgcgatcctcgaccttgacggctccgaacgattcaccaacgaaaagctcacacatctgcgcgcggactaccaggtggtcgtctccggcaaactgtgggtggacatcatgaacatcgaaaccgacaaaaagcagggcgtcgaggcgttgcagcgcgtgctcggcgtcacacccgcgcagacggcggtgttcggcgactacctcaacgatctgctcatgcttgaggcgggcgactggtcgttcgccatgggcaacgcgcaccccgatttgaaggccgccgcgcgctacatcgcaccgtcgaacgtcgagcacggtgtgctcaaggttgtggacaggctggttgcctgacgatttcgttgcatggggcgcggtgacgtaaagaaggtggcgtaatgaggcaatccgaggcgcttgcgattctgggttccggcgcaagcgtgttcctgacgggcgcgcccggtgccggcaaaacctacgtgctcaacgaattcatacggcaggcgcgtgccgacggcgcatccgtggccgtcaccgcatccacgggcatcgctgccacgcatatcaacggcaccaccatccattcctggagcggcatcggcttggccacggcattgaccgacaatctggtcgaaaccgttcgcacacgccgcaaacgcaagctgcaggaagccgacatcctcatcatcgacgaggtctccatgctgcacgcgtggctgttcgacatggttgaccggatctgccgcatcatccgccgcgacgaacgtccgttcggcgggctgcaggtggtgttgtccggcgattttttccagctgccgccggtttcggtatcgggacgcaacaacgacctgattgcgccgtccgccgaatatctggccagtcgcgagcggtacatgcgcgccggactcaatcccgaaggtttcgtcaccgaatcgttggtgtggcgtgaattgaaccccgttgtctgctatctgaccgaacagcatcgtcaggatgacggccagctgttgaacgtgctgaccgacattcgcgaaggcgcggtggacgatggcgaccgcaatgtgctgctgacccggttgggggccattccggaacccgggcagcaggcggtgaacctgttccccgtcaacaggcaggccgacgcgcttaatgatctgcgcctgttcgaaatcaaggaggagccgcacgaatacctcgccgaatccgagggtgcggcgaatctggtggaacggctcaaaaagaacatgctggcccccgaacggttgtgtctcaagacgggcgcggccgtgatggcggtgcgcaacgacaccgaccaccagtacgtcaacgggtcgctcggcaccgtgcgtggattcgccacgcaatcgcagggcggctggccgatcgtcgaattcgaaaacggcaacatcgtcaccatgaagccgaattcctggcagatgcaggacggcgataccgtgctcgccacggtcaaacaggtgccgttgcgctgcgcgtgggcgatcaccatccacaaatcgcaaggcatgacgctcgatcgtgccgtcatggatttgcgacgcacattcgcgccgggcatgggatacgtggcgctgtcgcgagtggaagggctcgacggcctgtatctgcaaggcgtcaacgagcgcatgttcctggtctcaccggacgcggtccgtcttgatggacaattgcgattggagtcggctcaggccgccgatacgcttgcctccgacggtgtcggagcattccgcgcccgcatgccgcaaccggccgccggtgaggatgacgaattcgcgcaggacgtgctgttctgacccgctgctaaatatcagcccatcgcctgcagggaacgcgcaagatccgggtcgagctcaacttcgtcctcgacgctttccggatcggggtcccaacagctggcgatcacgcaggccagtccgacgagcaaccaaagcgggttgcgctgcaggaactcaagacctggaatcgcccgcgtgacgatgatccatatcaccatgccggccagcgcaatcgcattgaacggcttcttccatggcagggaaatcaacgtgacgcacaatacggctaggcacaggccgatccattggttgccttcggccagcacttccggcgctgccgccgcgaagacgaaatagcagatgatgccgatccagccgagtttgctccaaatcgaaatgtgcgcggtgacgtgacgcatgctgcgtcctttccttatgaagcgatatggtgctgattccagtatcatagaaacggctttagacttatttataactctataaataacgtttttcgcgtattggtgtgcgattcgaggacgtgtggcgcatccaagtcggcttacctgagtaatttggaacgtatgaccaaagcacttcgtatgtctaccatgttcctgcgcaccctgcgcgaggaccccgccgatgccgacgtcgtgtcggacaagctgctgcagcgcgcctgctacctgcgcaaggccgctccgggcatctggacctggctgccgctgggcctcaatgtcctgaacaagatcgagaacatcatccgcgaggagatggcgtccatcgacgcccaggaagtccacttctccggactgctgccgcgcgagccgtatgaggccacccaccgctgggaggaatacggcgacaacatcttccgtctgaaggaccgccacgaggccgactacctgctggccccgacccatgaggaaatgttcaccctgctggtcaaggacctgtactcctcctacaaggacctgccggtgaccctctaccagatccagaccaagtaccgcgacgagttccgtccgcgcgccggcctgatccgcggccgcgagttcatcatgaaggacgcctactccttcaccctcgacaaggaaggcctcgtcaaggcatacatggacgagcgcggcgcatacgagcgcatcttcaaccgtctcgacctgaagtacgtgccggtgcacgccatggccggcccgatgggcggcttcgaatccgaggagttcctggctccgatggagatcggcgaggacaccttcgcccagtcgccgtccggcaaggcctggaacgtcgaggcgctgaccactccggaaccggaagccatcgactttaccgcaacgccggcagccgaaaagcgcccgaccccggacgcggccaccatcgacaagatggtcgaattcgccaacgccaaccatcctcgttccgacggccgcgattggcaggcctccgacattctgaagaacgtcgtcatcgtcgtcatgcatccgcaggacgaagaccacgacgagccgtggcgcgagctcgtggtcgtaggcgttccgggcgaccgtaccgtcgacatgaagcgtcttgaggcgcagttcaccccggccgagatcgaggaagccaccgacgaggatctgaagaagcatccggaactcgtcaagggctacatcggaccgatggcgcttggcccgcaggcacgcgacggaaagaaggccgagaacgcgtccgagaccggtgacgcgctgcgctacctgatcgacgcgcacgtggcacgcggttccgcatggttcaccggcgccgacgagcaggacgtggattactacgatttggtgtacggccgcgatttcgaggccgacggcaccgtcgaagccgtgcaggtacgtcatggcgacatgagcccggacggttccggcccgctgagcttcgagcgcggcgtggaaatcggccaggtgttccagctgggcctcaagtattccaacgcgctcggcctgaaggtgctcgaccagaacggcaagaccgttccggtgtggatgggctcctacggcatcggcgtctcccgtgtgatggcctgcatcgccgaaacccatcacgacgagaagggtctggcgtggccggcagtcatcgcgccggcacaggtgcacgtcgtggccaccggcaaggatgcggccgcgttcgaagccgcagaacagctgatcggtgagcttgaggccaagggcatcgaagtcatcttcgacgaccgcaagaaggtgtctccgggcgtcaagttcaaggacgccgaactcatcggcgtgccgatcatcgccgtcgccggccgcgacaccgtcaacaacggcaccatcgaagtgcgcgaccgcaacggtgagaacgccgaagcggtgccggtcgcggacgccgcgcaggcgatcgcggaccgcgtcgctgcactgctcaagtgacatacggcaatccgtagcgcgtcggtttgatccgacgaacgacatacggcaacggaagaccatcaagcaggtggtcttccgttttttgtttttcatggggaataccgtgcgcatctcacgcacatgaggattgtggatgtcggtggataagtcgaaattatccaccgacaatccacgactcgcccgacgatctcaagttatccacattctccggttgggcttgcagacggatggaacgttcggcgatagtggtcttaccgcggaaacgtgaagatgcgggaagggcatgcagtttaccctctctcaccataaatccacctcactgcctgtcgcttccgtgccgtcaacggcgctttccgcggtccatcattcgtcaaacagaaagggccgaacatggcgcagcagcagggtctcctcaccatcacgggatatgtgggcggccagcccacgcaattcaatcgggaaggcatgccgcatgccagctcattccggctggccagcaccagacattatttcgatggccgaacgcaacagtggaaggacctgcccaccacatggatcacggtgaaggcatatcgaggcctttccgaaagcatctgccaatcgttcaaaaaaggcgaaccggtcatcgtgaccggcgtgctggcggcggaaagctgggtggaccagaacggcaagcaacagtcgaaactcgtcatggaagcgaatgcggcggggcatgatttgagctacggtgtctccaccttccgcaaactcgccaagaaaaacgattccggccagcaagacgcgcagcctggacaggctttaggacgtgatccatatgtgcaagccgcccaacagcggtgcgaaacttcagtcaatgcgatggacgggcagagttccggcgttgacgagcaaggcggctcgcaggccggtacggatagcaacgccgccgaacccctacgtgaggaattcggcggcgatggcttctgacgattgcctgacgcttatgcgatcgctggcatggcctgttaccagatgcgcacgcgttgctccggtgcgagccacatgccgtcgccgggctgcacgccaaacgccttgtggaacaggtccacattacgggcgatgccgttcgtacggcattcggcgggggagtgcgggtcgatctgcagatactgctccgccaactcgtcgcgattcttagtgcgccaaatcgaagcgtagctcaggaagaaacgctgcaggccggtgaagccgtcgatttcaggagcatcggcaagcgcggcttcgatggcttccgtggaaccatccttgccgcggccggccgcttcatcgagagcgaacgcataggccttgagagcgatgttcacaccgctcaaatcgccgatgttctcgccgatggtcaacgcgccgttcacatgaggggccttcgacgggtcatccgaatacttttcggcgagctgcgtcggcacgaactcgttgtactggtcgatgagcttctgggtgagcgccttgaaattggccttgtcctcttcggtccaccagtcgttgagtttgccgtcgccgtcgtattgcgagccctggtcgtcgaaaccgtggccgatctcatggccgatcaccgcgccgatgccgccgtagttcgcggcatcctcggcatccgggttgaagaacggcggctgcaaaatggcggccgggaacacgatcacgttcatggacggctcatagtaggcgttcaccgtctgcggattcatcagccattcgtccttgtcgacggccttgcccaccttggccagctggtagccggtctcatacaggttcgcggcacgcatgttctgggcgaagccggcgtcctcgcgcacatccagcgcggaatagtcacgccaatggttcgtgtagccgatcttcggcacgaacttggacagcttctccaatgccttggccttggtctcgtcgccaagccaagtggaattggagatggacacacggtaggcgtcgatgagattgccgaccagctgctccatacgctgcttggaggtttcggggaagtgacgcttcacgtattcgcggccgacatcctcgccgcagatgccgttgaccagcgagacgccacgcttccaacgcacgcgctgctccttctgcccggacagcgtcttgccgtagaagtcgaaattcgtttcgtcgaattcgtggggaagctccaatgtggagccgatcaccacatgcacgcgggcccacagcttgagatcatccagcgacgcttccttccagaacgcgttgagtccggtgaggaagcttggctcatgcacgatcgtgtggctgaaacagccgcggaaatccaacggctgcacggcagccgcggtggtcgcgtcgtaagcgttctgccaggcgtcgatccaagcgtccaggtcaacatcggcgagcatggcgcacaggtcggcgtaatccgtcgggttataggtcttcaccgaatcgcgcgtggacacgttgtcccaatggttcgccgcgatgcgcgtctccacgtcaaggaaacgcttggcctgcgcatgggcatcctcgtcatcggccgcaagatgcgcgttcttcagctgcttggcgaccatctcgacatacgcctcacggatcggcgcgtaatggtcttccctgtagtaggcctcgtccggcagatccaaaccgtcctgttcgatgtgcacgacattggtctccggcgctcccggatctccgtaaacggcgatgccgatcaggtctggaccgccggtcgggttcatggcgccaagcgcgcgggtgagcgcggccttgtcttcggcctcgtcgatggaagccaactggtcttcgatggcggcgagtccggccgcgtcgatggcatcgacgtcaaggaaactatggtacaaagcgcgcgacttgacggctgggcaatcatcctcttcaaggatgtcgcggatctggttttccgcatcctcggcgagcttgtcgaaggaaccataccgggaacggtcgtcgggaagacggtacatgtcgacccacgggccgttgacgaagcggaacaagtcctgagacgggccggtcacggcggagaacgatgccggatcgatacccgaaaccaaagaattcgaagtgttgttcatggtttcacactatccatctttggtgacaacatcgtgtattcgaatcgaatattcgggtggaacgcaaggtggaatacagaaaggagaacatcgttcgccggtgtatggcccgcgaagtagggttgaaggcatgatcgaactgaaaacccctaaagagattgaagcgatgaagcccgcaggccgcttcgtcggcggcatcctgcgcgacctgaaggaattcaccaaggtcggcaccaatctgttggaaatcgacgaattcgtccacaagcgcatcgtggaccgcaagggcgcctcgtcctgctacgtcgactatgcgcctgatttcggcaccggtccgttcgcgcactacatctgcacgtccgtgaacgacgccgtgctgcacggcgttccgtacgactacaacctgaaggacggcgatctggtcagcctcgatctggcgatcaacgtcgacggatgggtcgcggattccgccatcagcttctgcgtcggcacgcagcatcccgacgacctgcgcctgatcaagtgcaccgaagaggctttggcggccggcatcgaagccgctcagccgggcaatcgtctgggcgacgtctcctgcgccgtcggcgacgtggcacgcgaatacggctacccgatcaacctggagttcggcggacacggcgtcggccatatcatgcacggcgatccgcatgtgccgaacgacggcaaggcgcatcacggctacaagctgcgtccgggcctggtcatcgccatcgaaccatggttcctcaagaccaccgacgagatctaccaggatccgaaggacggctggacgctgaagagcgaggacggctcccgtggcgcacacagcgagcacaccatcgccatcaccgaaaacggtccggtgatcctcaccgtccgcgactagtccaaaaccttatgaaaacgggcttgtgcgattacgcacagcccgtttttttcatgcccgttttgagacggaacccacatatcgaaacgcgcatgccatatagtgggcggtactttttgaactggtaaggagcgaacgagtatggccacagccaatctgagtgtggaatccaaggacttcaccctgccggtggtcgaagccacggcgggcgcggacggcatcgtggtgtccacgctgcgcaatgatggctgggtcacactcgaccccggtttcctcaccaccgcgcaatgcgaatcgaaaatcacgtacatcgacggcaagaactcgattctgcgctatcgcggctatccgatcgagcagctgtgcgagcagtccgacttccttgaagtcgcttggctgctgcgtcacggcgaactgccgaacaaggaccagtacgaccgtttcatctctgacatcaaccaccgcacgatggtgggggaggacttccgtacgttcatgggctccttcccgcgcaccgcgcatccgatgagtgtgatggcgtccgcggtcaacgcgctcgccacgttctacccggacaccacggacatcaacgattccgaccagctggacgaagcggcgaccatcatcatggccaaggcgcgcaccatcgtcagctacatcttccgccaccgtcgcgatgagccgatgctgtacccggactactcgcgtggctatgtcgacgatttcctgcgcatgtgcttcgccgtgccgtatgagccgttcgaatccgatcctctgtatgtgcacgcgcttggccgtctgctcatcatccatgccgaccacgagcagaactgctccacgtccgtggtgcgcatcgccggttcggcgcacgccaacctgtattccgcggtcgcggccggcatcaacgcgctgtccggcccgctgcacggcggcgccaacgaggcggtgctccgccagctcaaggccatccgcgactccggcaaaaccgtcaaggaattcgtggaggacgcgaaggccaacgggcgtcgcatctccggcctcggccaccgcgtgtacaagtcgtacgatccgcgcgcggcgatcgccaagacctatctgcagaagatcatggaacgcaccgacacgctgaagctgccggcggacgagcgcgcgctgttcgacgtggccaccgaactggagcagatcgcattgagcgacgattacttcgtgtctcgtcatctgtatccgaacgtcgacttctacacgggactgatctaccgtgcgatcggcttcgatccgtccatgttcaccacgctgttcgcgttgggccgcatccccggctggatcgcgcaataccgtgagatgctcgccgatccgaacacgaagatcggccgtccgcgccaggtgtacaccggctacacggaacgcgattacgtgccgatggaccagcgccactgaacgatattgacacgcggctccggtttcggacgtgcgcatgcgcctgccatggcttgccgctacagtgtttcaaggaacgaaagaacctaacgaatcgctggaaccggtctacggctccggcatggtcaaaggagcgtacacatgattgaacagcgcaccgcatggggttggggtctggcaagcatcgatgcggccggcaacacccttgacgtgtggtatccggaactcacgttgggcgaggctccggctgaaacctcgcgtccgaatcacaacttcggcgccatcgcgcatgacgaggccgacgcgcgtggcgtgcgccgcatgcccgtgttcaccgtgtccaagctggacgagccgatcgaggacgccgccgacgcctatctgcgtctgcacctgctgagcatgcgtctggccaagccgaacacgttgaatctcgacggcattttcgccaagctcaacaacgtggtgtggaccaactacggtccgttcgccgtcgatgatttcgctttgcgcaagcttgacgtgatggccgccacccgacagtccggagccgtgttggcgccgcacgtcgatgtgaacgtgctgtcgattgacaagttcccccgtatggtcgactacgtcgtgccgaccggcgtgcgcatcggcgacgccgaccgcgtgcgactgggcgcgcacctgtccgaaggcaccaccgtcatgcacgccggcttcgtgaacttcaatgcgggcaccctcggcgtctccatggtcgaaggccgcgtctcgcaaggcgtcgtggtcggcaacggctccgacatcggcggcggcgcgtccatcatgggcaccctgtccggcggcggcaagctcaagaactccatcggcgagcactccctgctcggcgcgaacgccggcatcggcatctccctgggagacaactgcgtggtcgaagcgggcctgtacgtcaccgccggcaccaaggtcaccatctacgacaaggccaaggtcgccgccggcgaaccgctcgaaaccgtcaagggcgccgaactgtccggcaaggacaacatcctgttcatccgcaactccgtgtccggccgcatcgaggcgcgctaccgcaagaccggcatcgagctcaacgagaaactccacaagaactgaaaacggaatggcggagagcgtcatccgcgctctccgcaagaggaaactcgtgaaaatcacactgatcaccgtcggcaaggtcaaagagaagtatctgcgcgacgccatcgcggaatattcgaaacgactgggccggtattgcaagctcgacatcgtcgaagtggccgacgagaagacaccggagcatgccagcgacggactcgaacggcagatcaaggccaaagagggcgaacgcatcgccaaacatattcgtgacgacgcgttcgtcatcgccctcgccatcgaaggcaagcagctcaccagcgaacagctcgccgcgaaaatcaacgacctcggactccacggcaccagccatatccaactcatcatcggcggctcattgggactcgaccccgcgatcctcaaacgagccgactacctgctgagcttttccaaaatgacgttcccgcaccagctgatgcgggtgattctgctggagcagatctatcgcgcatacaaaatcaacgccggagaaccttaccacaagtgattttcgaggcgtttcgcaagaaacgctaagtaggggcgatccggtatagtggcgcgtatgagtgactacagggacgaacgcgagcagcgagaacgccgtcgccgcaccatggtgcgcacggtgtgcatcgtcatcgccgcggcgatgctgctgagtctggtcattcctgcgatctacgcggggctttgacgccttcgggcccgtatgatccgaaacgggccccggtttcccgtatgcgtgcggacaggttcgcggtccgtccatgtgggaaatggatgtgggcacgtggaaaaaccttatggattgtgcgggagccgtggacggctccatgtcagaatagtcaggaacgtaatagaaatgtatggtgtaaacgatggcagaatttgattactccgaggcgatcagcgaagcgcgcgccaaatacgagtccatttccaaggccctcgacgtcgatcgactgaccgccgaggccaaggaccttgaagtgaaagcggccgaacccggattgtgggacgatccggaaaacgcacagaaagtgaccagcaagctgtccgcggtgcagtcgcagctcaagcgtctggcatccgccgaccagcgcatcgaggacgtggagaccctggtcgagcttggccaggaggaagaggacgccgacacgttggccgaggcgaaggccgaagtcgaaagcatccaaaaggatctcgacgatatggagatccagacgctgctcgacggcgaatacgacgaacgttccgccgtggtgacgatccgttccggcgccggcggcgtggatgcggccgatttcgcgcagatgctgctgcgcatgtacctgcgttgggcggaacgcaacggatacaaggccaaggtcatggacacctcctacgcggaagaagccggcatcaagtcggccacgttccaggtggacgccccgtacgcatacgggcgactgagcgtggagggtggcacccaccgtctggtgcgtatctccccgttcgacaaccagggccgccgtcagaccagcttcgccgccgtggaagtggttccgctggtcgaagcgaccgatcacatcgacgtgccggattccgaaatccgcgtcgacacctactgttcgtccggtcctggcggacagggcgtgaacaccacgtattccgcggtgcgcatcacccacatcccgaccggcatcgtggtgaccatgcaggacgaacgctctcagattcagaaccgtgccgccgccatggccgtgctgcagtcccgactgctggtgctgcgccacgaggaggaagccaagaagaagaaggagctcgccggagacatcaaggccagctggggcgaccagatgcgctcgtatgtgctgcatccgtaccagatggtcaaggacctgcgcacggggtatgagacctcgcagacccaggctgtcttcgacggcgacatcgacgagttcatcgaagccggcatccgctggcgtcacgaacagcgtcgcgcggcagccgaggaacaagaagcctaagcgataggcggagggacaacacgatggcgctgatctcgcttgaacatgtgagcaaagtctatccaaagggcacgcgtcccgcattggatgacatcaatcttgacatcgatcgaggtgatttcgtctttcttgtgggcgcgtccggttccggcaagaccaccttgctgagcctgctgcttcgcgaggaggaagccacggatggcgagatccgcgtcgccggcaacgatctgcgacgcctgtccgcacggcaggtgccgcattatcgccggcagatcggctttatcttccaggattacaagctgctcaacaacaagacggtatgggagaacgtcgccttcgcacttgaagtgatcggcacaagccgttccaccatcaaatcgctggtgcccaaagtactgcagacggtggggctcacgggcaaggaaaacaactacccccatgagttgtccggcggcgaagcgcaacgcgtcgccatcgcaagggcgtatgtgaaccatcctcagatcctgctcgccgacgagcctacgggcaacctcgacccgaccacatcgctgggcatcatggaagtgttggacgccatcaaccgtaccggcaccaccatcgtcatggccacacacaacgaagagatcgtcaactccatgcgcaaacgcgtggtcgaattgcacaccggcaagatcgtgcgcgacgagcagcagggatcctacgattccgcgctgtatttcccggatgccgaagtcgagtcgaaatcgcaccaggcattgggtacttccgacccgaacgcgaaataccgtcgacagaacgccatcgattcaacgaacgctcctgacgacaccgtcgacgtggaaggcgcgacgcgcgccgaaaccgtggtgaacgccgtggatgtggtcgccgctgccgtccatgacggacaggggaacgacggcatcgcccgtcttgccaaatccgtgcattccggacgcaccggccgttacggcgaggccttcgcgtcagtggagaccaccttgacctggggcaagggactgagcctcgaacagatggccgaccaggaacaggccgagcaaaccgaacggaaccaacaggccaagacctccgctgaaaatgatgcctccgagactggcgccgacgaagcatcggcgctgtccgctccgcctgcaccgcccgttccaccgacccaaaccgagcctccgacaccgcccgaaccgccggcaccgtccgatgaaaaccctgaggacaccaaggagcacgactgatgcgttttcgtttcatcctttccgaaacatggaacagcctcaagcgcaatgtttcaatgatcatctccgtcatgctggtcacattcatctccttcctgttcatcggcgtatccggcctgatgcaggcacagatcaccgccgcgaagggcgaatggtacgacaaggtcgaagtggtcgtatggctgtgcccggacggtgccagccaggcggcgtcctgctcgtcgggcaaggcgccttccaaccaggagatcgtcgatctggagaacgtgatcaacgaggaagccggcaacatcgtctccaaaatcacatatgtgagccgtgaggacttctacaagaacaccttcctcaagcagtatccgaacggcgaataccaaggacgcgtgctcaccgccgccgacatgcaggggtcgctgcgtctgaaactgaaggacccgaccaaataccaagtggtatccgaagtgttgagcggccgcaccggtgtcgaggaagtgcaggatcaacgcaagatcttcgacccggtcttctcggtgctgaaccgtgcgacggcggtcaccgtggcgctcgccggcgtgatgatcctggtggccatcatgctgaccggcacgacgattcgcatgagtgccgcctcgcgtaagaacgagaccgagatcatgcgactggtgggagcctcgaactggaccatccgcctgccgttcgtgttggaaggcgtgttcgcgtcgctgattggttcgctgctcgcctgcggaacgttgagcgccatggtgaagctgttcatcacggattggctgtcgaagagcgtgcagtggatgcctctgatcaaccagaagacggtatggctgcttgcaccggcccttgtggtgggagccgtcgtgctgtcgatcgtcgcgtccagcatctcgctgaggaagtacctgaaggcataaaccggcggagtgctgaacgagatgttcagcatatttgaagtttgctggatacaatgtcgaaataggtggatttcgggaagggaatacatgtctaggaaaatgacgagacaggtgcggcccatcgttggactgatgcttgcttcggctatgttctgcgccggtggcgtcgcggtcgtcgccgcgccggctccgcaggcgcatgccgtgagcatgtcggaataccaggcgaaggtgtcgaaccacgccaagctgaagtcgcagcttgccggcgtgagcagcgatcttgccgacacgattctgcagttggccgatttgaacgacagccagattcctgcggcggtcgaggccgcggaatctgcccagcaggcggcagaacaggcgcagagcctggcggaagcgaccacgcagcggttgcaagcggcccagcaggacaaggcgaaccttgaggagcagatcaaacagaccggctccgactatgatgacgccaaggccgccgtcgcgcagctcgcccgcgaaagcttccacggctccagtacgtcggatgtgctggattttgtcaccgattcgacgaccgccgacgatttcgtcaacaagatgcagtcgcaggccgcggtcacgcgaagcgaatccaacgcggcaaccgacgcggcgaacgagctgaacacgtcgatgaaccgcaaggaccgtctgggcgccatcgaacagaagatcacccagctcaaggagcaggccgaccagcaggcggcaagcgcccagcaggcggcaagcgaggccagcgccaagcagaccgccctgcagaagctgcgtgacgagggcacggtgaaacgtgagaagctcgaatcgcagaagagccagctgacaacgcagagcgccaaggaagcggcggacatcgtcgccatgaaatcgcagatcgattcatggaacaaccagtacaacaattccaacaacgccgctgtcaaccccaataacaaccagcagcagtcgcgtccgaacaacaacacgaactacaatcccgctcccgcgcctgcacctgcgccggctccgacgcccaataacaacaattccggcggcgccggcggcatgaactatgcggtgcccggcaattgcccggccggttccggatactgctacggacacaacaccggcaacacggtcggcggtgccgcgtatccgtcccgccagtgcacgctgtgggcatacctgaggcgttcccagctgagccttccggtcggctcctacatgggcaacggcgccgattgggccaataccgctcgtggactcggatacctggtgaacaacaccccgcatgtcggcgcggcgatggtgttcgcgcgcggccaaagcgtaggcggacattggaccgccgactggcagtacggccacgtggccgtcgtggaacgcgtgaacgccgacggttcggttctgatctccgaaggcggcactggcttcgcgacgttcccggcttgggagacgatctccaacgccggagcctaccagtacgtccactactgacggttccgttccagacatgaaaccacggcaagcgcgccgtccgcatcgtcgggcgacgcgctttcgtgatatggtcgacggagtcgcgttgcatacactgatcgaaagaaccgggaaggaggtccgacatggccaaggaacagggaaccaaaccgatcgcgcagaacaagaaggcgcgtcacgactacgccatcgaagacaagtatgaggccggtctcgtgttgaccggcaccgaagtgaagtcgcttcgtgaaggacgggcgtcgctggccgaatcgttcatcaccatcgaccgtcgtggggagatgtggcttgagggagccaacattcccgaatatctcaacggcacgtggaacaaccacgcacccaaacgcaagcgcaagctgctgctgcatgcggcgcagatcgacaagctggcccgccaaacccaggccaagggattcaccatcattccgctgagcctgtatttcaaagacggccgcgtcaaggtcgagatcgcgctcgcccgaggcaagaaggaattcgacaagcgccagtcgcttcgcgaggagcaggacaagcgtgaggcgctgcgagccatgcgatacgccaacaagcaggtgcgataaatcggaaaaattccggtttcacatagtgaaagaacgccgattcaggaaaatttttgtaacacaccctctttacgctaggatacggttcggctgaacaggccgatatgaatccataggagagggaacatgcaagcaggaaaagccctgaaaaccgccgccgcgttcatgttgagcgtggccatgctcgccaccggcgcggcatgcggcaccagcgacgacagcgacgcctcggcgtcgaaatccagttcgaagtccagcgaactgaccggttacgatgtttccggcgtgaagaaggacgacgcgatcgccaaaatgctgccggattatgtgaccaaggacggcaagctcaccatcggcatggatacgtcgtacgcgccggccgaattcctggccgcggacggcaagacgccggtcggcttcgacgtggacatcgccaaggcgctggccggagtgttcggtcttgaggccgatccggaaaccgcgaacttcgattcgattattccggccgtcggcgccaagtacgacatcggcatctcgtcgttcaccgtcaccaaggaacgcctcgaggcggtcgacttcgtcagccacttcaacgccggctccgcatgggccgtgaagaagggcaacccgaacaaggtcgacacgtccgatctgtgcggcaagaaggtggccgtgcagaccgccaccatgcaggagaccgccgccaacaagatggccaagcaatgcaaggcagacggcaaggcggagatggacgtcatctccagcaagctgcagaccgatgtgaccaccaacgtcgtcaccggcaaggccgacgtgttctacgccgattcgccggtcgccggctacgcgatcgcgcagaccgacggcgaactcgaaacgcttggcaagaccgaaggcatcgccccggaaggcatcgtcgtcaagaagggcgaccagcagatggacgaggccctgcagaaggccctgcagaagctcatcgacgacggcacctacatgaagatcctcaagtactggggtgttcaggacggtgccatcagcaagccggagatcaacacccccggcaccaacgagtgaatgtttcggaacttttgcgtccgttaatacgctcgtagcaatccgctcttaggttatgccatagccacgtttggctggttgatttggctgggttgaagagaggacttgccatgatgaggaatctgaaaggttgggcggcgctcgcgttgagcgcggcgatggtcgtctcgatgggagcctgcggaacctccgacaaaacggattcccaagcttccgtcgattcgaattcgtcgtcgaccaccggttacgacgtgtccggcgtgaagaaggacgagaagatcgccaagatgctgccgtcctccgtcaccaaggacggcaagctgaccgtcggcatggatacgtcgtacgcgccggccgagttcctggccgcgggcggcaagacgccggtcggcttcgacgtggacatcgtcaaggcgttggcgaaaacgttcggcctcgaggcggatccgcagacgtcgaatttcgattcgatcattccatcaatcggttcgaagtacgatatcggcgtctcgtcgttcaccattaccccggaacgcatgaaggccgtcgacttcgtcagcatgttcaaggccggttccacgtgggtggtcaagaagggcaacccgaacaaggtcgacacgtccgatctgtgcggattgaagatcgcggtgcagaccggcaccacacaggaggaggaagtcaacaagggcgccgaacagtgcaaggcggacaacaagcttgacatccagatcctgtccaacaagctgcagaccgatgtgaccaccaacgtcgtcaccggcaaggccgacgtgttctacgccgattcgccggtcgcgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaccaccaacgtcgtcaccggcaaggccgacgtgttctacgccgattcgccggtcgcgggttatgcgatctcccagaccgacgaccagcttgaggccctcggtgaggacgtcggtgtgaccaaggaggccgtggccatcaagaagggtgattccgacacggccaaggcggtgcaggcggccatgcagaagctgatggatgacggcacgtacatgaagatcctcaagcattggggcgtcgaatccggcgccgtcgacaaggccgagatcaacccgaccgatttgggctgatcggcgcactgacgctgcgggcgtaggggcatcggatgtatatagatcgatgcccctacgctttttgccgattaacgtcagcgtagcattgcggttttatcgtgtgcctttggaatactggacgtctgattggcaaatggacgattaccgttcagtggatgggaagagaatagaaggagaacccactatgtcgttgaaattcaaatcgtttgccgctctcgcgctgagcgcggccatgatgttctccgtcgccgcatgcggcaccacggattccggtgacgccaaaagcgactcgaaggcgaagaacaccaccgttggttacgatgtgagcaccatcaagaaggatgacgagctggccaagctggccgcctccgcgaagaccgtcaaggacggcgagctgtccgtcggcatggaactgtcctatgctccggccgaattctacgccgaagacggcaagacgccggtcggctacgatgtggacatgtccaaggccatcgcccagacgctgggcctgaagccgaagatcgtctcctccatgttcgacaccatcgtcccgtccatcggctccaagtacgatctgggcatcaccgccatgaccatcaccgaagagcgtctgcagtccgtcgacttcgtaagctactaccgcgccggctccacgtgggccgtgcagaagggcaacccgaagaagctcgacacctccgacatgtgcggcgcgaagatcgcagtgcagaccggcaccgtccaggaggacgaggccaacaagatcgccaagggctgcaaggccgacaagaaggccgaagtgatgtcctacaagcgtcaggccgaagccgccaccgcagtggccaccggtaaggccgacgtgttctacgccgattcgccggtcgccggctacgcgatctcccagaccgacggccagcttgaggcgctcggcgacgttgaaggcgtggccaagcagggcatcgccatcaagaagggcgaccagcagctcgacgaggccgtgcagaaggccgtgcagaagctgatggatgacggcacgtacatgaagatcctcaagcattggggcgtcgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcagaagctgatggatgacggcacgtacatgaagatcctcaagcattggggcgtcgagtccggcgctctcgacaaggctgagatcaatccgaccgacctcaactgatctcatcagatagatagaaaaaggaaacagcatcatggcgaagaaacaagtcgacggcgacggcctcgatattcccaatcgcattaaagccttgcctgtcaagcgtacgggtccgatcgtggcggccatcatcgtcgcgctcttcgccgcgatgctggtgcaggctttggtcaccaatccgcgtttcgaatggaatgtggtctggaaatacctgttcaacgagaacgtactggaaggcatcaagtacacgctgctgctgaccgtcatctcgatggtcatcgccatcattctggcagtcattctggcggtcatgcgcaaatccatcaacccggtgctgcgcggcgtgagctggttctacatctggttcttccgtggaacccctgtgtacacgcagctggtcttctggggtctgttcgcggtgctggtgccgcgtatcggcgtgggcatcccgttcacctcaatcgaattctggagcattgactcccagtctgtcatcaccgcgttcaacgccgcatggctgggcttggccctgaacgaagccgcctacctggccgaaatcgtgcgcgccggcctcgaggccgtcgatccggggcagacggaagccgcaaaggccctcggcatgaagcgcacgctcatcatgcgtcgcatcgtgctgccgcaggccatgcgcatcatcatcccgccgaccggcaacgagttcatcggcatgctgaagaccacgtcgcttgtcaacgccgtgccgttcacgctggaactgcagttcgccaccacggcgatcgcgacccgtctgtacaagccgattccgctgctgatcgtggcctgcatctggtatctggtcatcacctccatcctgatggtcatccagtcgcgacttgaaaagcacttcggcaagggcttcgacgcccgtcccgccggagcccgcggcaagcgcacgccgctgccgggcaagaccttcggcgaacccaaggatgacgtcgacaagcagaacgaagccacgttcgcgggaatgaccgcgtgaggggaatgaccatgagcgaaatcacaaccaacgaaatcgttcccgccgtcaaggcgacccaggtgcacaaggccttcggcaacctgcacgtgctcaaaggcatcgacatgaccgtcatgcccggcaccgtcaccgtgattctcggaccgtccggttccggcaaatccacgttcctgcgtctgatcaaccagctggaaaccctgaccggcggcgaaatcgacgtcgacggcgaaatgatcggctacaagtacgtcgacaagggcggcgaacgtgtgctgcagaccctgaacgacaaggaagtggccgaacagcgttccaaactcggcatggtgttccagcgcttcaacctgttcccgcacatgacggctcttgaaaacgtcatggaggctccggtccacgtcaagcacatggacaagaaggaagcccgcgaactcgccattcaggagctgaaccgcgtcggcatgggggagcgtctcgactactatccggcacagctgtccggcggccagcagcagcgcgtggccatcgcccgcgcgcttgccatgaagccggagatcatgctgttcgacgaaccgacatccgcgctcgatccggaactcgtcggcgaagtgctcaacgtcatgctcgacctcgccaaggaaggcatgaccatggtggtcgtcacccatgagatcggcttcgcgcgcgaggtcgccgaccagatcgtcttcatggacggtggcgtggtcgtcgaacagggcggaccggagatcatcgaccatccgaaggagtcgaggtttaaggacttcttgcagcacgtcctgtagcaagtaaggctgtcgtactgccgtaaattcccaatccactgacgtcaagcgtccacagacgtccggtgggttgggttttctttttgctgccgacgatgggcgcgttgcgtgcgccactggttcgcacgatttccctgggggagtgggatttcgcatatatggcaaagatttgtaaggacgcgcggcttggtttcatgattgacatccttacccgataggctaaggagctatgtgtggaatcgtaggatatgcaggaaatgttcggaccgcgtgcggcaaacccttggaggtctgcctccagggtcttcagcgattggaataccgtggatatgattcggccggcgtggcgttgaccgcgcccggcatggaccatgtggcggtgcgtaagaaggccggccgtctcgccaacctggtgcaggacatcgaacgcgatccgatgccggacgccaccgtgggcatcggccacacccgttgggccaccaacggcgtgccgaacgacaccaacgcgcatccgcacacctcgcgtgacggcaaagtggccatcatccacaacggcatcatcgaaaacgcgtcccagctgcgtctcgacctgcagacggaaggctaccatttcgtttccgaaaccgatacggaggtcgcggcgaagctgctgggcaagatcagcgacaagatcatcgaagagaccggcaagcctgacctgttcaaggccgtccgccgtctcgcacgcatgctggaaggcgcgttcaccatcctcgccaccgatgtgcgccagccggacatcgtggtcggcgcccgtcacgattcgccgctggtggtcggtcttggcgaaggcgagaacttcctcggctccgacgtggccgcgttcgtggcctacaccaagcgcgccatggaaatcgaccaggaccaggccgtgatggtgtccgcagacaaggtcgtcgtctccgacttcatgggcaacatcgtgcccgatccgaagacctacaccgtggactgggatgcgtccgccgccgaaaagggcggttgggactccttcatggacaaggagatccatgaggatccggccgccgtgcagcgcactctgctggggcgtctcgacgagaacggcaacatcaacctcgatgaggtgcgcatcgacgagcatgatttcaaagccatcgacaagatcatcgtcatcgcctgcggcacggccgcgtatgcgggcatggtggccaaatacgccatcgagcattgggtgcgcattccggtagaagtggaactcgcccacgaattccgctaccgtgacccgatcctcaccccccgaacgttggtggtggccatttcgcagtccggcgagaccatggacacgctgatggcgttgcgccacgcgcgtgaacagggctccaaggtattggccatctgcaacacgcagggcgcgtccatcccacgcgaatccgacgcggtgctctacacccacgccggtccggaagtggcggtcgcctccaccaaggcgttcgtggcgcagatcaccgccgcatacgtgctcggcctgtatctggcccaagtcaagggcgccatgtatcgagacgaaatcgcccagactttggaatctctgaaggacatgccccgcaagatccagtggattctcgacacccagaccaagaccgtgcaggaagccgccgaacagatggtggatgcgaaatcgttcctgttcctcggccgccatgtgggctatccggtggccatggaaggcgcgttgaagctcaaggaaatcgcctacacgttcaccgaaggcttcgccgcgggcgaactgaaacatggtccgatcgctttggtggacgaaggcgaaccggtcgtattcatcgtgccgccggcgcgcggccgcaacgtgctgcactccaaagtcatctccggcatcgaagaggtcaaggcccgtggcgcctacatcatcgccgtggccgaggaacacgatccggacgtggaacgttacgccgacgtggtcttctggcgtcccgcctgcccgacgctgatgagcccgctggtggacgtggtgccgctgcagctgttcgccatggacatggccaagctcaagaactacgacgtcgacaagccgcgcaatctcgccaagtccgtcaccgttgagtaacgaacgcaggcaccgctacgtgctcgaggaacctcatattcccttcgaatatgaggttctgtacgaggacgagaacatcatcgtcgtcgacaagccgcatttcctcgccaccacgccacgcggcatgtggtatcgcgaaaccgcgctgatccgtctgcgcgaacgctacggcgagccggacatcgtgcccgcgcatcgtctagatcgcctgaccgccggtgtcgtcgtgttcgtgcgcaatccggccgcgcgcggcgcataccagatgctgttccaaaatcgcaaaaccgtcaaaacctacgaatgcctggctccgctcgcccctgtgcgacggccgcggtacggaacggcggtccgcatcgatcggcatatgccgtttccgctggtacgcaggtcgcatatcaacaaggaccgcggacgattacaggcgtacgaaagcgccgacgttcccaacgcggaaacgctgatcgaacggggaagcggcatccgcttcgttgccggcagaccgtacgtgaattacacgctgcatccgaaaaccggcaagacgcaccagttgcgcgtgcatatgaattcgctcggactggcgatactgggcgacgatttctacccggacatcgtgcagcgcgcgtacgacgacttctcgcaacccttggaattggtggcgcgcgaactgcgattcgatgacccgctcaacggcgagccacgtcgattcgtatcgcacgtgccgttgggcgcgggcttatagaaacccacgattttggacattcccctatctcgcccgacacgcccgattatcatggcgttctgttgacttgccggagcgtttccggcatcacgagagtaagagagaaccatgggtaaaatctcgaaagccgtccgcggcgtcgccgacatctacaacggcgcatcgctgatcgtccgtatcatcgtcggcctgatcatcggcaccgtgctggcattgaccatgccccacgtgacctggatcggcgaattcggcaccctgttcgtggccgcgttgaaggccgcggcaccgattctggtgttcgtactggtggccagcgcccttgcgcagggcacgtcgaaactcgaccgccgtttcggcaccgtgctgttcctgtacctgttcaccacgttcctggcagcggtcgtggccgtgctgacctcccgtctattcccgcagaccctgtccttgggcaaggccgccaaagccgacgtggtgccgcaaggcctttccgaagtcatccagacgctgctgaccaacatcgtggccaatccgatccaggccatcatcgacggcaactacatctgcatcctgatgtgggcctgcctgttcggactcgccatgaagtccatcgccaacgaaagctccaaagcgttcatggccaacgtggccgacgccgtgtcccaggtgatccgctgggtcatcaacctcgccccgttcggcatcatgggcctcgtgttcaccaacgtggccgacaacggcctgtccgcgttcaccaagtacggcagcctgctgctcctgctcgtcggcaccatgctgctcatggtgctcgtgttcggcccgctcgtcatcttcatcttcctgcgccgcaacccgtacccgctggtctaccgctgcttcaaggaatccggcctgaccgcgttcttcacccgctcctccgctgcgaacatccccgtcaacatgcagctgtgcgagaagctcgggcttgacaaggacatgtactccgtgtccattccgctgggtgccaccatcaacatgaacggcgcggccatcaccatcaccatcatggccatggctgccgccaacacgctcggcatccagatctccctgccggcggccatcctgctgtccgtggtctccgcgctcggcgcatgcggcgcgtccggcgtggcaggcggctcgctgctgctcatcccgatggcctgctcgctgttcggcatcagcaacgacatcgccatgcaggtggtgggcgtcggcttcatcatcggcgtcatccaggattccgtggaaacctgcctgaactccgcgtccgatgtggagttcgcggccaccgccgaataccatgcctggctcaagcagggccgtcagctgccggccttcatgtattccaagaaggaacgcgccaagctcggcatcgaagcttgattgcgtaccagcttagccgccgatgcgatatcgcagggaaccgctttggaagttcgcttccggagcggttcttccgcattcggcgtatttgggtggatatggggagcctttccaagcttgtgcgtggcttccgcatgacccgtataatcttatgatggtaatcgcaggcgaaatacaaaacggaggtccgtgggcgtggtgctgaaatcggcgaaactggtgaagcagctcatcgccatctgctgcgcgggcgtcatggcggccagcgccgccgcatgcggggccaatacggacacacgcacacagatcaccgtatggtcgtgggagccgagcatgaaacaggtcatcgccggcttcgaaaaagacaatcccgacatccacgtggtttggaagaacaccagcggttacgacaaactcaacaacgccatccaagacggttacggcattcccgacgtggtgcagctggaatattacgcattgcgccagtacgcggtcagcagccagctcgtgcccatcaccggcagaaccgaaggctatgccgatttctacacgcccggcacctgggcgtcggtgcagctcaacggacgggtgtacgggcttcccatggactccggcccgatggccttcttctataacaacagcgtgttcgaacaggttggcgtggacgcgtccaagatccgcacatgggacgactactacgaggccgccaaaaaactcaagaaaatcggcgtgtacatcaccgccgattccggcgacgccagcttctacgacacgatgatctggctcgccggcggacgcccgttctccacgtccaacgatggcaagaacgtgaccatcagactcaccgaagataaaggcacccgcgaattcaccgaattctggcagaagatgatcgatgagggtttggtggcaacaaacctcacgtcatggtcggatcgatggaaatcggccgtgggacaaggcaaagtcgcctcgctgttctccggcgcatggctgccttcgctgctcatgtccgacattcccggcgcggccggcctgtggcgcgtggcccagatgccgacgcccgacggcaaggccaccacatcggaaaacggcggttcggcccttgccgtgctgcaacgttcccgcaaacccgaagcctcataccgtttcatcgaatacgcctgccacaatgccaaaggcatcacaacccgcgtggatggcggcgcgttcccagccgacaaaaacaccctatccgactcgaaattcctcagcaagaccacggtgaccgacgaccgtggcatcgaagtgccctatttcggcgggcaggaatacaaccgcgtgctgtcccaggccgcggagaacgtgtcgaccggataccagtatctgccgttcgaagtgtatgcgcgcagcgacttccggtccacggtgggcaaggcctacaaatggtcgagcctgctgcgcaaagagcagaacaggctcaacatcatcgccgcaggcggtcaggtctccgacacctccaacatcggcgatgcgttgaagaacaccgaatcgtccgaccgcatcaaacttaagggcggcatagccctatggcagaaggacctgaaagaatacggagccaaccagggcttcaccatccaatagcgtctgtgtaattggtttaatcgattgcggcctgcggatagcgcattatccgcaggccgtcggttttcagattgccgggctatgatcgccggttcgcgtcgctggctcttgaatcagcggacgtttcggtcgtagatgtgccgcatgcccttgaaaatcaggtccggatcgtaaatgtcgatcatgttcgtgtcgtcggcgaacacgcggctcaatccgcccgtcgccaccacacggaaatccttgtcgatctccttatggaactgcgcgatcgtgcgttcgatgccgccgaggaagttgtagtacaggcccgcctgcatggccggtttcgtggacttcgccagaatcgacttcggacgggtgatctccacttccggcagctgcgccgtcccttcccacagtgcggccgcggcggtgcggataccggtggtgatcagtccggaaatcaccgacgcgtccgcggtgacgtagttgaacgtggtggccgtgccgaaatcagccaccagaatcggcccgccatactcgtaatacgcgcccgcgcagtcggcgatgcagtccgcgcccatgttctgcggattgtccatgcggatgttgagtcccgttttgatgcccggtcccacgatcatcggatcgatgtcgaggaacttcacgatgctcgcacggaacgaatgcatgaccttcggcaccacggacgaaatgatcacatcatcgacatccgccggcttgtagccgctcaaagccaggaactgcgtgatcatcagcccgtattcgtcggacgtgtggttcgccttcgtggtgatgcggtacgtgcccgcgatgcgcccatcgtcgatgaaaccgatcacgacgttcgtgttgccgatatccacagccatcagaagcatgttgcgttctccttcgcgttttgcggaagttccgttgaaatattgcgattattgcgattgatacggttattgcgattcgaaaatgctgcggttagcgccgttcgccgtccgcacgcatggctgcgagcttgacaagaatacgtttcgcaagtgcgtccttgcccatcttgctccatcgttcgatgcttggcctgtctgcggtttcgcccggcgtcagcaccgtcaccacgttcgtgtccgctgcgaaaccggcgccgggggtgcgcaggttgttggccaccagcatgtcgcaatgcttgccgttaagcttcttcgccgcgttggcctcaaggtcgcgcgtctccatggcgaatccgcacaatgtctggtccggccgcttatgctcgccggcccaagccagaatatccggattcgaggtgagttcgagctcgatgccgctgcgcccgttcttcttgatcttgtcccgggcctgctcgaccggacggaaatcgccgacggccgcggccatgacggtgatgtccgtgtccgagaaacggctcgtcaccacatcgaacatatcccgtgcggtcgtgacatcgaccacatccacgccatacggggcgtccaacgccaccggaccggacacaagcgtcacctgcgcgcccagatcgcgtgcctgttcggccaaggcataccccatcttgccggtggaatggttggtgaggaaccgcaccggatcaagcggctcctgcgtcgggccggcggtgacgagcacggcaagtcccttaagcggcagctcgccgtccggacgattcgcaagcagtagcgctttcaccgccgtttcgatgcgtgccggctcctccatacgtcccttgccggcgtcgccgcaggccagcatgccgctttccggctccacaatcgtccaaccgagctcacggcaggtattgagattgcgttgcgtcacggcgttttcatacatatgcacgttcatggcggggcacaggatcttcggtcccttgtcgtacgcgagtatggtgctggtcagctggtcatcggcgatgccgcaggcgattttcgcgatgatatcggcgctcgccggagcgactgccagcagattcgcccacttcgcgtcggccacgtggctgatctgcagcggaccgtccggtccgggtgccacgtcggccgtagcgccgggacgatgtccggcggcgaacatggacatgcgtgtcggcgtgtgggtgagggaactgaacgtcaggggagtgacgaactcctgtgcggcggcggtcatcaccacacgcacctcatgcccctgcttgctccaatcggaggcgagatggcaggccttgaacgcggcgatgctgccggtgacccccaaaagaatatgcgccatggatcaaccgtccttctcgttgtgacctgccgcgactgcgtcaagtatataaccgggccgaagcctccgcgcgctttgcgggcgaatccgaacgggccgcgggtatggcggacggtagaatcaggccgtggtgatcgacctcacgcaggcggtcaaccgcaatcacaacacataatcgaaaatacgaagaggagaaatcccatgtcgtcacctaccggtgcgcacggcgaagccgacgcaaccaaacaggagaacgaacagcagccgcagtccacggcaagcaccgacgccacgctgaacgcgcgtgcgaaatcgtcgaacggcgcgaaatcgcaaggcccgaagaagtggcttatcgcgttgatcgccatcatcgccgccgtcgcggtgatcgtcgccattgcagtgacgcgcggcaaaaacgatgacgcgaacacttccggcgtaactaaagccgacaccgtcaccatcgggctcaaactcgccccggtcagcctcgacatccgccaccagtccggatcggccatcgaacaggtgctgatcggcaacgtctacgaagcgctgctgtcgcgcgactccgacaacaaagtgcagccgggcctcgcgaaatcctgggacatttccaaggacggcaagacctacaccttccatctcaaccagaacatgaccttctccaacggcgacaagctcgacgctgacgacgtggcctggtccatcaaccagctcaaggagaagcagtactacaacgccaaccaggtggccagcctcgacaaggccgaagcggtggacgccaacacggtcaagctcaccctttccacccccgactccaacctgctgtggtatctgaccggacgtcctggcctcgtgttcgacaaaaacgccaaatacaacgcgaaaaccgaagcggtcggctccggcccgtataccgtcgaatccttcgactcggccagcaaaatggtgctcaaagccaatccgaaatattggggaaccgcgcacaagcccgccacccagaacgtggtgatccgcttcctcaccgacgacaacgcagcggtcaacgcgctgaaaagcggtgatgtcgacgtgctttctcctgtgaacgccacgctcgccaaatcgctcgataccaacacatatcgggtgtccgcggccgacggcagcgacaagttcgtcctcgccttcaactgtacgaacgccaaactcaaggacaagcgcgtccgccaggccattcgatacggcatcaaccacaaggagatcatcgcctcccgaggcaacgtcgactacgcgctcggcggtccgatcccgtccgtcgaccccggttacgaggacctgaccggcctgtacccgtacaacgtggacaaggccaaggaacttatgaaggaagccggttataccaccgacaagccgttgcggctcaccctcacctacgccaacacgtacggcaccgaactgggcgaccagctcaagagccagctcgccaaaatcggcatcgatttgaagatcgactatgtggaattctccacatggctgcagaacgtgcacgccaacggcgactacgagctgtcattggtggaccacgccgaaagccacgacttctacaagtggaccacgccggagtactactaccactacgacaacaagaacgtgcaggcgctctacgccaaggcgctcgcggccaccgacgaggaggaaagcaacgaatacctcaagcaggcggcgaaggccgtcagcgaggacgcccctgcggattggctgttcagctaccgcgtgacggtggcgtacaacacgagtgtcaagggattccccaacaagctcagccagacggtactgccgctatggcagatctccaaggcaaaatgacacaaggcggaatgatatgagattcgtggccaggcggctgctgctgttcgtggcggcgctgacgggattgtcgatactggtttttctggcattgcgtgtgctccccggtgacgttgcagccgtcatggccggaacgaacgcgaccgcagcccgtatcgccgcgctgcgcatggagatggggctcgaccggccgttgcccatgcaatatgcggactggctgaccggcctgctgcatggcgatctgggcgtatccgccatcagcggcaaatcggtcgccttgcaggtcggcgtgcggtctgcggtcacgttcccgcttatcgtactcagccttgccatagcactgctcatcggattgccgcttggctgcgcggccgttatcaccagaaacagaagatggcgtggactgctccatgtgatcgccattatcggcggtgccgttcccgcattatggagcggcctgctgctgattctgctgttctcgcgcggctcgggattgctggggcttttcccctcacagggcttcccgaacgacggctgggcgagcccaaggcgtgcattggcgtcgctggtgctccccgcgttggccaccggcatcaccgccggggccggaatcatgcgctatacgcgtgccgcattaggtgatgccgcgcaatcccaggccgtgagcatggccatggcctgcggcatgacacgcaaacaggcattgctgcgcgtcggattgcggctgtcgctgccgcagctggtatcggttatcggactgaccttcgcccaaatggtaacaggcgtgatggtgatcgagaacctgttcgccctgccgggacttggcgcaatgctcgtcaccgatgtgggcaaccgggatctgatcgcggtgcagagcgaactgttcctgctgaccgcgttcttcctgctgctggggctggcggtcgatatggcgcatcatgcgctcgacccaagactgaaaaacgcttccaccgacttgcaggaggtgctgtgatgtccactgctcgtgtggttatgcgctcgatatggcgcaaagccagcggcaaatatgcgctgaccgtgctcggcctgtgggtgctggtttcgctggtttcgctcgtatggacgccgcatacgctgctggagaccgacggattccacgcatgggcctcgccctcggccgcgcacccgttggggacggatggcgtcggcgccgatgtgctgagctggctgatggccggatcgcgcacgaatcttgcgatcgcattgctgaccgttgccgtgtccggcatattcggcctggcattggtggccgccatggtgtcgcgcaacaccgtgctgcgatccacgtcggtggtggtggtcgatgcgctgatctctataccgaccgtgctgatcgcattgatgctgtccgtgccgttcggcgcctcggcggcggtgattgtggccgcatgcggattcgcctacggactgaatctggcgcgtatcgcaagacctgcggccgtactcgccgcgcgttcgcagtatgttgaatcggcggtatggttcggagcctccggcatgcgcgtgttcgtcaggcatatcatgccgaatgtgatgccggtgctgctggtgcagttgtcgatgagcgcgggaacatcgatactggccgaggcggggctgacctatcttggtgtcggcgtaggcgccggcgtgcccagttgggggcattccctcgccacatccgtgaaattcatcagcatctacccgctgaccgtgctatggccgggactagtcgtaacgatgacggtgatcgcattgcatctgttcggcgatgcactgcgtgacgccatcgacccattgaccaatcccgagctgagggaggcggcatgagcattgaaattcgcggactgaacatcgccattggtacgaagcccatcgtgcgcgatgtgtgcatgggcatagccgatggcgaacgggtcggcctggtcggttcctccgggtcgggcaaatccatgatcgccaaggccctgatggggttgctgcccgatacggcatggataagcggttcgatcatggtcggcggcaaacagctgatcggattggacgataccgccatggccgatttgcgcgggcgttatatgggtatggtgttccagaatccggctgccgcgctgaaccccgtgatgacggtcgcccagcaggtcgggctgccgttgtatctgcattacgacctgtcgcttgacgagcgtcttgatcgtgtcaaggcgatgcttgacaaagtggggctttcccaggatgcactgctgaaatacccacatcagctttccggcgggcagcagcagcgtgtcggcatcgccaccgcgctgatcacttcgccgcgattcatcatcgccgacgagccgaccacggcattggattcgatcacgcaacgtcagatcgtcgacctgctgacgtcgctggtcgacgatgccggcgcgtccatgctgttcatcacccatgatttcgcggtgctcgcacgcgccactacgcgctgttatgtgctggacggcggttcgatcgccgaaacgggtacgaccgcaagcctattgcaggcgccggcaagcgaacccgcgcgacgtttggtcgatgcggccaggttgcttaccctgccgcatggcaacagtgctggtagcagtgttggcagccgggaatccgcgagagcgcaatccaagcgggagacgttcaagaacacggcaatcatgaggaaagacgacggcaatgagtgacatcgtgctgcaggggcgtggcatctgtacaagcttcggttcgaagcgggaacgcaggcaggtgctgttcgacgtggacgttgacgtatacgagggggagtgcctggcgattatcggcgcttccggttcgggcaaatcgacgctgacgcgtgtgctgttcggcttgggatccgccgattcgggcgagatcacgtatcgcggccagacaatggggaagcggggctctgccgtgcgccgcatgctacgcggacagaccggcctggtgttccaggaccccttcgcctcgctcgacccgcgctggcgcgtcgcacgttccgtagaggagccgttgcgcttgcaccacaagggcatgggcaatgatgagatcgcctcgcaggccgagcatgcattgcgtgtggtcgggcttgacccggcggtgttcgccgcacggtaccccatggatctttccggcgggcaggcgcagcgtgtggccatcgcgcgtgccatagtggacgatccgggcatcattcttgccgacgagccgatgagcgccatcgacgtggccgcacgcgtgaggattctggaggcattccgcgccatccgcgcggcaaacccgagcatgtcgctggtcatggtctcgcacgatcttggcgtggtgcagcatatcgccgaccgtatcgtcgtcctacatgacggacgcgtcgaggaaagcggtacgaccacggaaatactgaagcatccctgttccgcgtacacgcgctcgctcatcgaagccgcgtccatgcagtcctgatcgcaggtcggatcgatgcaaggtaggcggctgggccggctgaaccgactggatcgcctgaatcggctgaatcggctgaaccgactagaacgtgaacagtctgcgcaaccagtcatacagggcgggattcgaaacgttccagctttcgctccgccccggggtcataagccatagcagctgcaagccgatgccgacgataagcagggcgacgatcacgacggtcagccaccggcgcccattttcacgcgcatccgtgttccatacgaacagcaggcacatggtgccgatgagcatcagccatgtcatatcgcacaggtaacgcgcgttcacgccgaacggtccgtcgatgcatgcgatgaggacggcgagaacgaggaacgtgagtcctatcgcaccgcactgtgttgcgtgggagttttggctgcgccgcagtcgaatgaaataccggatggccgcgggcaatgcgagcaggcagatcggcgacagcgcgacgagtccgccggcgaactgttccggaatgatgttccgattacggaacaggaatccccatgggtttgcctcatccagtgagaacacgtccatggtgtaggggaattccctcgtgaaaccgattggggtgaggaacagcaggaggacggaatacaggcgtgctttcagactgacatgccgttgcgtcagatcgcagccggtgagattgtaggctgcgccgaagtcgaacgggtcgtcgaaacgggccgtgttgtatgccatcatcgcgcagccgatgatgaggaacggcagaatcgccgcgatggtggagaggatggcgtgtctggaacgggtggacaggatatcgcgggttcggatttgcggccataggaggatgatgccgaataccgcggtgaggatgaacgccggtctgcaggcgatggtgagcgcgacaagcgtcgaaccgatggcgatgaacggagtgcgtggggtgtgatggccatcgctggaagagcgtgcccacaatgcgatgccggcgggcgcgagtgcgagcgatgcgaggatgggaatcgaatagaaccatgggacgagcaccagatacgtcaatccggatgccgctacgattgcggtgcaggcgaggaccgcgagccatctgggggtgccatgccaatagcgcttccacagtgtttcgatgaggaatatgagcgaagcgcatgccagtatcgcaaggaacgcgcatcctgcggcggtcggcagatcggttccggtcagtgctttgaacggcgcgaagagcaggagcgccggcagcgggccgaaatagcagtagtaccggccatggtagaaagcccaatcccagcgtgacggatcgccggtttgcgcgccgagggttcctctggcctgctcgtcgtacggattatccatggccgcaagccaatcggggacatgcgcgtcgatccaggttctgccatgcaggaacgcgtcggcgagctgctggtactgcgaacggtccacgaggaaggtgccaccttggtattgcagggtgtacacgctatcggaaggatgcgtggacaccgtcagcagtacgagaatcgtcgacatcaccgcccagagaaccacgaaaggcgtccatgcgcgatggcgtttgcggttggtgtgatcggtgcggtcgatgcaatcggtgcaatcggcttccggcgtgaggtggggacggtcgttgttccccgtcgacggtcgtactcgatgtgcggggaatatgaaagaggttcctctatacataattgcactgtatatcacgtagacgcgatgatatccggtggggtgttgggcgctgcgaaggctgttatatcgcaggttattgggggcggagcgagcccgttccaggaagctgatacggttcggatgtccgcatgatgaacgcgggtgacatgccgatgtccgggggagtggtaatgtaagccacatgttcaatcgctcttgttgttgctgtcgctaaccaaccgcccgaggggcgcgtggttcatcgacgcataacttgagataggacattccagaacgttcggcgtggtcgccagaacttcgattttccggattcccgtaacgtatcggcatgatcgccaatcttcggcatacggcataccgtaaccgtatacggtgatccccgcacaagcgcgaaaatcccaacaggtcctgtttcaaccgctgcacatgacgacgcggcttcccgggagcgcatcccaaccgaatccccgaaaccgcaaagccccaaaggaaacgtcatgaccatccacaacagcaccgcagaactcatcggcaacaccccgctcatccgcctcaaccatgtggccgaaggcatcaaggccaccatcgcggccaaagtcgaatacttcaacccgggaggctcctccaaagaccgcatcgccgaacgcatcatcgacgccgccgagaagagcggcgaactcaagcccggcggcgtgatcgtcgaaccgacctccggcaacaccggtgtaggcctggccatggtcgcccagcagcgcggctaccgtgccatcttcaccctgccggacaaggtgtccgaagccaagcgtgcggtattgcgcgcctatggcgccgaagtggtcgtgactcccaccgacgccggtccggacgacccgcgctcctactaccaggtggcggaccgtctcgccaaggcgattcccggcggctaccgtcccaaccagtacgacaatccgaacggtcccgaaagccactatcacaccactggtccggaaatctgggaggccaccgaccacaaggtcacgcatttcgtggcgggcatcggcaccggcggcaccatctccggcaccggacactatctgaaggacgtgtccaacggcgcggtgcaggtcatcggcgccgatccggaaggctccatctactccgacccgaacgacgtgcaccaataccagatcgaaggcgtcggcgaggacttctatccgaaggcctttgatcggagccttcccgacgagatcgtgcaggtcaccgacgcggaagccttcgaaatgacccgacgccttgccaacgaggaaggactgctcgtcggcggctcatccggcatggccgtgttctccgcgctgaaatacgcccgcgagcacgacctcgacgaaaaccagctcgtcgtggtgctgatgcccgattccggccgcagctatatggagaagatcttcaacgacgactggatgcgagccaacggattcgccgacgtcgtggaacgcaccaccaagcccagcctcgccgaacagtacctgtaaaagaccgtcaaacgactgtccggcagcccgatcgcacctttgaaaccaatgccaatcatccgaacaacccaaaccatccgatacttccaaggagttcccatcatgaccatctcgaccaacaccgaagccctcaacgccaccgctctcgccacccgcgccatccacgcaggccaggaacccgacccgaccaccggagccgtggtcacccccatctacatgacctccaccttcaagcaggatggtgtcggcggtctgcgcaacggctacgactacagccgttccatcaacccgacccgcaacagcttcgacgagcagctcgccgccgtggaaggcgcgaaatacgcgttaagcttctcctccggacttgccgccatcgacgtgctgctgcgctccactttgaagcccggcgacaacatcctgctcggcaacgacgtgtacggcggcacctaccgtctgctgtccaaggtgttcgtgccgtggggcatcggcctcgacgtggtggacatcaccgacacggccgccgtctcagccgcgctcgccaagaagcagtacgcgtacatctgggtggaaaccccgtccaacccgctgctcaacatcaccgacatcgccgccaccgcggccgtggcgcacgcgcacggcaccaaagtggtcgtggacaacaccttcgcatccccggtattgcagcatccgctcgcagacggcgccgacgtggtcgtctactccaccaccaagtacatcggcggccactctgacgtggtcggcggcgcggtggtcctgaacgacaaggaaacacgcgacgcggtggccttcctgcagaacgcggccggcgcggttccgtccccgttcgactcctggctggacatccgaggcctcaaaaccctcgacctgcgcgtcaagcagcacagccgcaacgccatgaaggtggcccagtggctggagacccgccccgaagtggaacgcgtatggtacccgggcctcgaatcccacccgggccacgagatcgccgcgcgccagatgcacggcggtttcggcggcatgatctccatccagatcgccgccggtttcgaagcggccaagaagttcgccggagccaccgaagtgttcaccctggccgaatccctgggcggcgtggaatccctgatcgagcatccgggcgccatgacccacgcctccgtggccggcaccacgctcgaagtgcccgccaacctgatccgcctgtccgtcggccttgaggacgcggacgatctgatcgccgacctggagcaggcgttccgccagatctgaattccctatttccgatagaagcatgaaacggccggcatgggcaagacccgcgccggctgtttcgctctccgcggtcaacgcatggcattgctacacttggaaaccatgacgcaagctgttgattccgccgattccgtagacccccgcgcattggaggcgctgaaccgctatttcggctacgattcgttccgtcctggacaatccggcatcgtctcggccatcctcaccggacacgacgtgcttggcgtcatgcccaccggcgccggcaaatccatctgctatcagattcccgcagcgatcctgccgggcgtcgccatcgtcatctcgccgctgatctcactcatgcgcgaccaggtcgacgccctgaacgacgtgggccttccggccgcgttcatcaacaccactcagacgccggacgaacaggatctcgtcttcgcgcaggcgctctccggccagatcaaactgctgtacgtggcgccggaacgtttggaaaccgaacgattccgcaacttcgccgtccgtgtgccgatctcgctcgtcgccgtcgacgaagcgcactgcgtctcccaatgggggcaggacttccgttcctcatatcttggcatcggcgaattcatcgccggactgcccacacgtccaacggtcgccgcgttcaccgccaccgccaccgaacgcgtgcgccgcgacatcgtttcgattctgggtctgcacacaccgtccatcaccgtcaccggtttcgaccggccgaacctgtatttcgacgtcatcagcatgccacgtaaagacaaagcatcctgggtggcgtcctacatcgccagccatccggacgaatccggcatcgtctactgcgccacgcgcaaggaaacggaagcgctcgccgaatcgcttaacagcgccgtcgccgaattgcgtgccgcagggggtgcggatgtgtcggatatcggcaccatcgccgtcgcctaccatggcggtatgagcgccgacgcacgagagaaggcgcaacgcgatttcgtcaccgaccgtgtgcccgtggtcgtggccaccaatgcattcggcatgggcatcgacaaatccaacgtgcggttcgtcatccaccacaacatgcccgaatccatcgaagcgtactaccaggaggcgggtcgcgccggacgagacggcgaaccaagccgttgcacgctgttgtggaacgaatcggacatcgtcacccgccgccggctgctcgattcggattacgaaaacgaacgattgactcccgaagagcaggaggccgtacgcgcgtcgaaacgccggctgctcgacgcgatggtcggctactgccgtaccacggactgcctgcacgcgtacatgacccggtatttcggcgaaaccgcgggcgcggcggcgaaaacggacggcaaatgcgtgggcggttgcgccaactgcgagcacacattcgaaaccatcgacgtcaccgacatcgcccgagccatcagccgttgcgtgcacgatgtgaaccagcatgtcggcagcggtaaaatcgtcaaggtgctgcgcggctcgaaggcacaggatctaagctatctcaaccccgaaagcctgccgtcgttcggcatgctcgacgaagtgccggaagcgcgcatccgcgacgtgctgagccagatggccaccgacggcttcctgacgatcgcggaaggacgcctgccgatcgtcggcttcggaccccgtgcggcggaaacggtcgcacccgaattccattacgacatcaagaagatcaaacgtgctgacgcccgtgcgcgtcgaacgcccgacgtgtccactcccgctgtcggatcgtacgtgccggatgacggcgacgaggcgctattccagaagctgcgtgcgctgcgactggacatcgcgcgcgaactcggcaaaccgccgtacatcgtgttctccgacaagacgttgcgtgacatggtacgggtcaagccgatcactgacgaccagttccttgccgtcaacggtgtgggggaaagcaagctcaaacagtacggcgaacggttcatggccgcgattcgggaggattccggcgacgaggcttgaaccggccataaccgacacgcatggcacgacggttgacgttgagcccgcgaaccgtgaatagtggaatgtgaacacaacaacgaaaggacagaacatggcggaagacaagccggtggtggaaagcttccaattggaccacaccaaagtaaaggcgccgtatgtgcgctacatcgatacggaaaccggcccccacggcgacgtgatctcgaactacgacctgcgattggtgcagccgaacgagaacgccattccgaccggcggactgcacaccatcgaacacaccatcgcggtgctgctgcgcgaacgcatccccggttacatcgactgctcgccgttcggatgccgcacaggcttccacctgctgacgtggggcgagcattccaccgaggatgtggctcgcgcattgaaggaatcgttggaattcatcgcctacgaggccacatgggacgacgtgccggcaaccaccatcgaaagctgcggcaactaccgcgaccacagcctgttcaccgccaaggaatggtgcaaggacatcctcgccaagggcatcagctccgacccgttcgaacgccgccttgtgtgagcgttaccatgcctgtgcggtgggcgtggtagtttggacggctggaatgcttgagagaggtatacagtcgaattgaggtgaaagggttgagcgaaaccacttccgaacgtcggttccgtcgtgccaccatggatgatctgcctgtcatgctgaaaatctaccagcatgcgcgtgagcttatggcggccaacgggaatcccacgcaatggggaaacacgttcccacgtgaggaagtgatccttgacgacattcgccagcagcgcaccatgctgctggtggacgaggctgacggcaaggagcgtgtgctcgcccagttcgccctgtgcacgggcgaggatcccacctacgcgcatatcgacggcgcctggctggacgatgactcgtatgtgaccatccaccgcatcgcctcgtcgggaatcgtcaaaggcgcggccaaggactgcatcaactggtgcatcgaacattacggcaacgtgcgcgccgacacgcatccgaacaacaaggccatgcagcacgtgctcgaatcgaacggattcgcccgctgcggcctgatccaactgcttgaccgccccaccgataccacgcgtatcgcctaccagcgtcacgaatggtgattgcgcatacatagaaacatagaaaaaaggacgtctcccgtaaaactgcgggagacgtccttttccatatgaagggatgattagaacagtcccggctcgttaagctgagaatgcttgcggctgtacgtgaaatacacgaccagtccaagcgcgaaccacacggcgaaacgcacccacgtctcccaattcaaaccgaagatcagaatcaggcagaagatgatggcgcagattggcgtgaacggcacgcccggcgcacggaagccacgatgcgcgtccggctgggtcttgcgcatccacaggatgccggccgacacgatgatgaacgcggacagcgtaccgatgttcaccagctcgaacagcacgttgatgttgatgaaaccgccggcgatggccgtcagaatgccgaagaaccacgtgcccttgaacggtgtgcggtacttcggatgcacttcgccgaagaacttcgggaacagtccgtcgcggctcatcgcatagcagatgcgggactggccgtacagctgcaccagcatgacggtggtcatgccgatcaacgcgccgaggttcacgatgaacgccagccagttgagaccggtctcgagaatcacgcccgccaccggagcgtcgatgaacttcgcgaactccttgtacggcaccacgccggtcatgatgagcgtcatgatgatgtacagcacggtggacacggccagcgagatcaggatgccgcgcggcagcgtcttgttcggattgatggtctcctcggcggaggaggagacggcgtcgaagccgatgaagctgaagaacacgatcgacgcggccggcacgatgccgtacggctgcgtcgaacccggctggaacgtgtagatgccatacggggagaacggtttccagttggcgggattgatgtaccagacggtgcacacgatgaacagcacgatgatggccagcttgatcatcaccatgatgtcgttggtcttcttcgtctggttgatgccgatggacagcacccacgtgatgataagcacgattacgaagccgggcagattgaaatacgtggtgactcccggcgtggtgccgtatgcggcggtcagttcgaccggcagatgcaggccgaagccttccaacagcttgttgaaatagcccgaccagccggcggacacggtggccgcctgcaacgcgtactccagaatcagatcccagccgatcacgaaggcgatcaactcgccgaacgccagatacgcgtacgaataggcggagccggaaaccggtgccatcgcggcgaactccgcatagcacaagcctgcgaagccgcagcagatcgcggcaagcaggaaggacacgcataatgcgggtcccgcggtgagcgcgcctttgccggtgagcacgaagatgccggtgccgatgatggcgccgatgcccagcatggtcaggtcgaaggttttcagtgttcgcttcagcggagtcgattcggagacaagttggtccaccgacttcttgcgaaatagatccatggtcgtcagattccctgtgattgtttcaaaaatgggctggaccggacggatttccgggactctggcacgccttaacgccagaaatcagaaaggccgcggcgatatgcgcaacagccttgtgtatggaaagtgtaaaaaacactgccggacaaaatcgtgaaaacatcgtgaatcgtctcaccatatgtccctgatgttccatacctgtcacatagcggcgcgacaatgggagccatgactttgagcgcaacacgtgaatgggatttctcctccgaacaaggcaaagcgaactacaaggccgcccagcggcggtatccggcgcaggccatcgtcgacctcgccgcactgcgcgacaacatgcgccatctggtgagtgtcgtcggcggaccgcattccggcaccgccgtcatgggcatcgtcaaagccgacgcgtacggacacggcctgatccccgccgcgcttgccgcgctcgcaggcggcgccacgtggctcggcaccgcgcaatcgcatgaagcgctgttgttgcgcaaggcgggcatcggccccgatcgctgccatattctgacatgggtgtacagcggcgccgaagtgccgttcgacgagctggtcgacaacgacatcgacatttccgtcggctcgctcgccggcatcgacggtgtcgccgcggccgcacgcaggcttggcaagacggcgcgcgtgcatgtgaaggtcgattccggcttcggccgtaacggcttcacgcccgccggtttcgacgcggcgctcgccaaactggtgccgctcgccaaggaaggcgtgctgcacatcgtcggccagtggagccatctggcggtcgccgacgcgccggacgttccggaattcgttgcctccaccgacatgcaggtcgaaacgttcaaggacttcacccgtcgtatggaggcggccggcattccgccggaaatccgccacctcgccaacaccgcggcgacgctgtcccgtccggaaatccacttcgaactgacccgtccgggcatcggcctgtacggttacgaagccgatccggccatgggcacgccgtccacgtatagcctgaagcccgccatgaccctgcaggcgcagctcggcaccgtcaaggacgtggaagccggccatggcatctcctacggccgtacgtatctgaccccgtccgacacctccaccgcgatcgtgccgctcggctatgcggacggcatccaccgctccgcctccggattcgacatggaaggcgccaagcacgtgaccaagcccggtggtccggtgcgcgtgatgaccgcggaaggcccacgcctgtaccacgtgtccggccgcgtgtgcatggaccagttcatcctcgacctgcacggttccgccgccgaactcggcatccacgaaggcgacaacgtggaactattcggtccgggccgcggcgaggactacgccgagccgacagccgacgattggggacgtgccgccgacaccatcagctacgagatcttcacctgcctgcgcaaccgcatcccgcgcctgtacgagcatgccacggacgtattgtccgccgaggacctcgccaagctcgacccggcaagcatcctgtaatcccgtaaaaagcggcggcagccgccgcacccataggaaggcggtgcatcatgacgagcgaaggatacagcgcgttcgacgaggagcgttgggctccggaaccacccaaatccagctcccgcaccgccttccaacgcgaccgcgcccgactcatccactcgtccgcattgcgcaggctcggcgcgaaaacgcagattctggtggccggcaccgacgatttcgcacgtacacggcttacacacacgttggaggtcgcgcaaatcggtcgacagatcggcacttcgctcggttgcgatcccgacgtggtcgactgcgcctgccttgcgcacgacctcggccacccgccgttcggccataatggggaacgtgcgcttgccgaaatcgccggcaatatcggtggtttcgaaggcaatgcgcaaaccttgcgattattgacgcgcctcgaaccgaaaatactgtttcccgacggacgttccgcaggcgtgaatctgacgcgtgccgcgctcgatgcggccgtcaaatacccgtggacgcttgccgaagccgccgcgcatccgaaaggggagcgcagcgcgaaattctgcgtctatccggatgatacggacgtgttcgcctggctcaaacaacacgcgcccgacaccacccgccgtcccgtcgaatgccaggtgatggacctgtccgatgacatcgcctacagcgtgcatgatgtggaggacgccatcgccaccggcgcgttcaatccgggcgtgctgcatgaaagcggcgtgatcgacgcggtcgtcgaggacgcgcgcgcctggtacggaccgcaatgggacacagacaagctggtggccgcgttcgcacgcatgcaccggcgcgacacgttccccggctatttcgacggttcgcgacgcgcgctcgccgcattgaagaacatgaccagcaatctgatcggccgattcgccggttccgtggaacaagccacgcgggacacgtacggcaacgagccgctgacccgatacaacggcgatctggtgattcccgaggaaaccagttacgaaatcgtggtgctgaaaggcatcgccgtgcatttcgtcatggcgcccggcgaacgcgagccgatgcacggcgaggaacagcggatcgtcggcgatctggtggacgtgttcatggcggacaatcccaaaccgtccagcgcgttggagaacgtgttcctcgacgattggcgcgaggccggcagcgacggcgaacgcctgcgcgtggccatagaccaggtggcgagcctgaccgacacgtccgccctgaccctccactcccttctctgctgaacgagctggtaggctggaccgtatgccgggaatgatcaagaaggaagacatagaaaaggtccgcgccaccgccgacctgtatgacatcgtatccgcgaccgtcacgctcaaaccctcgggaaccggcacatacgtaggcctgtgccccttccatgacgagaaaacgccaagtttttccgtgcgcccggcgcttggcgtgtggcattgcttcggctgcggtctcggcggcgacgtgttcggctacgtcgaacatcaggagaacatcgactttcgtgacgcggtggagctgctcgccgacaaataccatatcgaactgcattacgacaaagccgacaacgtgcccgcgcacaccggttcgaaacgcgcacgcctgctcgaagccaacgaggcggcgcaggaattcttcgtctcccagctgatgaccaaggaggcgctcgccgcgcgcaagctgttggacggtcgcaacttcagccaggccgactgccagcggttcggctgcggatatgccccccaaggatgggataacctggtgcggcaccttgccggcaaaggcttcacccagcaggagatgctcgacgcgggactcgcccgtcagggccagcgtggcgtatacgactatttccgtggccgcgtgacatggccgattcgcgattcgaccggccgtacgctcggcttcggcgcgcgcaagctgtacgaggatgacacgatcaatgcgaaatacatcaacacgcccgacacgcagctgtaccgcaaaacacaggtgctgtacggcatcgaccttgccaaatcggcgattgtgaagaaacgccaggcggtgatcgtcgaaggctataccgatgtgatggccatgcatctggccggcatcgacacggcggtcgccacgtgcggcaccgcattcggcgccgagcatgcgaagatcatccgccgattgatcgcggacgattcgttgggcgcggtgcagctggttggccccctgaaggtggaggggcaggcgttgagctcgcgtgtcgtgttcacattcgacggcgatgcggctgggcagaaggccgcgatccacgcgttcggtttggacgccgcgttttcgacgcaggcgttcgtcgcggtcgccgaagacaacctcgacccgtgcgatctgcgcatcaaacgcggcaacgaggcggtgcgtgcgctgattgccaatgcacggccgctgtacgatttcgtgatcgattcggcaatcgaccgtttcgacaccacgtacgcgacaggtcagatgggcgcggtcaaggcggtcgccccgctgatcgcgcaaatccgagaccgttcgctgctcgacctgtactcacgcaaggcggtgcgtcgcatcggcgtcgatctggacatcatgcaacgcgaagtggcgtaccggcgtcgcaaactgaacgtgcgtgacgaggacgcgtacgcgccgaaacgtcgattccaaaacaatgcggggccgtcggctgaaccagcatatgcggaacgtggcgcgaatccgtatgcgaatcccgccgcacgcaaggcgttggagcatcgtgacgcggccgggcaaagctactatcgcatcgacgacgccgtgttcatctgcgaacagcagttcatggccacgctgatccaggtgccgttggcagtcgatccgacgatgttcgccagcctgaccttgtcgagtttcatgacgccggtgttccgcacgctgttccaagcggtcgccgcggcgggcgggcttccaggggaagacgtgccgcagggactgtggatgcacaatctgacgaaggcgggcggtccgatgcttgaatcggtcatcaacgagctggccgtcatgccgctgccattgccgccgagcgaagcggacgcgaaccgcaatgcaggcgagtcgcaggaacaatcggcgcaattgcgcaagccaacgcaggaggagcggcggtacgcgtccgaactgatcgtcagactgcttgataccggcatcatgcgcaaaatcggcgcggcccagcgccgcatggcgcaactgccggacggtgcagagaaaatcgaactgctcggacagatcaccaaactggaaacgctgcgcaaggacctgcagtcgcgtgttttcggcaacaacgttgcgtgacacgcccatatggtgaatcgaaggcgaacggaagatggtttttagacaaaatcttggcgcacgcggggttaatttgtgaagatttgcgggccttgttttcggtttcgccggtttgcaaaagcatgcggcagtaagcaatagtggatgaaaatcgttggaatggtcggaaaagcagcacgccgagggttcgtgctagtcgcatttttgggtaaagtggtctaggcgtttgcatgaaaatcgcttgggttttgcaaggtgtgcaaggcggttgcaaacgagattgacggaggaatgcatgcggcgattggtcgtcaaggtcctgaagaacgagaccattctcgtagtcgcttccatactcgcactcatatcgtgcttcatcgtgccgccagacaaggaatacgccggctacatccacgccagcaccatctcgcagctgatttgtctgatgcttgtggtgtgcggcttccagcgcatcggcgtgttccgcatcatcggctcgcgcctgctgcatcacgtcaaaaccgcgcgtggcctggtgctcacgttgatcgcattgccgttcttctccggcatgctcatcaccaatgatgtggcgttggtcaccttcgtgccgttcgcaatcgcggtgttgacgatggcgcacatggaagagcatgcggtgcttgtcggcacgctgatgaccatcggcgcgaacgtgggcagcatgctcaccccgatcggcaacgcgcacaacctgtatctgaaagcgttgacggacatgccgacgtccgagatgatcggcatcatggccccgtattccgctaccgcagccgttctgctgataatcatcacctgcgtgattttcggcagcaaatcggtttccgaattttccgcgatcgatggttccgacatcgaacagaacgtactcgccccgcattccgaccggccgcagcctgacgagattcgcgtgaccggctacggtgccggttatggcggctggcgtacgatcgtatacacggcgttgttcgtcgtctgcttgctggcggtgagcgatttcattccgctgtggttgatgtgcgtcatcgtgttcgtggcgttcctgctatgcgaccgccgcgtgttccgcaacgtcgattggggactgccgctcacgttctgcatgttcttcatcttcatcggcaacatgaaacgcgtgccggaattctacgagctggccgcctcgctggtgggcgcgcatccgctggaagtggccgtggtgtccagccagttcatctccaacgtgccgaccacgctgctgctgtccggcttctgcgaccagtggcgtgaactgatcatcggcaccaacctgggcggcttgggcacgctgatcgcgtccatggcgtcgctgatcggctacaagaacgtgacgcgcgcctacccggacaaaaaaggccgttatctggccgtctacaccgcggtgaacgtgctgttcgtcatcgtgctcgtcggcctgagctggattatcgagtagcgtttggccgtcgaccggtttccctgaccgctaatctcaaggtcgccggttcgcaccttttgctgagattgcatgaaaacccttggaatcattggatttcaagggtttattgttacgtcggctgatggtctggtgctgtgataatctgtgccgggaagcgtgtgccgagaaacgtaggaaggctgaacatgctgcaaggattgctgggaattttctccggactgatcacgccggtgcagaccgcggtgaacacgcggctcggccgttccatcggctcgccgttgcgcgcctcgctggtgtcgttcagcgtcggcctcattgcgatgctgactttgacgctgctgcttggcccgtatccgctgattcccgccaccgcggcgaacggtccatggtggatgtggttcgcgggcgtgttcggtgtcactttcctgaccggcaatgtgctgctgctgccgaaactaggcagtctcaaaaccgtgatcatgccagtcaccgggcagatcgtcatgggcctgctgatcgacgctttcggctggttcggcactaccgagcagccgatttccccgctgcgcatcgcaggtgcggcgatcacgctggtcggcttcctgcttgccgtcgccggaccgaatctgcgattgaggcctgccatcgatcgcccggctggcggttcggaaaattccggcgattccgaaaaatccgaaactgacggaaaagccgtacatgtgccaggttccgcgaccgtgctgtggagttgcgcaggcatcgcgttcggcatgtgttcggccgtgcagacggcgttgttgggcaagctgggcgtcgcgttgggatcgccggtgaaggcatcgctcgcctcgttcgcggtcggtctgatctcgcttgcgatcgtcgtcgcattcgtcgaccgcacctacagcctcggcgacgcgctgaagaaaggcaatccgtggtggatgtgggcaggcggattgctgggtgcgacactggtgatgtgcaacgcgtacctgtccgcgcatatcggcaccggcatgacggtgatgctggtattgctcggtcaggtcggcggaggattgctggtcgaccgtttcggcctgcttggcgtgccacgcaagcccgtggccggcatccaatacgtcggcgtgctcgtagccatcgtcggcattgtgctcaaggcgatgtgactgccgtgtcgagttggcaaccgtgtgcgaactgactatactgtgtttagtttggccctgtagctcagctggatagagcatgtgacttctaatctcaaggtcgccggttcgagcccggccggggtcaccatcaagccctcgcgtcgtttcatgcggtgcgggggctttcctgtccattgaacggcaagccattggcttgcgaagataggggagaccatgaagcgaatcgtcgcgggcattctggcgcatgtggacgcgggcaagactacgttgtcggaggcgctgctgtacgctaccggccaagtacgcaaactcggccgcgtcgaccacggcgacgccttcctcgacacggacgccatggaacggcagcgcggcattaccatcttcaccgagccggccgtcatcgccacgcccgacctcaccatcaccctgctcgacactcctggccacgtcgacttctccgccgaaacggaacgtacgctcgccgtgctcgactacgccatcctcgtcatctccggcgcggacggcatccaaggccataccgaaacgctgtggcgactgctcaatcgctatcaggtgcccacattcgtcttcgtcaacaaaatggactcgcccggcgccgacaaaacgcaactgctcgcccaactcaagaaacgcttctcggacggctgcgtcgacttcaccgagccgattgacggcgaacgcatggaggagatcgccatgcaaaacgaaacggccatggacgcgtatctcgacaccgaaaccgtgccggacgaaaccattcgcgccatgatcgcccgccgtgagctgttcccctgctatttcggatcagcgctgaaaatggacggtatagaacagttcgtcgcaggtttcgaacggttcgcgcaagagccgcaatacaatggcgaattcggcgcacgcatatataaggtgtctcatgacgcgcaaggcaaccgtctgacctggctcaaggtgaccggcggcgaactgaaggccaagatgatgctaagcggcaccgcgcacgccggcgacgcggatgcggttgccgaagacggccaatggcatgagaaagccgaccaggtgcgcgtctattccggcgcgaaatccaccaccgtcgacacggtccccgcaggcaccatctgcgccgtcacgggtctgacgcagacattccccggcgaaggcctcggcatggagcgggacgctggcagtccggtcctccagccggtgctcacgtacacgctggaaccgggggagtgcgacatccacaaatgtctggtggcattgcgtgagctggaggatgaggatccactgctgcacgtcgtgtggcagccgcgtctcgaagaggtgcatctgcagctgatgggcgcggtgcagctggaaatcatccagcagatcatgcatgaccgtttcggcttggatgtcacgttcggtcccggcggcattctgtacaaggagacgattacctcgccaattgaaggtgtcggccatttcgaaccgttacgccactatgcggagacgcacgtgctgttggagccgttgccgcagggctccggtatggaatatgcgaccgtgtgcagcgaggacgtgctcgaccgcaactggcagcgcctcatcatgcagcattgcaaggaacgcgagcatctgggcgtgctcaccggctctccgatcaccgatatgagaatcacgctgctgacgggtcgtgcgcatctgaagcacacggaaggcggcgatttccgccaagccacctaccgcgcgatacgccagggcctgatggaagcgaagaagaagggcgattgccgtctgcttgaaccttggtacggcttccgtctggaagtgccgcaggacatggtcggacatgcgatggccgacatccagcgcatgtcgggcacgttcgacacgcctaccggcgacggcgaatatatggtgttgaacggcacggcgccggtatccgaaatgcgtgactatgcgatggacgtgaacgcgtacacgcacggccgtggccatttaagctgcgtgttcgccggctaccagccgtgccacaatgccgacgaggtgatcgagaacatggcttacgatccggaatccgacctggagaacacgccggattcggtgttctgcgcgcatggcgccggctatccggtcaaatggtacaaggtgcccgaattcatgcatctcgactacgcgtgggatggcatgcgcgaatagaaccgaaagacagacgggtgggaagcgccgattgcttcccacccgaggcatgttgtcggataccgacaaacggataaacgaaaagccccaccgaatcggtgaggcttcatactggagcggacaacgggactcggacccgcggtctcaaccttggcaaggttgcgctttaccaactaagctatgtccgcaaaggtttcctgccgtgagaagcaggaaaccagtgggtgatataggaatcgaacctatgaccccttccgtgtgaaggaagtgcgctagccgctgcgccaatcacccaccgcatggacgagttgtgtcgtgacacgatcaaaaacacgatcatcagcctgatctacggcgacaaggacaccgaccacagcgaggccgtcagctacgagttgtcgaagcttgagaaattggacgcgcaatgctggatagtcgccgccgccgaaaaatatttggaggacaggcaatgacgcatctcatgatcgcgggcggcatatacctgctgctgctcgcgctcattctcatgttcaatcatggcgcgcacaagattcaggctggtggcatcgtggctggcgctgtcacgacagacaaggtggtggccgacgctgtgaccgccgacaaattggccgcgaacagcgtgcaggcgcggcacatcaccgctcttgcagtcacaaccgacaagctcgcggccaacagcgtgacgaccacgaaactgcgcgtcacggaggacatgacggtcgcgctgctcaacgcgcacagacattgatttttcacacttcaaagccatcccacttcgggatggcttttctatttgcccctgacttgggggcgggaaggagaggatgtgggcatcctcaacaaaggcaacccgaaacacaagcgtctgcgtcggcatatcggcaagccgttgaccgcgttggctgcggtgctgtgcgtcgccgtcgcgccggtcgccagcgcgaacatgaacgtcatcgacgtttccggctggcagagtgcagacgtgacgcgcgtggtggacgccgacgcggccatcgtgaagatcaccgagggttccggctacgtgaacccgtcttggcgcagccagaccgattggacgcggcagaccggcaaggcttgcggcggctaccattacgcggacggcggcaacgtcaccgcggaggtcaaccattatctcaaccagttcaacggctatgtgggccagtgcgtgctcgcgttggactgggagtccaacggcaacgcagcttggggcaacggcgactgggtgcgccagtgggtcaaccaggtgtattcgcgtaccaaggtctggccgatcgtgtacgtgcaggattccgccgtgtatcagattccgtccgacgtgcgatcccattgcatgttgtggaaggctcagtatgcgtcgatgaacgcgaccggctggcagtccactccgtggaacgccggcagcaagggcgagggcatggtgcagtatgcgtccaccggctatctgaacggtgttggccctctcgaccttaacctgttcttcggtgagcgtgacgcatggcagaagatcgcgaacggtgataggggtaagacccatgccgaggtgaggcatgatccggtcaggccgcaggtcactgccacgcctgattacaatgacatggccacgaaggtcattcgcggcgtgtacggcaacggcaatgagcgtcgtcaggctcttggcggtgcctatgacacggtgatggcgattgtgaaccagcgtcttggcggttctggcggcgcgcctgccgccgtgaattgcggcagcgtgtgcgtgaccgttcgttacggcgacacgctcagcagcatcgcggccagtaatggcggttcgtggaaccagtacacggggtaccgttccggcaatccgaatgtcatctacgctggcgagaccgtctgccgtcgcaccggcgcggccagtacgtccaccgtcgccaccggtggacggtacgtggttcgttccggcgacaccctcggcggcatcgccgcatattacggggtcaacatgtacagcatccacgggtaccgttccggcaatccggcgttgatctatccgggcgagaccctctactggtaaggagactgacaatggtcgataacgtcaaagagactggaaatgatggcgaaaagccgcaggaagaaacaggcgaagaaaacaactacatcctgccggacgaagcgtacaaggtgctgaagtggttggcgcttatcgcgttgcccgctttggctgtgttcgtgcatgtggtcggcccagcatggaaccttccatgcgttgaccagatcgtgaccacgttgaacgctctggccgtcttggttggcgctttgattggcgtcagcgagttgaaggcaaagtattccgagtagaaacctttcatttctctaacatgatgttagagaaatgtaagaatactatgcccaactagtacgcgtcctgtacaagttgcccctctctcagcatcatgctgggggaggggcttttctgcgttttagggcttctattctgcggttcgattggctctatcgccatcaccaaagtctatttgttggcccatttggtcgtaatagcggttttgatacatgttgcaaaacttttccctgatgtgatccaccacagtttgcaccgccgtatgtttctcaatgtccaactgctgttcggtgatggttatcttctttgggaactcgtcttctggatgccaggtatcgtaaccggctccgtttatcaccattctgggtgcgttgaatacgaacccatatcgttctacgagtttcaacgcttcatcgaatcctcgaccgtatccttccctatacgaaactacatcaagctcatgcggcatttacgacacctttctgttcgatctgcttcaagtctaatgcggagttcatcgtttccattgcggccaaccgttctttcaacccggcatgacggtagtgttcgaccatcagacggctggaatggcccacgatttcctcgaccagtccgacatccacgcccattgacatgaggatggtaacgacggtatgacgggtttcgtgacggctcctatgctccgcattgggtactcccgccgcttccaacagtttgcggaactgttcgatatcctcttccggttcgataggggagccgtcatcatgacggaacaggagtccatgcgggttcggtatttcagcggtatccaccaagtatgcttcgagtgtctgcgccaatgcgggaatgattggcactttccttccacgcttcgatttcggcggggtgagacaccagcggccttgcaactcgatcatgtcgaagccgtctggaatacgccacctccattgcggacatgcggcaccacgcttgtatccgcacgggtacacgcctttacggtctggttcgccgcaaccgtgctccttcttcaactcctccagtttccagttgacggtgtattcgccgtaggggatgccgtttgccgtggtggtcagttcgaggtcttggagtgatgcgcccaagatttcgccggggcgcatgccggtgcatagtctgaaccattccctcgcgccgttccgtatgcctagttcgttggcggcttggaggatgcgtttggcttcatcgtcggtgaatgcggtacgctcgtgggcttcgttcttgcgttcgtcggcaagactgatgtccttgtccttcggagtgggaacgccacccatcggattcgtgggaagaatcctatccgctacggcggcattgcaaatctggttcaacgtggtgtgcgtctggcggcggaggctgagactggccttcacgtgcattttcttgccgtcgatggtcttcgcgacggtaaggccatttacgatgcggtcgcagactgcggcgttcaggttcgacattttctgcgaatggtatgggcgtagatgcttgcggacgatggttcgatagttggcgaaagtcttcgggtctgcatccctctgccgtcgttccaaccattgttccgcatatgcgcccaacgtgactgacgtgttgctggtactgccgaatttggctcgctcttggagcagttcggtcagacgccggttcgcgtcggcgtacttcttgcagctgtaggtcttcccgtcgatcttgaactcgaagctggggtaagccttgattgtgccatcggccagcttctttttccgttcgactttgtatgggtagacgatgccgtttcttgctttgcgtgccatgattacctccttgcttccatattctcagacattctcagacttccatttgaccttcacttgcgggtcaagtgaccctcaagtgaggttaaaccgttggaatgaagccgttttgcccaatcgttccaaggggtattctatcaaactctctaactgttaatcggacggtcactggttcaagcccagtcgcaggagccattcgaaaaatccccttggaaacaaggggattttttcattttcaacgactcttggcatttttggccaccctttatgtttatccgtcggcggaagccgtggttcgtccagccgtccatgcgtatgatgaacgcaccgggtcaatcaaacaaaggaaggaagtccatcatgtgcactggcgttcgtttctccgacgaagagggaaacatgtatttcggccgcaacctcgactggagcttctcatacggcgaaagcatcctagccactccacgcggctaccactacgacaacgtgttcggcgcgagcggcaaggccacgccgaaagcggtgatcggcgtgggcgtggtcatggccgaccgtccgatgtatttcgactgcgccaacgagcatggtctggccatcgcgggattgaatttccccggctacgcggagttcgtgcatgagccggtcgaaggcaccgacaacgtcgcgaccttcgaattcccgctgtgggtggcacgcaatttcgattccgtcgacgaagtcgaggaggcgttgaagaacgtgaccctcgtctcccagatcgtgcccggccagcaggagtcgctgctgcattggatcatcggcgacagcgagcgcagcatcgtcgtcgaacagatggcggacggcatgcatgtgcaccatgacgacgtagacgtgctgaccaaccagccgacgttcggcttccatatggagaatctgcgcaactacatgtgcgtcggcaacgagatggccgagccggccacgtggggcaaggcgtccctgtccgcttggggcgccggcgtgagcatgcacggcattccgggcgacgtgagctccccgtcgcgtttcgtgcgagtggcctacgccaacacgcactatccgcagcaggagggtgaggcggccaatgtgtcccgcctgttccacacccttggttccgtgcagatggtggatggcatggccaagatgggcaacggccagttcgaacgcacgctgttcaccagcggctattcgtccaagaccaacacctactatatgagcacgtatgaggatcccgccatccattcctatgcgatggccgatttcgacatggattcctcggagctgatcaccgccgcctgagcatgcgtgggctttttcgtccgtcggttcccatacagacggacgaaaaagccgcacgattgccgaaaggacatgaaaatggagtcgtgcgacagatccacttttcggataccggctcttccattgcccgctcaatgccgtttgacgtcggaccaatacgacacgccggaatatggacttcgagcactttaagtttttagagtgcggggtatgagcaatacgacgaccacctggcattcgatccgtgaggcgtccatgatttccggactgcccgaatcgacgttgcgttattacgagcagatcggcatcatcgatccgatcgcccgcgatccgagttcaagccaccgagtctattcggacaaggacatcgaatcgctgaccaccatcgcatgcctggcggcgacgggcatgccgcttgaatcgatgcgcgaatacctgaagaaccgtttcgacggtccggaaggcgcccgacggcagatcgaactgctcgacgcgcaatcgctgcgtctggccgcgaaagcggaagccctgcgcatccaacaggcgtatgtgtcgctcaaatcgctgtactggcgagccattgccgacggtcatgaggatgaggccaaccgcatcctggaggaaaacaaggacgtcatcgacaacgtcaagaaacagcaatcccacaaataagaggaggaaatccatgaaagcggcgatttataagggcatcaagcagatggcctgcgaggagcgtccgaagccgggcatcgttgacggcggcgatgcgattatccgcgtggtgcgcgcctgcgtgtgcggctccgatctgtggttctaccgcgatggtggcaaacccgtcgacagccaggctggccatgaggccatcggcgtcgtcgaagcggtcggggaggatgtcaccatcgtcaagccgggcgattttgtgatcgttccgttcccatacagctgcggcaaatgcccggtgtgcaaggccggtttcgaatccagctgcccgcatggcggctatttcggcgatgaggacggtatgggatgtcaggccgaatacttgcgtgttccggaagccgaaggcactctggtcgtagttcccggcgatgccaagaccttctccgatgagatgctcgcctcgctgctgacgctgtccgatgtgatggcgaccggctatcatgccgcggccagcgccgaggtgaagccgggggatacggccgtcgtgttcggcgatggcgcggtcggcttgtgcgccgtgctttccgccaagcttatgggtgccacgcgcatcatctccatgagccgtcataccgaccgtcaggagatcgcgaagaaattcggtgccaccgatttcgtcgaggaacgtggcgacgaggctgtggccaaggtgctggagatgaccgatggatacggcgcggacgcggtgctcgaatgcgtcggatcggccttgtcgaacgacacggccatgaaggtggcccgtgccggggccatcgtgggtcgggtgggcctgccccacgacgtcgaagccgatattcccggcctcttcttccgcaatgtcggtctacgcggtggcccggccgcggtgcgtacttatgacatgcggcgcctgctcaaggaggtgctggacggcaacatcaatcccggtatcgtatacactggcgagtacacactggatgatatccaggaagcgtatgccgctatggacgaacgcagtaccgtcaagtcgctgctgcgggtcagcgaagtctgatttcgtggtgcccaacgatatttgaaacgatggcattgggctcgaattgagccgcgtgagggaaggatatcgacatgttcgaggaactgcataggaagatgaacgccttttggaacaacgatcggacgctgtcgcagaccgacccggaattcgtcaagttgttctccgatttcgcctatgacgaagtgataaacgaaccgggtgccaaccaccccgatctggacgaccagacccgctccctggcgatcctcgcggctctggtcggctgccagggtctcgacgcgttcgaaatgatgctgccggtcgcctatgagacgggactgacctccgtggccatcaaggagatgatctaccaagccaccgcatactgcggattcgggagaaccctgccgttcctgaagaagctcaacgttttccttggagccgcgaatgtgcatctaccgctggagccgcagggcacgaccacgtcggagacccgcgcgcaggccggagaggacaagcagattgaaatctttggtgaaggcatgcgcggattcgctcaatccggtccggacgagacccgtcacatcaacaaatggctcgccgacaactgcttcggcgactattacacgcgaggagggcttagcacccgcgagcgcgaaatggtcacgttgtgtttcctggccgcgcagggtggttgcgaaccgcagcttacggcgcatgcgaaggcgaatatggccgtcggcaatgagaaggcgtttctgattgcggtggtctcgcagtgcatgccgtatatcggctatccgcgtacgttgaacgcgattcgttgcatcgatgaggctgtgaagggctgacctgcccgttaaaaacgccggcaaacaaacaaagggctatccgccgaacaagacggatagcccttccttatagctgattgtggatggcgtgctgtgtttactcgccccacacgtccttggcgatggattggacgagtgcgatcttggcccactgctggtcttcggtgagcttgttgccttcctgggtggaggcgaagccgcactgggtggacaggcacaggcggtcgagcggaatgtactgggcggcttcctggatgcgggccttgatggtgtccggatcctcaaggtcgggcttcttggaggtgatcaggccgagcacgaccttcttgtcgccggagacttcggcgagcggcgcgaaatcgccggaacggtcgtcgtcgaactcgaggtagtaggcgtccacgttctcctcgccgaacagtttggccgcgaccggcgcgtagcctccggaggaaagccaggtggagtggaagttgccgcggcacacgtgggtgttgatgaccaggtcgtccggctggtcggcgatcacggcgttgatgacgtcgaggttctcctgctgcaggcgtagcgcgtcctcgtcgctccagccgagacgttcgcgtacgctcgcatcgcacaggcgggtccaggtgcagtcgtcgaactgcacgttgcggcagccggcggcatacaggtcggcgatgacctggcggtaggcggcgacgatgtcggcggtcagctcgtcatcgttcttgtagaactcgtcatacgggtaggcggccgcgttgccggtgagcacgaagcgggtctgcgcgggggagggcatggtctggcgggccacggtgttctcgtcctcgaactgcttgacgaacttgaaatgttcgacgaacggatggttctcgccggagattcttccggtcacggtggcggtgtcggccggggtcacctcgtcgtggaaggcgacgcggtgggctgcggcggcatggtccacgccgttgaagccccacatgaagtcgaaatgccaccagccgcggcggaattcgccgtcggtgatcacatgcaggccggcggccttctgcttggcgacgagttcggtgatggccttgtcctcgaccgccttgagcgctgcggcatcgattttgccggcggcgaaatcctcacgcgcggccttgagctcggccgggcgaagataggagccgaccacgtcggcgcggaacggcgcgttatgcgagtataccattgaatacccctttttttgggaaagcgacaaatacctagtgaaggttacacgcacgtcccgaaacacgggcgcacacggcttctcggccagtattcgtgcttgaatggatgatgttatccgttacacattcgagaatggaaggcaatgagcgaatcgcgcgatcccgcaggcgacagtacgaccacgaacaacatgggggaggtgcgggaagccgaacatcagggcgcggccgtcaaggcggcgttgggtgcgaacattggtgtcgccatcgcgaagctgctcgcggcgttcttcaccggatcgtccgccatgctttccgagtcggtgcattccatcgcggattgctccaacgaaatcgtattgatggtgggtggacgtttctccaagcgcaagacggacggcgaccatccgttcggcctgtatcgcgccaaatatcttgcttcgttcgtcgtggccacgctgctgttctttgtcggtggattcttctcgacgtccgaggccgtgaagaagcttgtcgcgatcagcgccgatccggcattgtgtgacgtgaacaggatggaactgcttgtcgcgttcatcgtggtcgtcatcagcgcatgcctggaaggattcggcctgcaccagagcatcaaggaggccaacgagcgtatggaacgcacgaacacgccgcgtatgggcgtgttccgtttctggagacgcaccaagtccgccgaactggcttcggtgatcatggaggatacgctcgccctgatcggcctggcgttcgcaggcctcggcatcggtcttgctatcgcgctcgacgacgaggtgttcgacgcgttgggcggtcttatggtcggcctggtcctgatcgtcggctcgcttctactggcgttcaagtccggttcgctgctgatcggcgaggccgtggattccgatacgcgcgggaagatcgtcgaggcggttaccaccacgccgggcgtcgaacgattgctgaacatgcagaccgtgcacatgtcggaggacgacatcctcctgtgcgtcaaagtgcagaccagcaagctcgaccgcgactatgacgtggaaaccgtcgacaagatcgagaaggccgtgcgcaccgcgttgccctggtacagtttcgagatctacgtcgagccggacatctacagcgccaaacacgtgcacgcgtaaccggttcccgcgtaacaggaaccgttcaatatgggaaagcccggacgatctgattcgtccgggctttcccatatgcgtgtcggaaatggtggaagtgggattattcctcggccaccagatccaggtaggagtcgttccacaggtcctcgtcgccgtcgggcatgagcagcacgcgttccggattcaacgcctcgaccgcgccctcgtcgtgggtgaccagcacaatcgcgccctcgtatttggcgatggccttcagaatctcgtcgcgggacgccggatccagattgttggtcggttcatcaagcagtagcacgttcgcgcggctcgtcaccagcgtggccaacgccagacgggtcttctcgccgccggaaagcactcgtgccggtttcagcgcgtcatcgccggagaacaggaacgacccaaggatggaacgtgcctgtgtgtcgtcaagttccggtgccacgtgaatcagattctgcaacacggtggcgtcaaggtccaatgtgtcgtgttcctgtgcgaaatagccgattttgcagccatgtccatattccacggatccggtgtcgggatcctccagatgggcgagcagacgcagcgtggtggtcttgcccgcgccgttatagcccagaatcaccacacgtgaacctttgtcgatcgccagattcacgcctgcgaacacgatgttcgaaccatacgctttggagatgtccttcgccatgatcggcgtacgtccgcaaggtgccggctcggggaagcggatgtccgccaccttctccttcttctgtgcttcggacgtgttctccagcagtttctccgcgcggcgcatcatgttctgcgcggccacggccttggtggctttcgcgtgcaggcggatgccctgctgcatcagacgttcggccttcttctctgcgacttcacgttcgcggcggcgacgttcctcgtcgaccacgcgttggtgcaggtaggccttccagccgagcgagtacatgtcgatctggccgagctgtgcgtccagatgccacaccttgttcaccacttcgtcaagcagttcggtggagtgggagatgaccaggaaaccgccctcgtattttttcagatagccgcgcagccattcgatggaatccgcgtccaaatggttggtcggctcgtcaaggatcagcgtatccgcatcggagaacaggatgcgcgccagttcgatacggcggcgttgaccgccggaaagcgtacccaactgctggcccatcacgtcctgcggcaggccgagactggccgccatcgcggtcgcttcggactgtgcggcatagccgccggccttttcgaaatcctgcatggccttgtcgtagcggttcatcgccttggtcatgacatccggatccggatcggtcatttccttttcggccttgcgtatgcgtttgatgatcgaagcgatgtcgcgcgcgctcatcatgcggtccagtgcggtctgctccgggtctgcggcatgcgtgtcctgtggcagatagccgagtttgccggagacacgtaccttgccggcggtcggcagcatatcgccggtgatcacacgggtcagcgtggtcttgccggcgccgttgcgaccgaccagaccgatcttgtctcccttggcaacgtggaagttggtgggatgcagcaacgtgcgcgcgccgatctgaatctcaagtccctgcgcctcaatcgccatgccgtgatacctctagtctttcgtgttccttcaaacgccaatcgaacatcatagcgaacacccgcaaccgtttcacctcatctcacgtttcatttccaagcagatgccggagcagtgattcgcggtggttgatgaagaccctggtgatttgatagctgtccgtatcctcataatcgcagggatggacgccgttttcgtcgaatgacaggatttccgcatccggcagaccgagcagaatcggcgaatgggttgcgatgatgaattgcgatccgtcgtttgccattcggtacatgtgctccagcagagtcaattgccgctgtgtcgagagcgcggattcgggttcgtccataagatagagaccctttcccgtgtgggacaggagtatctccaggaatccttcgccatgcgacatctcgtgcaaacgggacatgtcgccatatccgcgactgtattcacgagcctgtgtcgccagcgtgaaaaactttccgcacgcaggaagaagcttgatgggccgatcgcatactgccggtatatcgtcatcgccttggcgagatccgacgtgtcatcgtatgtgctgaaacggtagttgcgcgtgccgccttccgcgttgaagccgcaggcgacggcgatgccttccagcaaggttgatttgccgctaccgttctcgcctaccagaaaggtgacattcttgtggaattcaagttcgtcaatcgaacgcaatgagggaattcgactgacgtatgaatcagtcagcatattccaatcgatgcgcagccccgacacaatcagatcatccatgctttttaacaaaaccacacttccatatccggcagaaccgacctacagaccggtggcatagctcgatacgcgcaacggctccaccggtctcatattttcctacgtgccatcgtctcttcagattataggatgggccgtggggaaaggcgcatatatcacgacgacgttgtggatgaaacgaattatccaatcacgtgatcgattcgctacagtggtttcggaacctttcaggagggaagaagcatggcaaaggctttgattgtggtggatgtgcagccgacgttctgcgaaggaggcgaactgggcgtgcagggaggcaatgcggtcgccgaacgtatcgcggattatgtgaacgagcaccggagcgaatacgcatatatcgcgaccacgcaggactggcatatcgagccgggaacccactggtccgaacatcctgatttcgtggatacctggccggtgcacggcaaggccggaaccgccaatgccgaactgcatcccgccatcgccgcattgaacatcgaacatcatttcaagaagggccagtattccccctcatattccggcttcgaaggctttgaggacaacaccgaccgcattcccacccgtgaggaagtctccaccgccatggccgcgggcaggacactcgccaacgggttgaagaccgcgggcatcacatgggtcgatgtggtcggactggccgaatcgcattgcgtcaaggagaccgctctcgacgcgaagaagctgggtttcgaagtgcatgtcatcgagaacctgaccgaaccggtcagtgaggaactcggtatcgcagcccgtcggcagatgagtgaagccggcatcatccttgactgattggccggagtcgcacgactgcagatccgcacgggtatagcggcatcaatccgtgcaaagcacatacgctcgcgaacgcaacggatggaaaatcggccagtcatgatgagtggttcctcgaccaagtagccagataagccaagcgatgactatgccatcgaaagcgggtttgcgttccgcgtgatcaggacgcgtaggcccgctttttatcaatgctgtactaaagccaatcgtcatcgtatggtttcgacatcatggcatggtgcacggtattccgttgaactttaatatccctcgtcgatgaagatccatccgtgttccgcccgcgcggaaccgggattccacgcgtaccagcttccccagccatcttgggacgagttctgcgagcccgcacggcaagagatgtcattggacaggtaaatcacattgtccatcccgtattcgtcaatggccgtggaaatcgaagaactgccaccggaagccgtgacgtcgtgttcggctgcaagcagcgtggccgaacgctttgcgtcatatcggacggcatccacgcggcaaccgttccaggatttcagcctggcaagatccgccttcaccgcgccgtcgatctgggattcgtcgaacttgcccgtcgcgttgatgctgatccgagcatgactgacatcggcaggccggagtggcaggtagacgaaccggtacgcgccgacagcgcatgccacggcggcgacgcataccgatacgacggtgatgggtttcttgcttttcgtggtccgcatgatcctcccacataacagctttccctaaagcatacagcggaaacgtgataagaggaatggataccaagaccaacaagaacgcccttcaacggatactacgatggaacgtgtcaaacaggcggaatgattcccccgctccgcaaacgagatcggcaaacgactcatggtatttgaatatgcacggtgacgttttgacgcgtataaagcgtataaagccgaatccgacgaatcagtactggaatgctgcaaggagggtcagatgatattggccgatgccatcaatctcgttctcgccgaatatcctggaatgaaggcgattggtgccgcggagagtgccgatgcgtggatcatcggactcgatttcgcgtcttcaacagatgaccatccggtgccgggcacaccgagcgtagcggtcgaaaaaacatcaggcgttctgcatgaccttattccggggacggaagatttctggcattacatgaccggtgccaaaaaggtgactattcctcggatttaaaatccgccttagtcttcccataagagctcccgccttccgcgtggaaggcgggagcttccgttattcgctgagcagtttcggcgtgaacgccatgaacaggattcccgcggtgacggcgaagacgatgtccgaaatcggttccgcgcggatcagacgccaagcaatccaacggaaaaagcaagaggaaaaagacacgaagaaacacgccgggccatctcataccagaggatgagtcaccccaacatttacgccaaggaatgaatacgacggacgatgccacggacacgaccagccgtactaccgttgaaaccaacaacggaaacgaaacccacgcacacaccacgcgcatcccacacgcccagcaaaggaaaccggccatgtcatacgtcctctacttcagcaagccattcgcgctcgccatcgcaatctggccattcctctcactcctactcaccctgcccgtgctcgcactgctctaccaccgcgacaaccggctacgcttcacctccgcactgaccgcatatctcgtggtgctctacctcatcgcgctcgcatgcttcaccatgtacccaatgccagaaaacccggccacctactgcgccgcccaccatctcaggccacaactcaacccattcgaattcatccacgacatccgaaccgacggcatcacaggcgtcatgcaactggccatgaacgtcgtgttcttcctaccgctcggctacttcatgaaacgcgtcttccgctggaaattcgccacggcgttgccggccatgttcctcacctcgctgctcatcgaaaccacccagctgaccggcatctggggcatctatccatgcgcctaccgcctattcgacgtcgacgacctcatcaccaacaccctcggcggcatactcggctacgccatgggaagcattgtcacccacttcctaccccaacagcgcatcgacgaagacgccatcaccaccgagccaggcttcgtgcgccgctgcgtggcgctcgcgatcgacctgttccttgtcgaaacggcgtcgctgtccgtcacggcgcttatctatctggttggcgtgctgttcgatgtgaaccgcgcgaacaacgtcaatgcggccgtctccgccgtggccaccatcgtcatgttcgtcctgttcgaagggatcattccgtggaggcgcgccggccgcacgttgggcggcggtttcacgcgcatgacggtggagaccagggagcgttccgacatgcgcaggatcgtgttctatacgttacgcgcgttggtgttgtattgcgcggtctacggattgtggacggaccgtggcttctacgcgctgctgctcggcatcgcgcttatcgtgttctggcgcgttaaaaagcgcatgccgtacgactatgtctgaccgtcgtgcggagctgccgcgagtccggcgccgcaaaaacgcgacacgccgggcttgcgcgatggcggacgctcctgtatattttcaactcgttgcccaccaaggtggaaaacatgcggacatagcttagttggtaaagcgcaaccttgccaaggttgagaccgcgggtccgagtcccgttgtccgctccacaaaacgaaagctcccgggagggagcttttcttgtatttccggcagtcgccggcaccggcgaatccaatggaatccgatgccggcggtcttgttttttcagtcgccgatgttgtcgcgtgccggcgtgaccatcgtcagcatcatgacggacggctcctcggcgtatatcgcgtgcgggatgcgggtgggaaagtaggccaggcctcctggaacaagctccacggtcctgccgttgcccgtcaccttaagccgtcccttcagcgtctgcacgaacaccggcatcgcggccgtatgctcgccgagctcctcgcccgtgtcgaaggagaacagcaccacgttgcctccggccttctgcatgacggtgcgggacacggtggccccctcctgaacggaaatcatgtccccgaggtcctcgatgtatcccagttcgatcggttcggcctcatcgcgttcgtcgctcatcatcgtcctcctttggttggtggcagggatgcccccatcgtatcgtcttcacgccggagacacggcatgtacgcgtggaggaaaaacgtttgaccacgatgtgaacacgctcttgcatcgaacgcgtttatggtccagacttttgcctgttccatgaaagtcggcaatgtcgccgggggcaagtgggacgaacggaggtattaaggaaatgaacgagaacatcgacatcgacaccactttcgtgccggacgattccgccagccattcctggacggagcgcgacagcgagcttgtggaggagtatgcggcccagctcatggcgatgagcatctgagcggacacgatccgaaaacgtgggggacgccccttccggaaactccggaaggggcgtccttccgttttttcattccgccgggccgaaacgcctccggcgcgtccgtagccacatgtgtgactatgctttccagccgtagcgtttgagacgaccgggaggagaccgcatgccgacggacggaaaaccgaaaaacggcatcgtcagacaattgttcagctatggcggcgtttcggccatgcagaccttcgtggaattcggcgtgttcgccgtgcttcagctggccggcctgccgttccgtctggcgaatgccgtggccgtcttctgctccggctcattcaactacgtcatgaaccgcaacgtcacattcaaatcctcgtcgaactacgcgcgttcgatagccatgttcgtggccatgtactgctggaacctgctgttctccaacctgatgatggcctggatccccggactgctcggctggcccaccacggcggtcaagatcgtcaccatgggcatgcaggcggtctggggcttcctgctgtgccgctacgtcatcttcaaatgacgttcgcgccggacggttttcccgccgcgatcacgggaaaacggacatgctatcttacaatggatgcgcatcgggaaacttgtggctaagggaaggacgggacgccgttggcggatgtaagacgggaaatggaacggctccggcccgtgtatgagaccggggtgctgcgattgctgctgcgcggcaattccatgctgtacgtcgcgctgctgcgctccacgttcgacccgctcaccggcgagctgccacgcgagatcgtcgaggaacggttctcccgcagtctgacccgacttgcggaaacgggcgattacacgcccaaggaagggcagacgtccgcggaagccgcgcacacgatcctgcagcagctgacgaaggaaggcgaaggcgactacgcctggctcgccaattcgctcgacgtcgcagcccaccgctacctgtaccgtctcacggcgcgcgcccaccgtgcgatcgaggcgctcgaccggctcgaggacaccacgaaagcgctgtccggcgcgcaggccaacagcatcatcatggagatcgagcatgcgcgcatgcagctgaccgccgacccccgcgaacgcatccgcctgctcgaacgcgacatcgaggagcggcaaaagcagatcgacgaattgaagcacagcgacacgttggacaagctcacctcgcagcaggtcggcgacatcatcggcgtcatccacaacacgctgcgcggcgtgccgatcgacctgcgcgaactggcgctcgaggaacgcgacaacggcgacaatctgcgccgaagcatgcagtcgggctccatcagcgtggagcaggcgctcggcacctaccatgacgaataccacaggtcgttccacgaatccgacagcggccggcgtttcgaggacgcgttccaggtgatcgtcaccgacgagggacgccgcgaaatcgacgaggcggtgcgagacatcgcccagaacccgtatctcgagggcgagccaggcatcctgctcgcccaggtacgcgccgaactcaaacgcatctacgagggcatcgaggacgtgcgccggcagatccgcatatccgacgaggcggtgagccgtctggtgcgccagcagaccgacacgcattaccgcaccatgctcgacaagctccacagactgttcgtgcgggccagcgacgacgcgaagacgcaccccggctcggacgaacgcccataccgtacggacaccggcacggcgcaattccaagcattgccgtccaggcccgcgaaatcgatggcgcgcgcggccacggccggattggacgacgcgccttcgacgaacgtcgacgcgccggacctgaaggccatggtcgagatgtgcggcccgcggctgacgcacatgatcggactcatcaggcgcgatccggtcaaaacggcggacggcaggttcgtggatttcgcggcgagcttcaaccggctgccccgggaggaacggcgcgaaagcgagctgatcggcttcctaagcgccctacgcacgcaggacggaccggcaaccgtggcatggcattgcgtatccatcgacggaggcgagcgcgtgtggcgcaccaggccgatcctcaccaccgaggcggcgcttgacgagatcatcgaggagggatgagcatgacggacaacaccgacggattcgacactggcatcggcatcgaagaggagacaggcccggaatccggcatgccgtccgaagggccggatatgacgagggacaggccggcattgttcgacggggatacgggagacatgcctcttgaggcgcgtatggccgcgatcgcgctgaaacgcgaacgctacatcgacggcagcctgtacgacagggcgtgccagtaccgtgaggccgtggaacggtcgttgaacaacgacatgctcagactggtcgacaacacgaaataccggatcatgtacgcgtcgccggtcacggacgcggagacgaacatccgctcgttgaagacgcgtgtgagcctcacccgcgaggaggccgccacgctcgcggccctgcgcatcaaggtgctggagtacgagaaccagaagacgaagccgggcgactggctcatcagcttcgacgacatccgcgcgctgctcgccacgggagcgggcttcctcacggccagcaacgacgaggagggcacggcgaagaagatcacgtccgtcatctcgcgcatgcgcacctacgggtatctcgcggaaacgggggacgagaacatgtacgtgctcacgccattggtgccgatggtgctcgaccagaagctcgccgaccggtggctcggctccgatgatacggacggcgatggtatgaaagacgcggatggcgatggttatgacgattcgtccatcggcgcggatggtggcgatacttccgattcgaccgggacggtttcgtccggcgtcgagcaggacgcgttcgatttcgattcggccgatgacgcttttgatggaggggaacactgatggaagacggcatgaaaatcgtttccgaccgttggatgctgcaaagccggcagatcgtcaactggggctcctacggcggctaccacgcgttccgcccgtccatggacgatgcgatgccggtgaccctgctcgccggcgcgagcgaatcgggcaaatccacgctcgtcgacgcgcagatctcgctgctctacccatccggcaccccctacaataaggcgtcgaattcgggacgttcggaacgcaacgactacacgtacctgcgcggcatgatcggcatcagcgacggcgaaaacggtgagaccccgatcttcctgcgcggcagggacgcggacggcaccccgcagaacatctggggcgcgatcgtcgacacatacgcgaaccgcagcgacggcggactgttgtcctgcgcaaaattcctctacctgaccgcaggcgacgggccggacggactgcgccgccaatacgtcacctggaaccagaccatcgacccgcgcctcatggaccggcaccgcgacacgtcattcacgcgaggactgatggaacagacctacccaggatgcacgacgcacgtcaacgcgcaggcgttccacgcctccatctggcaggacatgggcctaagcgccgaagcatgcaggctcctgcacaagatccaatccgccgacgcgccctccaaactcgacgacatcttcaaacagggcgtgctcgacgtgcccgaatccatccggctcgcccgcgaaaccgtcgacgactacaaccggttcagcgagaacttccacagcatggaagacaaaatggaacgcgtcgccatcctgcaggacatacaagcccgctacggcgaatacgccaaacaagccagcgaacgccgcgaatacacgcccatcgaccccgaccgcgagcaaggcgagacgacgctcgccgcatggacatggtcgcgcatggccagcgaagtacgcgccggactgccatcggcgcaacgcaaagccaaggaatcccaggacgccatcgaccggtctcagcagcgcatcgacgaactcgacacgcaaatcgaagccgtcaaagaacgcatgaacggcatcgacggcggcagcctgcagcaactcggcaaggacttcgaacgcgcacgccaggacgccgacgaggcgcgcagacaacggcacgccatcgccgaacggttcgaacgcgtcgaaggcagactccccgccgacgagcagacatggaacgccaaacgcgccgcgctcgccttgtcgctcgacacgtacgacaagcgtttggaagacgcgcgatccgaataccagcggatggtggtggaacgtcacgcccggcagggcgaacgcgacctgttgaggcaggattaccggcgcaagatcgaacacaggacgcgcatcagcgacgacatggaccatgcgcgcacgctcatcgcacgggcgacgggcttggacgagacggaactgccgtacgtggccgaactgatggacgtggacgagggggacgagcaatggcgtctggcgatggacgtcacgtacgcgcccatcgcgcagaccattctcgtggacaagcggcatgagcaggggttcgccgcgaaggtcagcgcgatcgatccgacgcgtatgacgcggcgtgcctggcgtttcgtcgataccgacgcgcaatacgattcggcctgcaacgaggggtggatgtcgtcgaagctgcggtacaaggaggattcgccgttcgtcggatggttgaaggagcagaccgcgtcgcaacggttcgacgcgcgttgcgtggaggcgatcgacgacatggaccgggccgaacggcaggtgcaggtcgacgggcagatcaaatccggcgaccgtggcttccatggcgtcaaaggcctgcgtcaggtcatcggcttcgtgaacgaacggtatctggccgaattggaacgccagcttgacggggcggaacgggcgttggaggacgccgaccgccgcggcaggcagatggccaacgccatgactctgctgcaggacgagcatgagctcgcattgaccgtcgcggatctgccatggggcaagatcgacgtggacgggctcgagacgaaggcggaacggatccgtctgcagatcgaacggatcgaaagcgatccggaactggcacaattgcaggacgagttgaaacagctgctacggcagaaggacgacgagggcaagaccaggtaccgtgccgaagcggaattggaaaacgcgcagcatgccgtccaggccgaacaggcatggctcgacatgcatggcgactccgatttcgacgatgccgcattgcccgacatggtgtcgaatctgctggccgacacgtatgagacctgtttcgacacgtcgcgtccgcaggaacggccgcagcgcatcgccggcggtttcgaccgtgaggggacggcgccgttcgacgtgcgcgtgctgcgcagaatcggcaacaccgtgcgtgcgagactccagcagatcgacgagcgtgccgtccaattgcgcgccgacacggaacgcgccatgggcgactatctgaagcaccattccacggagggcgacaccgtcatggcgagcgtggaggactatccgtatttccttgacgagctcaagaacctcaacatgctcgtcacccgcgccgcgaccgacgaggagtatgcgaacagcgtcgaaaagctgtatatgagcttccaacagctcaaccgcgcgttcaacaccgacgaggagaacgtcagggagcagctcgaccgcatcaacggcatgctcaaaggccaacagttcggcccccgcggcggcaggctctcgctccacgtggacttccacccgatcgaccggcagttcaaaacctcgttgggccgcatcatgtcgaagctcgacgattggacacgcaacgcgcgcagcaatcccatggagacgcgcaaggcgttcgcaggctgcgaaacgttcatcggcaggctccaggcggaactcggccagatccgcgacacgaacggcatcaaggaatacggtgcgcgcaacctcgatccgcgcgtgcgcagctcgttctacgcgatcgtgcaccataacgatctgcccgacgagcgcatcagctccaccggcggcaagtccggcggcgcgttgcaggaactcacctcgttcgtctacggcgcggccctgatctacctgctcggcggcgacctgaccggcaagcccacctacaccacgctgttcctggacgaagccctcatcaaagccgacggacgctacacgaaacgcgcgctgaccgtgctgccgcgcctcggcttccagatcatcgtatccgcgccggaaagcaaaaccgccgaaatcctcagcatcgcagacaaggcgtacgtggcatacaaggatcccgcaaccggcaactcgtacctgcaggagctcgaccgcgagccggcaacgcaagccgaaacacaagacgccaccgtcgagcagacgcaacccgcgacggaggcataatatggcagcggccagaaacaccacaggcgaaacggacatccgccggaaactcgacgaatacgtcgacgcccacctcaccaggcacatgtacgacaccgacgaatcctggccgctgcgcaaaaccatccgactgcccaaacaagccgaactagagcagcactacaaccaaatccgcgcccaaaacgaaaccatccgcgactgggcgcggcaacaccactgcgaaaccagcgagaaaaccaaaatcgtctccagcggactcatccaacaaaaaagcccgctcatcgactccgtgaccatacccgacctcgacaccgccctccgcatcgccaccaaacaaacccgcgaacgctacctacgcgaacacgaccgcatgagcgcgctcgccaaagaattcggcctcgaaccggcgaacgccatgaacgtcgccaaaaccctcaaagaccacgacgacaccgacttccacctcgtcatccaagccgcccactacttcgcaaaccacgactgccacaccatgaccccacgcatggcgcccatcccaggattcagcgccaaatggctcggcgcacccaactcccaacgccgcaaagcgatatgccagctcaccggacaagacaacctcaccttccaggaacgcccgaacgaactccgactacgcctcatggacgccgaacaccacgaccaacccgacctcatcgtcacccaaccatgggtccgcagccagccaaccgacatcgaacacgccatcatcatcgaaaacaaagacacctaccaggccatgcccaccgtcgaacacgccatctgcatcctcggcaacggatacgccgcaacatcacacatcacaacactcctgccatggctcaccaccatccccaacatcatctactggggcgacatggacgccaacggactcgacatcctctccaaactacgcgccaccggcatcccatgcacatccatactgatggacaccaccgcataccggacatacgaacaatacggcacccaattcgacgccaaaaacaaacccctcaccacacaaaccccacaacccacacccggactcaccaccgaagaacgcaaactctacgaaacactctgcacaggaacagacatccaatacctacgcatcgaacaggaacgcatccccatacgcgacgccacaaccatcctgcacgaccaacaccactggccaatcgacatacccggcaacgacataccaaacaacaacaccaaatagaacacctgttcgaacccacaacaaaaatacgctatcctatacaacagaacaggcaacaccaagcggaagaacaccatgacaaccaaacgcaacaacacgacacacaacgaagtcgtggtcgaacgcgtactcaccagcgacgcattcctcacacgcgaaatcaaaaaagcccccatgaaaacaacgaacgactcactcatagcagacctcacccacctacccaacgacctcaaaatcaccatccaaggcgctcgcgagcacaatctcaagaacgtggacttggagtttcctcgcaaccgcatggtggtgttcaccggcctgtcgggttcgggcaaatcctcgttggcgttcgatacgctgttcgccgagggccagcgcaggtatgtcgaatcgctgtcggcgtacgcgcgccagtttctggggcagatggacaagccggacgtcgacttcatcgaggggctgagccccgcggtttcgatcgaccagaagaccacgaaccgcaatccgcgttcgacggtcggcacaatcaccgagatctatgattatctgcgactgctgttcgcccgcaccggcattccgcattgtccggaatgcggcgccctggtaagcgcgcaaacaccgcagcagatggtggacacgttgctgaagtatccggaacgcacgcgtttccagattctcgcgccggtcgtgcgcggccgcaagggcgaattcgaggatctgctcgaactgctgcgtggcgatggttacgcgcgtgcgctgatcgacggtgagatgcggcaattgtccgatgacatcaagctcgccaagcagaagaagcacaccatcgaagtggtggtggatcgtctggtggtcaaggacggtatccgccagcgtctgaccgattccatcgaaacggcgttgaagctttccaaaggcgtggtcgtcgccgatttcgtcgatttggacgagaaggatccggaccgccgcaagccgttctccgagaaacgcgcctgcccgaacggccatcagctggaactcgacgagatcgaaccgcgcaccttctccttcaacgcgccgtatggcgcctgccctgaatgcacgggtatcggatacaagctggaaatcgaccccgaactggtcattcccgatccggacaagacgctgaacgagaacgccatcgaaccgtggggcatgaccaaaggcaccggcgaatactaccgccatgtgcttgagggactcggcgatgagatgggcttcgacctagacacgccttggaaggatctgcccaaggacgcgcgcgacgccatcatgtatggccgcgatttcaaggtgcaggtctcgtaccgcaaccgttggggtcgcatgcgcgagtattccaccggtttcgagggcgtggtgcgcacgttgatgcgccggcatgacgaaaccgattccgaccagatgaagcagtattacgagtcatacatgcgcgaggtgccatgccaggcgtgccatgggcggcgtctgcgttcggaagtgcttgccgtcaccgtgggcgacgagtccatcgcggacgtgtgcgacatgtccgccgaacggagcctcgcatggatcaacggcctagaactcgaaggctcggccgcgcagatagccggcgaagtcgtcaaggagattcgcgcacgactcggcttcctcaacgatgtcggcctgaactatctgacgttgtcgcgtgcggcgaagaccctgtcgggcggcgaggcgcagcgcatccgactggccacccagatcggctccggcctggtgggcgtcatgtatgtgctggacgaaccatccatcggcctgcatcagcgtgacaacgaacggctgatcggcacattgcatcatttgcgcgacctcggcaacacgctgatcgtcgtcgaacatgacgaggacaccatcagaaacgcggactgggtcatcgacatcggtccgggcgccggcgaacatggcggcgaggtcgtgtattccggccccgccagaaaaatcaccgaagcgccacgctccatcaccggcgactacatcgccggccgacggaagatcgaagtgcccgccgcacgccgcaagacgcataagaccaagcagctgcgcgtggtcggagcccgcgagaacaacctcaagaacctgaacgtcaatttcccgctgggcgtgttcacctgcgtgacgggcgtgtccggttccggcaaatccacgctggtcaaccagatcctttatccggtgcttgcggacaagctgaacggcgcgcgcatcgtgcccggcaagcacacgcgcgtggaaggcgtggaccagtgcgacaaggtgatccacgtcgaccagaatccgatcggccgcactccgcgttccaatcccgccacctatacgggagtatgggacaaaatccgcacgctgttcgccaagacgcccgaagcgcaggtgcgcggctatggtcccggacggttctcgttcaacgtcaagggaggccgctgcgaggcatgccacggcgacggcacgttgaaaatcgaaatgaacttcctgccggacgtgtacgtggactgcgaggaatgccacggccggcgctacaaccgcgagactctcgaagtgaagtacaacggcaaatcggtcgccgacgtgctgaacatgcccatcgaggaggccgcgcagttcttcaaggcgtacccgtccatctcgcgttacctggacaccctggtgcaggtcggtctcggctatatccggctcggccagccggcgccgacgctgtccggcggcgaatcgcagcgcgtgaaactcgcgacggaactccaacggcgttccaccggcaaaaccgtgtacatcctcgacgagccgaccaccggcctgcatttcgaggacgtgcgcaaactgctgctcgtattgcagggattggtggacaagggcaacaccgtcatcgtcatcgagcacaatctcgacgtggtcaaatccgcggattggatcatcgatctggggccggaaggcggtgacggcggcggcaccatcgtcaccgaaggcacgccggagcaggtcgcgcgatgcgaacagtcgtggacgggcaagttccttagggatatgctgtgactgatttcgaacgacacagtccggacgtgtggcgcaaaacggcggatgcgttacgggaaaccgcagtatcggacgccggcacccaatccgacggcaggggagtgaacaagaacggcgcgcccctgttgggggatactcgcgacctgttccgtccgaaaacctccgacattcccgcgcagccgggcgtatacaagtggcgtgacggcgaggggcgcgtcatctacgttggcaaggccaagaacctgcgcaaccggctgacgaactacttccagccgctctaccagctgcatccacgcacccagaccatggtgttgacggctcgcagcctcgaatggacggtagtgggtacggaactggagtcgctcacactcgaatacacgtggatcaaggagttcgacccacgattcaacgtggtgttccgcgatgacaagacctacccgtatctggccatctcatcaggcgaacgcatcccacgcgtatgggtgactcgcagccgcaaacgtcgcgataccagatatttcggcccgtacgccaaggtatgggatcttcggcacagcctcgacgcgttgctgaagacgtttcccgtgcgcacatgctcgaagaacgtgttccacaaggcgcagttgacgggccgtccatgcctgttggcatcgatcggcaaatgctccgctccatgcgtgaaccgtatcggcgctgacgagcatcgcaggatgtgcgagcagcttgtcggcgtgatgaccggccgaatcggcaaatcgtatatcgcccaactgacccgcgacatgaagcaggcgagcgccgaactggaattcgagaaggcggcccggctgcgcgatcagatccaaatgctcgggaccgtggtccagcagaacgccgtcgtgttcgattcggatgtcgacgccgacgtgttcggcatcgcgtccgacgagcttgaagccagcgtgcacgcgttcttcgtgcggtccggatcaattcgcggcgaacgtaactggagtgtggagcgagtcgaagatgtgagcgacgcggagttgatcgccgatctgatcactcaggtatattcggaaaccacgggggagagcgcggccgtctccgattcgaccgtcgtgaccgagcagcgcaatgcgatcggttcgacacagaccgtgaccgcaacggatgctatcgcccgtgcgcaggccacgaaggaacgcaacgaacgtcaggagcagacgggacgtgccgacctgctggctccaatcgcgcctgttccccgtgaggtgatcgttccaatcgaaccgtcgcgcagcgcagggcttgagcaatggctaaacggattgcgtggagcggccgtcaccatccgtgtagccagcagaggcgacaagaaacagcttatggaccgtgccaacgacaatgccaagcaggcgttggcacgcagcaagatgagccgtatcagcgatatgggcgcacgttccgatgcgatgaacgatgtggcgaaggctcttgggcttgaacaggcgccgttgcgcattgaatgctacgacatttccaacacagtcggcggcgcgttccaggtagcgtccatggtggtgttcgaagacgcgatcgcgaaaaagtcggagtaccgccgtttcgccatccgaggtgcggacgggcagggcgcgttggatgatttgagcgcattgtatgagacgttgacccgtcgtttccgccatggcaacatcgccggcgattccggggaaagcatggacaacgagcgtcggatggccacgcaaaatgataggtcggatggcacgaatggtcctgaaacggatgccgtgcagcagaacaccaaccgtcgccatttcgcctataagccgaatctggtcgtggtcgatggcggcaaaccgcaggtgatgacggcggccaaggcgcttgccgactgcggcgtggacgatgtggccgtctgcggattggcgaagcgtcttgaggaggtttgggtgccggatgacgactatccgatcatcctcaagcgacaatccgaaggcatgtatctgctgcagcgggtgcgtgacgaatcgcatcgtttcgccatcacctaccatcgtcagaccagacgcaaaggagctttgcgttccgctttggacgacattcccggcatcggcgaagcctatcagaaacggcttctcaaccatttcggctccgtacgcgccatgcgtgaggcgagcgtggaggatttcgaacaggtcaaaggcatcggccatgccaaggccgagaacatttaccaggcattgcattcgtccgttgacattgcttcgaaggcggaggatgccctccgaacagtgaaatcggatggaaacagtccgaaagatgaaaagaaatagaatctgtaacgagcaatcgcttctgcgttgctagcatgatgaatggtgagagtaagggagggaacatgaccgaggtggaccatcggtgcgcggtccttggcaaacccatcgcgcattcgctttcccctgtattgcataatgcggcctatcgagctctaggacttgacagctggtcgtatggcaggcacgaggtcggcgagacggagcttgaggattttttggagtcgcttgattccagctgggcgggactgagcctgaccatgccgttgaagaagaccatccagccatatggcgtgccatgcaacgcgtgggcgaaagagctgaaggtggccaacaccgccgtcttcgactggtctggcgcgaacgataagaacgccgccatccctgcgatcaggctctacaacacggatgtgaagggaattgagctcgccttcgagcactcgtatcgggcacgtggcatgcggatggattctggacaagacggcgaggcggtgatcatcggcaatggcaacaccgccacctcggctttggcggcctgcaccgagatgccccacattggacatgtcaccgtcgtggcacgccatcccgataagaacgaggcgcttgaaccattggcggaaagccatatgggcgtcggctccataagcatcgtcgccatggaccatgcggtgaatctgctgtcccatgcggacgtcgtcatcaacaccatccccggccttgccgccgatccgatcgccgaggcgtttgcctcagccggcatagtcacgaacggcacgctactcgacgtggtctatgatccccgcccgaccaagctcatgcaggcctggaggtcatgcggcggcaccgccatcggcggcgaggagatgctgctgtaccaagccatgattcaagtctggctgatgaccggcatatgggacaacgatccgccgaccgagcccaccagccatcagaaagtcgaagcattggagcatgccatgcgctccgcgcttaaggaggccctgtgatgaacgaaaagaacaacgccgtcaaccaggcaggcaggcatacgagcgcgccttctccggccgcaggcttcgaagtgctgctcatcaccggcatgagcggcgcgggccggtcccacgcggccaacagcatcgaggacatgggctggtatgtggtcgacaacatgccgccgaaactgcttgtcccgctggtggacatgatgaccagctccggttcgaacatccacaaactcgccgcggtcatcgacgtgaggtcacgtgactatttcgacgacctgtccgccgtgctgagccatctggacgatcttggggtgaagacccgcatcctgttcctcgacgccagcaacgaggtgctcatcaagcgctacgaatccgtgcgcaggccccatccgctgcagcagggcaatcgtctgatcgacggcatccttgaggaacgcgacctgctgaagaacctcaaagagcacgccgacatcgtcatcgacacctcggcattgagcatccatcagctgtccacgaaactgtacgagggtctgcttggttccggaccgaccacggtttccgtgcatatcttcagtttcggattcaaatacggcattccgatagacgccgatttcgtggcggacgtccggttccttcccaacccgttctgggtgccggagcttcgttcgctgacgggcaaggacaaaccggtcagcgactacgtgctctccagcgagggcgcggaggagttccttgacgcctacgagaaagccatcgccatcgccatcgaaggttatgcgcaggaagacaagcactatgtgaccatcgcgttcggatgcaccggcggccagcaccgttccgtggccatgagcgaggccttggccaagcgcctgcgtgcgcgtggtctcacggtctccgtatcggcccgcgagctggacaagcgttcggccgattgatgaccgcattgtgagaagacagtatccaaatacaaagaaaagctgccggctttgtccaagttattcggtatcacagtaagccggtagcagtgcgggtcgagtccgcgactcgcctgaaattatagggaagaacaggaaagtaggaggttggctcttggctcttctggatgacgtcaaaagcgagctggccgcaatcgacaacgagttgcccatcgccaaaaaggcacaggcgactgcgatgattcgattcggcaatggtttgcactcggtggatcaccacattctcgtgcaggcgcagcttgattcccaagacgcggccatatggctgcaggacaccatcagaaatctgtacggccacgaagccacgcttacccccgtttccaggcagacgccgaccggcgtggtgcagcgcttcatagtccgcgtccccaagggcagcgcggctctggtgctgcagaccggcctgtacagccgttacaccaaaaacatggtgctgggtctgccgggcgacatcatcaacggcaagatcgcccagatcaaggccgcctggcgtggcgcgttcctcgcaggcggacacctgtccgacccgggcaaggccagctatctcgaaatcgtatgtccgaatcatgaggccgcgctggcgctggtctccaccgcgcgtcgtctcggcatcaccgccaagccgcgtaagctgcgcagctccgaacgtgtgacgttgcgcgaccccgatgccatcgaacgcatgctcatcctcatgggcgcccctcattccgcccgcgaatggaccggaaagcgttccgacggagaggcccgaggcaaggcgaaccgtctggcgaacttcgatgacgccaacatgcgccgtagcgccaaggccgccgcggaagcctgcgataaggtccgccaggcctttgaaatcctcggcgacgacgttccggacaatcttaaatccgccggccagctccgactcgaccatgccgacgcgtcccttgagcagctgggccgtctcgccgacccgccaatcaccaaggacgcgatcgccggacgtatccgtcgactgctgcaattggctgagaaaacggagaaggcacgccgtcaagcggcctgattttcgtttccggaaacaaaacaccatgcgacttttccgtcgtatggtgttttttgttcgtttgggcttgtattatgcgtaagtggcaatatggccattccacgcttacaagcggctaggaaaggatatacatgaagacactcaaggatcttggagatctcaagggcaagcgcgttctggttcgcgccgatttcaacgttccgctggacggcaccacgatcaccgatgatggtcgtatcaaggccgccctgccgaccatcaaggctctgcgcgaacagggtgcgaaggtcattctgatggctcatctcggccgtccgaagggcaaggtcgttccggaactgtccctggctccggtcgccgcccgtctcggcgagctgctcggcatcaccgttccgctggctgccgacacctatggtgaggacgcccaggccaaggtcgccgctatgaacgatggcgacgtcgtgctgctgcagaacgtgcgtttcaacccggaggagaccagcaaggatccggaggagcgtgccgcatacgccaagaagatcgccgctctcggtgaggtcttcgtctccgacggcttcggtgtcgtgcaccgcgcccagggctccaactatgatgtcgccgccgatctgccggccgccgctggcctgctggtcgagaaggaagtcaaggcactgtcccgcgccaccgtgaacccggagcgtccgctgaccgtcgtgctcggcggctccaaggtctccgacaaactcggcgtgatcgacaacctgctggacaaggccaaccgtctggtcatcggcggtggcatggcgtacaccttcctcaaggccaagggctacgaggtcggcacctccctgctggaagaggaccagatcgaaaccgtcaagggctacatggagcgcgccgagaagaacggcgtcgaactcgtgctgccgaccgatgtcgtcatcaacccggtcttcccgaaatccgatgaggacatcgctccggaagtcgtggccgccgatgccattccggccgacaagatgggtctggacatcggtccggaatcccagaagctcttccacgataagatcgtcgattccaagaccgtcgtgtggaacggcccgatgggcgtgttcgaggtcccgaccttcgctgaaggcaccaaggccgtggcccaggctctcgtcgatgccactgctgccggcgcattcaccatcgtcggtggtggcgattccgcttccgcagtgcgcaacctcggcttcccggaggatggcttctcgcacatctccaccggtggcggcgcctccctcgagttcctcgagggcaaggaactgccgggcctgaaggtgctcgactgatctcagaatcatgaaggggtgcttcctcatcagtgggtgggggagcaccttttgcgtatttcgcatacaatgtcacaagaacgacctttcgctttgacgagcacggacgggagacgacgaatattatggggccgaaacggattcctttggtggccggaaactggaagatgaatttcgatcatcttgaagcgacgtatttcgtacagcagcttgcatggaatcttcgggccgtccatttcgactacaaacgttgcgaaatcgcattgatgccgtcattcacctcactccgcagcgtgcaggtcgccgtcgaatcggacaatctgaaaatccgctacggggcccaagccgtctcagtcacctcgcagggagcgttcaccggcgacgtctccgccgatatgatcgcccatctcggctgctcgtacgtgatcgtcggccattcggaacgacgcaaataccatcccgaagacgacgcgaacatcgtcgaccaggtgagggccgtgcttgctgccggcatgcagccgatactttgcgtcggagaaagctacgaggaacggcgcaaaggcatagagctcgatttcgcggtcggccaggtgcacgacgtgacgcgggacctgtccgatgaggaggccgcgaagctgattgtggcgtacgagccggtatgggcgatcggcaccggcatggtggctacgcctcagtcggcacaggacgcggccagggcgatccgaaacgacctgtccgatacgttcggaacacgggtcggcgaaacggtgcgaatcctgtacggcggttcggtgtcctcgaaaaacgcggtggaactgatcaacgagccggatgtggacggcttcctgatcggcggctccgcgttgaaggtcgatgaactcacacgcatctgcaagctgacattggaaacaaccgcctgaaaacttttaaaaagcatggttggacgctcgattttttcaacaccatgcgctattatcagaaacagtgtttacgaactggaggttcacccgtgtccgctatggctactgtcaagcttgtgctgcagattcttcttgtcatcctcagcctcttgctcaccttgcttatccttatgcacaagggtaaaggcggcggcttgtccgacatgttcggcggcggactcacccagaacgcgggttcctccggtgtcgcggaaaagaacctgaaccgttggaccgtcatcatcgccctgctgtgggtggccatcatcatcgccctcggtctgatgacgaaattcaacctcatctgattgacgtaatttggtttggcccatgaccggcttcacggtcatgggccaaacttgtctccggctagattgctcccgcaaaggattcaaatgacttcgacaaacaacacctatgatgacgtgaccatggtcgtcgccgatctggacggcacactgctgcacgacggaaagactttcgaggaccgtttcctgacgcaacgatccattgacagcatcaaccgcatgcacgacgccggcatcaaattcgtggtggagaccgcgcgaccggtcagcaccggctactcgttcgtgcagaagcttccggttgacgccgtcgcctatctcaacggggcgctgttggatttcaaccccgtctcgtccgattacgatatgctcacctcaccgacactgccgaaggacggacatctgcagaagatcggattctcttcgaaaagggcctgcgaggtctgcaagtacctgctggaggaactgcctggcatggaagtgggcatcgtcatggatgatgtcaggtacacgaatttcgacgtcacgaaatactggaagacgcagacctggcgatacacggatttcgatgacgttccggacggcaccgcggacaagctgatcctgttcccgaacgaggagcagtggaagcgtgtgggacggctcatccccgacgatttcgacgtgcatatctccgaaggctcgctgtggatgctgatgaatccgcaggccaataaggagcatgcattgagcatcctcgccgatcgcatgtcgacgccgttgtcacggaccgtctcattcggcgacgatttggtggacatcgccatgcttcgtgaatccggcaggggagtggccgtggccaacgcgaaccccgacgtgttgaaaatcgccgatgagatctgcccttcgaacaatgatgacggcgtggcccaatgggttgagaacaatctgctttgaccgaccccccacatggagtcttttcacggaattgaactcattcatgcagcggcatgaaacacatccaccaaaattgaactctttgtctttcttggtgccctgtcgtgctattctttgaactagcttttgtttaaattgaactggaaggataggcatgacggaatcattctcgaccagattgaatgatgccatggcattacgcgagcttaaacagattgatttcgttcatgctgcggaaaagttcaatatcaagctcggcaaaagccatatgagccaatacgtcagtggcaaaaccgttccccgtgccgatatcgcgcatttccttgccgcgtatctgcgggtcaacgaggattggctgatgggcaaggatgttcccatggaagagcatgccgcgattttgccggattttgccggtgaacagcccgaccatgttgacgatgcatccgagcaaccgacagaaggaagaaccatgcgcacttttacgaaatcccacaagctcgacaacgtgctgtacgacgtccgtggaccggtcgccgacgaggccgcgcgcatggaggccgccggcacgcacatcctgaaactcaatatcggcaatccggcaccgttcggcttccgcacgccggatgaagtggtctacgacatgtcgcagcagctgcccgacacggaaggctattcgccgtcgaagggcctgttctccgcgcgcaaagccatcatgcagtatgcgcagctgaagaacatccccaacgtgtccatcgacgacatctacaccggcaacggcgtcagcgaacttatcaacctgtccttatccgcgttgctggacaacggcgacgaggtactcgtgccgtcgccggattatccgctgtggacagcttgcgtgaatctggccggcggaaccgcggtgcattacgtctgcgatgaggattccgaatggtatccggacatcgacgacatgcgttccaagattaccgacaagaccaaggcgatcgtcatcatcaatccgaacaatccgaccggcgcgctgtatccgaaggaagtgcttcagcagattgtcgatcttgcgcgagagcaccagctcatgatcttctcggatgagatctacgaccgtctggtcatggatgggttggagcacatctccatcgcgtcccttgcgcctgacctgttctgcgtgacgttctccggattgtcgaagtcccatatgatcgccggctggcgtgtcggctggatggtgctgagcggcaacaagcgtctcgccaaggattacatcgagggtctgaacatgctggccaacatgcgtatgtgctcgaacgtgcctgcgcagtcggtggtgcagaccgcattgggcggccatcaaagcgtcaaggattatctggtgcccggcggccgcatctacgatcagcgcgagttggtgtacaacatgctcaacgatattccaggcatcaccgcggtcaaaccgaaagcggcgttctacatcttcccgaagatcgatgtgaagaagttcaacatccattccgatgagcagttcgcgcttgacctgctgcatgacaagcatatcctcatcagccacggcggtgcgttcaactggcaggaaccggaccacttccgtgtggtctatctgcctcgcatcagcatgttgaaggagaccatcggcgaaatcggcgacttcttcagcacgtattggcaggcttgattttcggttcgcttttctttcgattatggccgcgatctgatatcgcggcctttttgtctttccgtatgtcttctgcgcgtattatttcggcatacgaaaaagaggtctccatcaaaagatggagacctctcggcttttatccgtttaacggtgctgtatcagcgaatgattcagccgttgacgcggtcgatgccagcctggacgtcggcgaggacggtgtcccaggacttgatgaaggctgctacgccgtcagcttccagcttgtcggtgacatccttgatgttgatgcccagatcggcgagcttgttcatgatggcgtgggactcttcgtaggtgcccttgatggacggagcgccattgccgtgatcggcgagagcgttcagggtcttctccggcatggtgttgacgacgaacggagcaacgagctcgtcgacgtacttgcagtcggagtaggcggcgttcttggtgccggtggaggcccacagcggacgctgcttcttggcgcccttggcttcaagagcggcccaacgcggatcgttggcgaacttgttctcgaacagctcgtaagccaggcgagcgttggccacagcggccttgccctcgagagccttggcttcgtcggagccgttggcttccagcagcttgtccacagcggtgtccacgcgggagacgaagaaggaagcgacggagccgatgtgcttcaggtcgtggccgttggcgtcagcctgggcgatgccctcgatgtaggcgtcgatgacctgctcgtaacgctccagggagaagatcagggtgacgttcacggagatgcccttggccagggtggcggtgattgccggcaggccttcgagggtggccggaatcttgatcatggcgttcggacggttcaccttggcccagagttcctcggcctgcttctcggtggcctcggtctcgtgagccagacgcggatccacttcgatggagacgcggccgtcaacgaaatcggacttctcggcaacctcacggaagatgtcggtggcgttgcgcacgtcggtggtggtgagctcgcgcacggcggtctcaacgtcgaccttgcccagttccttcagctgcggatcgtacgggccgacctcgtgcagagccttctggaagatggacgggttggtggtcacgccgacaacgttcttgttggcgatgagatcctgcagagagccggactcgatgcgggagcgggacaggtcgtccagccagatcgagacaccggagtcagaggtgcgctgagttgcttcagtcattgttttttctccttgatacctttttggatcaaatcttgtttatcggtgaaaggggaggggcacatgctgtcgtgtccctccccgtatcatcacttggcggcttcgacttccgcgatggaggccttggcggcttccacaacgtgctcggcggtgatgcccagatcgatcatgttctgagcgccatcaccctgcaggccgaactgctcgatggacaccggcttgccgtaggagccgaggtacttgtaccacggcatggcaacgccggcctcgacggagacgcgggccttgacggcggccggaagcacggcctccttgtattcggcgtcctgctcctcgaaccattccacgcacggcacggacacgacgcgggccttgatgccctcgccggccagggtcttggcagcggacacagcccactggacttcggaaccggtggccatgatgatgacgtccggggtgccctcggtgtcaacgagcacgtaagcgcccttcttcacgccgtccttggccttctcagcggtctcggcgagaaccgggacgccctgacgggtcagaaccatagcggtcggcagggtgttcttcttctcgaagaagtaacggtaggcttcagcggtctcgtaagcgtcggccggacgagcgacctcgagctgcgggatggcgcggaaggaagccagatgctccaccggctggtgggtcgggccatcttcgccgactgcgacggagtcgtgggaccacacgtacaggttcggaatctgcatgagagcggccagacgcacggcggaacgctcgtaatcggagaacatgaagaaggtgccgccgtacggacgggtgtgggagcccagcaggatgccgttggtgatggtgcccatggtgaactcgcgcacgccgaagtggagctgacggccgtacttgctgcagttcggccactgcttggtggcgcactcagccggggcgaaggtctcagcgcccttgaggtcggtcttgttggagccgccgaggtcggcggagccgccccagagttccggcatgacggctgcgatggcgttcagagtggagccggaagcgccacgggtggcgacgttcttgccgacttcgaaagtggcctcgaggtcgtcgatggccttgtcgaagccttccggaagctcgccggccttgatgcggtcgtacagggcagccttgtccgggttggccttgcgccatgcgtcgtacttctcgtcccattccttgtgggcttcgagaccgcgctcggcgaccttgcgggcgtgggcgagggcctcttcgtcaacgtggaaggactcctccgggtcgtagccgaggagcttcttgaggccggcgacggcctcggcgcccagcttggagccgtgggaggacgggtcgttggtcttgcccggggtcggccatgcgatcagggtgtcgaccttgatgagcttcggctggttcggggcggcggcgcgggccttggcgatggtgtcggccaggccttcgacgtcctccttgtaggagccgtcaggctggatgaagctgaactcgtcggtgtaccagccgtatgcctggaagcgcttgagcacgtcctcggccagcaccaggttggtgtcgccttcgatctggatgcggttggcatcgaagatcacggtcaggttaccgagctgctggttggcggcgagggaggcggcttcgccggagatgccctcttcgatatcgccttcaccgcagatgacccagatgttgtggtcgaacggggactcgccttccggagcttccggatcgagcaggccacgctggaaacgctggccataggcgaagccgatggcggaggcgaagccctggcccagcggaccggtggtcatttcgatgcccggggtcaggccgtattccggatgacccggggtacgggtgtcggcgccgccacggaagttcttcagatcgtccagggtcaggccgtagccggagaagtacagctggacgtactgggtgagggaggcgtggccaccggaaagaatgaagcgatcgcggccttcccagttggggtcgttcggatcatgcttgatgaagtgctggtacagggtgtaggcgataggcgccagggagacgggggaacccgggtggccgtgtcccgcacgctcaaccgcgtcggccgacaggaccttggccatcttgatggcgcgttcgtccagctcggtctccttgaattcggtcatggattactttccttccaattggtcgggccgcgtatccggcttgtgccgagcgctcgacgccctcacattgcgtttcccatagtagcgatgtgaggtgacgttgtggtgaaattttggcgtgttttggtagtttgtgtgctgttagcgctcacaattaacattcgcgtgaacttcagatgttcgtttgtcgatatatctcccaatgccagtcgccgcaagcctttgccgcatgaaggaaactactctggaagcgaacgaattagcactccgggtgccggagtgctaaaacattaaaagaagttttccgggtacgtctcatcagcaccgtcaaacataaggcgtaccggcacacacctatgcataaggaggcgcgcatggcgcaatcaagacgcatgctggtgttgcgtgccgtggtcgaggattacatccgttctcaggaaccggtgggttccaccacactgacccgggatcatgacctcggcgtcagctccgccaccgtgcgcaacgacatggcggccttggaagatgaaggctatcttattcagccgcacacttcggccggcagggtaccgaccgaaaaagggtaccgttacttcgtcgaccgtttggcgacggtcgttccgctatcggaggcccagcgccgcggcatcaacagctttctgtccggatcggtcaatctgcaggacacgctgcagcgggccgcccggctgctggcgcagatcaccggacaggtcgccgtcgtggccgcgccgtcactgtcgaagtcgacattgcggcatatcgaaatcgtgccagtgtccattaatacgctgcttgccgtagtgatcaccgataccggccgtgtcgcgcagcatatcctcaacgtcacgaaattgccggacgtgacgacgctcactcatctgaccaacgagatcaacacgcaatgctccggcgtttcgctgacccgcacggccgattgcgtacgacagatgggagcgcgcaaggaataccatgcgatcagcacgcttgcggaaacgcttgcgcaggcctttgatggcatggcggatgacgaacgcgcgagcgaattgtacatggcgggcacttcacggcttgcgcatcaacgcacggtggccgacctggccccgctgttcgacgcgttggaggagcaggtggtgctcatgaagttgatgagctcgctgagcgaaaccacgcaatccgacggcgtcggagtggcgatcggttccgaaacgcacacgcccggtttgctgcacgcctcagtggtaaccagtggctacgggcgtacctccgcggccgccacggacggcgcgacgcatgcggccgcatcatcacagacggaaaatcaaagcggtgatgatacgcagcaggcgggcgaaccggtcgcattcgtcggatcgatcgggccgacgcatatggactacgcggcgaccatggccgccgtgagggcggtcgccagatatctgacggcgttcctcgcccacgatgaaggtcagccggccgactgaccccgccttatggcacaatgacacgcagaaccaacagggagaaagaataatcgtgacggactattacgaagtgctgggcgtcgaccgttcggcaagcgacgacgagatcaaaaaggcgtatcgaaagatgagccgcaaataccatcccgacatcgcaggtccggaattcgaagacaagttcaaggaagtcaacaacgcgtacgatgtgctgtcggatcctaagaaacggcagatgtacgatgccggcgtcgatccgaacgatccgaatgcgggcggcatgcacggtggcggattcggtggcggattcggcgatatgggggacatcttcagcatgttcaccggtggcggattcggtggcaccggcggtggaccgactccgcgcacccagccggggcgtgacgcgcttgtttccgcgaccatcgatttgaagacggcggtgttcggcgacaccacgcacgtcaaggtcaacacgttcggcctgtgccaggaatgcggcggcaccggctgccagaacggcacacagcccacacaatgtcccgactgccacggtcagggatatgcgcagcgcgtggtacgcaccatgctcggccagatgatgaccaccgcgccatgcgaacgctgcgaaggccatggaacggtcatcgagaagccgtgcccgtcctgcctcggccatggccgcgtgcgcgtcacccgcaatgtcggcgtcgcggtgccggccggcgtggcgaacaacacccgtctgcgtctcgctaatcagggtgaggtcggcgaaaatggcggcgtcgcgggcgatttgtatgtggatatccgcatcaagccggatgacatgttcactcgtgatgacgacgatttgcattgttggatcaaggtgccgatgagttgggccgtattggggcacgaagtcgaaatcgacaccttcgacggcaggcagacgctggatatcccagccggcagccagccggacgataccgtgacgttgaagaacctcggcgtcacgcatctcgacgacaagaacgagcgcggcgatttggtggcgcacgtagtggtggagattcctaagaagctgtccgatgacgagcgggagctgattgagcggttcggcgagatgcacgacacggacgcccagcatgttgtcgtgaagtcccgtccgtcgtccggcgcgaagaaggggttcttctccaagctgaaggacgcgctgcgctagttttcgcaatccaatcgaatacgggacatgtgaaagaagtccgtatcccaactcataaccttgggatacggacttctttcacatctggcgtggcgggtgattcccgcctatttgagcagcgacctgcacatggtgcgatactggctcacatatcctccaccgaagaacacgcaatgtcctgcaatggggtagagctgccataatgtgatgcggtcctgccatccggccttaagcggatgcgccgactgatagccttcgaggatgtccgtaagatatgacatgccgaacaggtcgagcatggcaaggtcttcctcacggtgcccaccgtgagccgcaggatcgataagcacggcttcgacgtcaccggaatcagcagtccacatgacgttgccgctccacaggtcgccatgcacgcgtgcgggcttgtcgttggcggccttgcctaggatgtcgggcaaggcgtcgataacggcttcagtcagttccatgtcatagtcggtcagttcgcgacgtttcatgccgagtcgtaccatcggacgcaatctgccgtccgccagataggtggccacatcatcccaggcaccggtatccatcgggacgggatcctgcaatggcccgaaatagcaggtgccgtcgtatccagttggagcggagccaaaatgttcggcaccggcatcatgcatatgagctagcgcaacaccgaaatcgcgcgcggcttggatggtcggaccgcaggcgttcacgcgttcaatgtcgagataatccttgccccagtcgtatacgtcgaccacgcgtgggccgccctgcgattgcgcctcgccgagccatttgaggccgcgtccctcgcattcaaagaaaccttcggggctgaatgccctgcttttgcggtatttgcccatgccgatgagcctttctcccatgccggacatgccggcgtacttttggctccattgtgtgcatggtttgagacaactatgccgggatgccttgaaaactagacccctctcgctactcttggtcacggaaaaacagacgaaaccgtatttctacgaacataaagagggttcatgaatttcttccaagcgattttccttggcctggtgcaggcgttgaccgaatacttgccggtctcttccagcgcccatatccgtatcatcggcgatttgatgctgggctccgatccgggtgctgcgttcaccgccatcatccagatcggcaccgagcttgccgtgatcctgtatttccgtcatgacatcatccgcattctcggcgcgtggttcggctccttgttcggcaaggagggcaaggacttcaagagccgtatgggcgcgcataaccgcgacacgcagatgggttggttcatcatcatcggcacgctgccgattctgattgccggtctgttgttcaaggacgccatcgaaagcacgctgcgtaatctgtggatcaccgttaccgtgctgattatcttcggtattctgctgtgggtggtcgacgcccgcgccaagcaggtcaagaccatggatgagatgacctggaaggatgcgctgatcttcggcatcggtcagatgctggcgctgattcctggcgtttcccgttccggcggcaccatcaccttcggccgtgcgatgggttatacccgtgaggctgcagtgcgcgtgagcttcctgatggccattccggccgtgttcggcgcgggcatcctcgaagccgtttccgcggtcaaggatgtggccgcaggcaatgcgggaatgttcccgggctggggtgcgaccatcgcggccaccatcgtggcgttcgtggtcggctatgtggtgatcatcggcttcctgaagttcgtgtccaccttctcgtacaaggcgttcgccatctaccgcatcgcgctggccgttgtcgtggctctgctgctgatctgcggcgtgctgcacccgacggaagtcgttgccgccgcgtaagcgtgattcggcgtaaataaagcgaatcccggccatccgtaaggtggccgggattttttcgtctgcgacctcctcctggaggggaacgactcagacgccgttgcgtagaagtgattcggcctcacgaagcagttcctcgcaggcaggcatgccattcgaggcgattcgcttcgctctcgcgtccaaatcgtaatcatgttccagacgagccaaatagtcgccggcatgcatgtctgacaccaatccatcggcgtcggaacgccattgcatggcctttctggtcaaatctccttcaataagcggatactcgattattaaagacaaggcgcgcagcagctccaaagtgccttgcatgcattcggtattggcacagtaatgcggtacggatacccatatggatgttgtcggaaagcccgcttcggcggcgaaggcgtcaaggatgttggggatgcccaccggaccgttgtattccctgtcggattcgcattcgcagccgcttttggagatgtcaagcggcaatggccgtgtgtgcgggcattcatcgaacatggagccaagcgtgatgacatcacttacgtcatagtcttctgcgacacgtagcgtctgcctgcagtattcctcccaccggtaattgggttcgggtgcgatttgcgcaagcaggtgcagcatgggggagacggcaatgtcatagaaagtcgtttgcggccagatgatgcgcttacgcccctgcacggagcagatcatgggccgggccacctgatagtcgtagaaaccttcgttgtcaatatggcgcacttcctgcgactcataccgggacaccaaatgacggacgacgttcgtggccgcttggcttgcatcgttccatccttcgaatgcggcgataagtatcgtcttgggcattgcgctctcctcacacatgcttttaatgtataccgaaaacgggtggtgtgacacgcgcttcagccatcggtgaatacgaataaaccaaaccgcgacacgctgacttgcaaattacacgaatgtggttatagtagatactcgtgctcacgcagtgaatctgctgaagacatgcggacatagcttagttggtaaagcgcaaccttgccaaggttgagaccgcgggttcgagtcccgttgtccgctctaaggttccgattgattatcgacctttatggtgggttagccaagcggttaggcagcggcctgcaaagccgtatagacgagttcgactctcgtacccacctcgcatcatgtgagattagttttcgcatgttgacatgacccgggcggttggcgcagaggtagcgcacttccctgacacggaaggggtcacaagttcgaatcttgtatcgcccactggagcattgctccgtacaaattaagactgggtgattggcgcagcggctagcgcacttccttcacacggaaggggtcataggttcgattcctatatcacccaccgttatcacagctcggttttgccgggttttttgtttccattccttttcacgctacttcgtcaaataagaatgcaagcatcgacgcgccggcaaaaacagcgatcgacgaaaaacgattcaccacattacacaagaattgccgatgaaaatacagagaatcaaacgagagaagcatgacttttgccaaacgcatttctaaaatgagtatcgtaaacaaaaaagaaaacaaacaagacgcaaggtgcgtcacagcacaccagcaagaaaaggaaacatcatgaacaagaacaagatcttctccgcaatcatgcgtggcttcgaagtcagcggcatcaacgctctgtcttcggctgccggctcctcttccgtcaacggcgctctgcaggaaatcatcgacacccgccgctgattcggacaccacacactgaatccttcttgaaaaagcctggaacgcgattaaaaagcgttccaggctttttgttccccggcaagcggctacaattgcctattgtgaacgagagacaattgaacctcaaccaagcggttaaggatatgggccccaacgaattgaaagcgtacgccgagctggggcagaaacaacacgatgaggcgaaccgcgaactggaacgacgctggcgcagctacgatgacatgctgccgaaggacgaattcgtatccatcatcgacaagaacgaacggtaaataccgttcacagtgtatgattcgtgaccatgccggccacaataccggccaattgcaaggggagagggtagaatgacagctatgactgatccgattccaagcgcaggcgaaacgaccatcattggtcttcctgctatcactgtaccggttacttccaccggagaccgtcctctgacgaaggaggacctcaatacgatcatgcgtctggccgacggcacggcgctcctgatttccaccaggggagcggtgtccggctcgcgttatctcctcgacgaggacgagatcaccgtgggacgcgacccgagttccgatatcctgctggacgattccaccgtctcccgcacgcacgcggtgttccgcaggattaacggaaattattcggtgattgacgccggcagcctgaacggcacatacgtgaaccgtcaacgagtggatagccaggaactgaagaacggcgacgaaatcattctgggcaagttccgtctcgtatatttcaccaacaaggccgtcattgcctaatgaaacgcccgatgcgggataaactgtgagtaacggttttccttcaatcgcctatgggctccgaatggaagctcataggcgattgttttatggcgtgtaggagaagacaatggacggcgaggcagaaccaacaatgcggttgcatctgcacgtgtcgcacgcggtgcagggggagttgttcccctccgcggacgcgcagcccgtcacacggggctatcgtggtacggtcgcgtcaaaagtggcgggtatcacgtaccgccagcttgactattgggcgcgtaaacagatagtggaaccatccatcaccccgtcgcacggatccggctcacgcagattgtattcgttcaaagatgtggtgattcttgccgtttccaaaagattgctggatgccggaatcaatctgcagaacgtgaccaccgccatcggcttcctcgcgcagcgcacgcccgaacagttggccggcatcatcatcatgtgcgatgggcagaatgtgcatgagtgcacggacagcgaacagatggtggctctgctccaaagcggcagagctgtgttcggggtgtccgtcggatcgctatggcatcagatcaaagaggctctagaacatgaggaatacgtcgatttgacgaagacgccggcatcgacagacaccaataggccaatcgacgacattgccgcgatacgtatgagaaagaagctggaatcgcgacgcaaatcccgcgcagcagcctgatcgcatacaattggtacgattcagcccggaacgttcgaacgatataacccgcaggggggtagcgcatgcttgatattctgccggcactgttgtggatcatagccgccgtcatcgcagtgaacatttgtttgattactgcgattcgaggcaatctgttttccaaaaaacaccgcgatgtgcatccggtgcgttggtcgatcatcgcgctgcatttcacctcattggtcattggcgcgttgccatatccggcatatgcgatgttcaggtcggatttctcggagaggttccagcgtttctacgaacatgtcggatggccatcggctgcggtgatggtcatgctgatcgcagcggaacttgttttcatgtatcttcaggcccgaaacggcatgcacagcgagatggagcggaagctcaatcaggccgtcaaatagaaatctgacataacgtacattatcggctttttaggaatgacgtttttccaggcttgaggaagcgtcaaacacgcggttctgacataacggcctccgtcactcaataaataaaaacgtggttgctgccacgatattgcgacagcaaccacgtaactggcctacagcgtttccgtttacggactcaggcgaaatactcctcgacggcctgtgcgagttcatctaccgaatccagaatacggtatgcgccatgggctttgagctctccgggctccgcatagccccagccacagccgaggcagtccaaaccgcacgccttggcgccgtcggcatcggtccaacggtcaccgaccatcagtgccttgtctcctgcgttctcgtcgaaatcgatgtgctggaaagcccaacggatcacttggtccttgtcaagacgggaattgtcctcgctggcaccgtagatgccgtcgaccatggtgtccaagtggaaatgctcgcaaatcggaatgcattggtattgcggcttgcagctggcaatcgccagatagtatccgtcggcacgcagtttggcgagctgctccggaataccttggtaaatcgtgttgttcaggcggccggggactttctgtccgggattgttcgggtcgtcgaacacggcctcgtcggcgtaatacttgcggtaaatcctcacgccttcgtcaagcttgtcatccggaatgccgttgcgttgcatcgattcgctgatggccggtccaatgaaacgatgcaattcggcatcgtccggcaccggatatcccatctcttcgaacgccttgacaacgcagccaatgattcctggatcggatttcgtcaatgtgccatcgaggtcaagcagaacgactttcttcggatgttcggacatggatctgattctccccttggctgtgtgctataagaattgatgacagaaacaattatgcccggtctcaatgaccgggcattcgttcaagtgtcgttcaactgcaggtcactcgtagtccgggaaccatccgtcacgatgcatttgcagacgcttctccagcaaagccttcagttcgtcttcggtacgacgttccatgagcatgtcccagtgcgtgcgtgtcggcttggcgatttcatcagcctcgtcgtcattgtctccttcacggtgcgcgacggcgccgcagcggcactcccactcatctgggaattctgcgccctcagcgaacggcagaatcgtacgatggcctttcggacacacgtatgcgacgtcggttcgcgccgcaaaatccacattgtcatcggattcaagcgacttcgcaccgatgctcatgcctcgcaggctacgttccgccatattgcttttgcctccttgattatctgcttactctaagctacaaaacacttcggacgtgtcacttattcccggcgtccgcgaaaaccgatctcccgattgcgcacatgctcagtcgacacctgaataggcgacgatgccacggttgacgttctcgtacgcctgtttcgcgatcggagcgagcgtttcggcgcgtttacccaggtatggtccggccacggcgatctgctgcaacacgtcggcgagacgtttgcatccgcgtacgaaatcgccgccggtcaaatcggtgccgtacagcacacgcgacaggctttcgccctgagcccattcgtagacgacatcggtgatgccgaaatcaagttggcgcggctcgtcgagggcatagtcctcacacagcatggcaatcgacgcgtgcacgcctttgagctgcgccgcacagacggcgacgttcccctgcattcctccgggataatggcgcggctctcccccgctgcctctgcgtggctcgtaaatcaacgacatgacggcgctggccagctccgtcgcatcgagtccgtcgaacgcgccatcatcgatcgcctgggcaagcaccaaatcaagctcgctgtacaagtgccgcaacagctgtccacgttcggtaagccggtaatcgatatgttcttttgcgccttcatcaagccgatcgaggtatccgagctcgttcagcacattgcagatgcggtcgaattgacgtgccacggagccggtgcgtgaatcgtagcggtgctgcacacgttccaattcacgcatttcacgcgcccaccgatgcccccatttgagatgcttctgaatatcggggcatttgcggcagggatggtccctgcctttttcgcgaagctccgcgatacgcctgtcaaggtctttgaacgcttcgcttcgcgccttctgcgtgcggaacacctcgtgcttgagtttgcgtcgttcgttcttttccaagtcgctcaagcgcatgcgcagccgcatgaactccttgaagtcgccgaactcacaatcgaacgcccgttcgtatccgtccaacgctttgcgcaacgtatccatctgcgcttcaagctgccaggcggattcgttggcctcccattgcgcgaaggaatggtcaagcgtgatgcgagcggtctcgtaatcgctggaattaagcaggttgacggccatgttgaacgtcggtttgaaactggagtgcagcgggtacacgcgcttgctggacagcgcggcggcagtggcgggaatgaagccatgatggtccacaaccaccgcatggccgatggtgtcgatgccacgtcggccagcgcgtccggtaagctgggtgaactcccctggcgtcaatccgacatgcccggtcccatcgaatttctcaagtttttccaccaccacgcaccgtgccggcatgttgatgcccaaggcaagtgtttccgtggcgaagacgaccttcaccagcccctcttcgaacagtcgttcgacaatttggcggaagagcgccaccatgccagcatgatgcggcgcgaatccttcctccaaggcgaagcggaactgcgagaaatgcaaagccttcaaatcctcttgactgagttggccttcgaccatctcatcgacgatacggcggatgcgacgcatctcgtcatcggtggtgagttcgagtccggcgttgatgcattgttcgacggcctgatcgcatccgttgcgggagaagatgaaatagatgcccggcaggatgccgaggaaattcaattcatcaatcacggcccaacgacgtggcgtatggcgttcgggtctgcgggaatggtcgttccatttgccgcccttgccgccctttcgtctgtcggggcgctgctctcccctacgtttcgcggccttgcggtcgagctgatcgagcctgctcaccagctgggcgttgagcttgtctgtctgattgccgtctttatcacgtcgatacaggtcgatgagttccggttcggtgtggtcgtccgcctgaacaagcacatgctgttccaacggcacgggccgtttttcggacaccaccagcgtggtgtcgccacggaccgattcaatccatttggagaagtcctcgacattcgacacggttgcggacaggccgatgattctcacgctttggggcaggtggatgatcacttcctcccacaccggcccgcggaaacggtcggcgagatagtgcacctcgtcaagaatcacgtaacgcaaggcgtcaagcgtcatggaatgctcgtagagcatgttgcgcaggacctcggtggtcatgaccacgatgtcggcttcggagttgatggacgtgtcgccggtaagcaggccgactctgtccggcccgtacgtttcgaccagatcatggtatttctgattgctcaacgctttgattggcgtggtgtagaacgctttgacgttacgctcttgggccagatagatcgcgaaatcagccacgaccgtcttgccggctccggtgggcgcggcgacgagcacattgtcgccggcttccaacgcatcattggctttgacttggaaatcgtccaattcgaatggcatggaccgtgcgaaacgagacgagaccgattggcgtttggcctgcgtctgtttgaacgccgcatagcgttgcgcgggagatagggctgtggtcatctcggcatcgtatgtgccggtgtcgttattgccatgtcgacgatgatgagtcatggttccttttcgaatcagtcgttggaatgtttccactgcgcccactgccgggcatgacggacgcgcttttcctcacggcggctgatgacttcggcatgagcgtcgatataacgattggccgcgtcctcaagtggacgtgtaaagaacggggacgtgttctcctttggttgcggcaacggctcggacatggcctcgaaacgtttggacatgcgtccgcctactttgatggcatctttgaacgcatgatatccgcggatgcatgcgtatgcgccgccgccgaccagcatcgtcagcatgaacaggacgagtaccagccaaatccaccaaggcatagcgcctcccccgtcagtcttcgttctctcggtcgccgacgctcagctcatgctgtgctcgggcgatgatcatcgtgcgcaacgtctccggcgcgacggcagtaatatgacgggcgtgcgcgatgcagaacgcgacataccaggaatcggaagacacaatcagatgcaccttctcgccttcgccgcatttctcgacggtggctcccgacaggctgtcgatgaacgacaggtcgtcctgattggttatgaacacggcaggtgtgccattgtcgaaactccacttgcgcagttcggatgcgggcacgtccggaatgtccactttttcagtgggttcgaccagctccgcatgctcgatgcgggagatgcgaagcacctgccagatacgaggcttgccagtagccttgttgatggtcgtatccgtcttgacgaacttcatcttgtccgcgggcgccgcgttggacacgtcggtccataccgccacgtagtaaacgccttcgtcgacaaaaatcttgtctggcgccactagcttgcgctgtatacggcccgcaccgtccgtatattccatgtcgagcagcatgcctttggagatggcgctcttgacgatggagaagttccttggttccatctcgtatccggtcaggctcagccacggcatgtcgccaggcttgacgtgctggcgcagtcggctgtacagcgattccgcctgctcacgcagcttgtccggaagcaaagaggagtgggcgagatagctcaccgatgcggtcagcatgctcaggtactgctgggaaatgccggcaaggcgttcaagccccagcgaattcgtggcggagacgatgccttccgcgtcaagcaaggaccaatcgatatcgaagaactggcttccggccatctcgccatcatcggacaccgtggtcaacgtgttgatgtccttatgaatgatgttgacgaacttcttcaattcgtcatcggacttcggcctgccgatgaatcgttccgcaagttcttcaagagagtattcctcacccatgtgggcggacaggaacagcatcaggcgaagacgccgatcgacctcactaccggtctggaacgcggagttcttcttcggacggcccttgccttcctcggtatcatcctcatcagtgctgttgcggttgatttccggagacaccacggtggagctgtcggtgccggtggattcatcggccggcacgaactgcgtggccgcatgcagccggcggttgaacgcgtcgacagcctcctgagggctcactatggacgcacccggatgagacagcacgaacatggccagatcatcggagtcggcgtaggcgacattgagatgctcgccatcaacatccacagtggcggcgaaacgtcgctgatcgaccactttgaccagctcgtcgggaatggattgcgtgccaagacccggcgcgatggaatccaagccaagtcctggaatcggcgtctgcggcacgcgcggcgcggtacgggaagcgtgctggggttcgtgcgcaggagccgaggaaatcgacatggagcgcgcaaggtaattcgcagcggcaagaatcggaagatcctcgtcgccgaacagcagacgcacgcgcggctcatcgccaagctgcagacggtaggaagcgaaatcctgcccttctgacttggaggaatattccggctgccttgattcgatggcgatgcccatggcggcgagcttggcgcggtcacgctgaaattgcttggcgaaggcggccttcgccgcttgatcggcgagctctccgtacgaatcggcatacgccttcacacgttgcgcgatctgacgtgaggtaagccattgcggaaaggctgaggagagcacagccaacacatcaagctcatgcttgccccatttgtcggaaaaacgtcgcctaccgttacttccctcagccattagtcctcacgtctcgttaacgtttctttttaagtgcttggcctcgtaagccgcacacaacattctatgatagaggttttttaagcgatttgtgcctatttcacgaaaaaacatcgttttcgtgttgcatggccgtccaaaatcagacccaatcgtccggttccacgccctgcgggccgacatattcgccattcggcacatagcttggttcgccttgatcctccagtcgcgcgtcgctaaacagcatcacatccctgccgaaggtccaatcgccatcgatattaacggatttcgccgcggcgagcgaaggcacaccgtatgggaaacgggcatcgaaatcgtggatgttcttgtaatagcgcgcgtccaaatggacgtcggggaagatgtagttgccgtcttccatctcgtactggtccgtcagatggaatcggtcggaccgcatgatgaacaaatcgtcagtggtcttcaccggcaggaaacgcatacggtcgacgcatacgcaggtcgcgccatcgaaaagcgacaccgcggctcccatggcggtctccagctgaatgaccggctcgctggtcggatcggtcgggtcgaccgtcttcttattgcggattaccggaaggggaagcacgccgtcataggatgcgagtttcgctttcagcgcatcgatacgcacccaaatgctgttcgtgttgaagtacggatgcttatcgatgttctgcgcgtcgtccttgtcgtctggatggacctggctcatctcacgcagcatcagacggcccgtggccttgtctcgcacgatgtggccgcccttacgatcggctggggtgcgtttggcgacctcgatcatgaacggtgcgcccgtattctcgaaatgctgcgcaagcgtacgggagggacgcgcgcccaggttgtcggaattggagatgaaaaggtatttgaacccctgcgcctcaagcgcgtcaagcagaccggattcccaaatggtggagaacaggtcgccgtggcccggcgggcaccattcgagttccggattggccgggaagctgacgggcattcccgtttccgcgctgatcttcggctcctgatgctggatgatttccatcgggatgtcttcctgatggaatttcttattggtctgcagcaccttcatggtgtctttggaggtacggaaggagttcatcagagtcaatggcagatcgacgccaagtctggtccgcgcggtcaacacctgtccgatgatgatgtcgatgaaacgcatctgccgtgccttgtggcgacgtaccggcagcagcgacttggcgcaatcgagtcccatcgaagtgccaagaccgccgttaagcttcaggaacgccgttttggcgaacgcgtcaacggccttgtcgtgattgatggtctcatacacgtcatggaagctgggaacactgacgagcggttcgacctcgtcctcacgaatccaactgctggcctcctcattgcgccagacctcgtacagacgacggaactgggcgatggccatgtcggtcattccgtgcttccgcatcttcgcggcagagtattcgaatacgtcctcagtcaatgtctctccctttcgaacgggcgttgttattcgatgcgcttatgccataatacgacattccgccaaaatcgggggcatttagacacagaaccaacatgaacttccggtggagcaattgccggaaaaccctcaaatatccgaagccaaactctccggaatggatgcgactcgctttccgacacgatgtgtttgaaaaaccgtagagattatgctatgcttcatattcggtgcttttcgcaccgttcggaccatagcgcagtttggtagcgcacttgactgggggtcaaggggtcgcgggttcaaatcccgctggtccgaccaagaaagcccgtcgttccgccgttttccacggcatcggaatggcggggttttcgttatgtttgggcaggtttgggcagtgaactgcggcatacagcccctcagaatggcatctatcggagccggaagccggacgtcaggacggtcttgagcgcatgcaaatatgtagcctgcgatatttttcatgtttcttgccgtttaatgcgattaacgcatgggttcagagaggtgattcggtttgcagcagaacgacacgcagccacagttcgatgacgtcgacgaattcgcccatgtgttcgattcaacgcttcccgaagatgaatggaagattcgattgccccgcgagcttggcttggaagcccgcgaacgcgctcggcatgatggcatcacgcttaccgaattgacccgcagggcactcttgtccgacgattccgatggctgttcagacgcggtcggcatcgggcgcatgccaaagaacagcgacgggcgcaaacagcttggcgacgaatggaagatcaaactcccctacgccgtaggccataaggcgcgggccaaggccaagcaggacggcatttcattaagctcgctcgcgcgcagagccataacggggtatctcagaacacgcaaccaggatgaacatcctctgttctgacgctgtcggcctaagctgtgcgtaaaggaaaacaaaagccggcaacgacccagattcaataaggcagatgggcgtgcgccatggtctaaaccaggcgcacgcccatcttctaacagttccggtggttacttgcgtttcttcttctcacggacattcaccgaaatctgaatcggcgatccttcgaagccgaattcctcgcgcagacaccgttcgatgtagcggcgatagccatgctccaagaagccggtggcgaagatcacgaagcgcggcggtctggtggacgcctgcgtcgcaaacaggattcgcggctgcttgccgccacgcagcggatgcgggtgggcagcttggatcttgccaaggaacgcgttgagtttgccggtggggatgcgcttgtcccatgatgccaaggcgccacgcatggcattggccaaacgattggtgtgccatccggtctttgccgacagattgacgcgctgagcccaagtgacgcgattgaactcggtcttccacaggcgttccatacgctgacggtcgaactcgtccatcaggtcccacttgttgaacacaagcacgatgcaacggcccgcgtccacggcctggctcatgaccttcaggtcttggtcggaaatcggctgggaggcatcgaacagcaccaaggcaagctcggaacgttcgatcgcggcctgcgtacgcaacgaggagaagtattccgcgccggacagcttgtgcagacgacgtttgatacctgcggtatcaatgaacagccaatcctcgccatcgacggtgacgacctcatcgaccggatctcgcgtggtgcccgcaagatcgttgacgacggtgcgttcctcgtgggccagctgattgagcagggaggatttgccgacgttcggacgtccgaccagagccacgcggcgcagatgcgacggcgtaaggaagccggatgtcctttccgctttctccaacgagtcgagtgcggcgtcaagcagttcaccgatgccacgaccatgcatggcggaaatgccatacggctcccccagacccatcttccagaattcggcggtcaggtattcgctttcgcgatcatcgaccttgttcaccgcaagcgtcaccggcttgccggcggcacggagcattttgacgatgcgttcgtccgtgtcggtgaggccaaccagaccgtccaccacgagaatcacggcatcggcaagctgcacggcgatttgcgcttgggatgcgatggcggattcgatgccttccacgtcggcttcccagccgcccgtgtcgaccagtttgaaatcggtgccgcaccattcggcgtcgtagctcacacggtcgcgagtcacgccgggggtgtcctccaccacggctgcgcgacggccgagaatacggttcaccagagtggatttgccgacgttcggacgtccgaccacggcaagtacgccgaccggtttcggaccattcttgctttcgccaccagagaacaccgttccatcgatcagctcctcatcgccttcatccagctcatagccttcgaggttggaaacgtactggcggtattcctgttcctcgatggcgtcgtcaacgatacggacgagcacgtcaagggtctcgccgaagttgagatcggagttgtcgacggtcaacacgccttccgcggcggatgtgaagttggtgactttcgaatcggccttgtcgcgtgccgcgacattctccgcacccacacctgagacggcctgtccgctacgtcgggcctgacggacctcttcacgcgcggtaagcaggatgcgcacttcggcgtcgggagcgacgacggtggtgatatcacggccctcagcaacaataccggcgccttcggagaaggaatcgaccgaagcctctcgtgcgatgtaggcacgttgcgcggcgatcaacacgtgacgcacggggatgatgttggacaccttggacacgtgcgaagagacctcggaagaacggatggcctcgctgatgtcctcgccatcggcgtacaccttcggatcatccggatcgacgctgatgtcgaaatggccgtcggtgaagaattcgccgacggtttcggtgacgagctgctcatcgatggtttcggcatccaaatcgatgcctttgtgcatgcaccaccaggcgcaggcacggtacatcgcgcctgtgtcgaggtatgcgaaaccataatatttggccagtgccttggacgtggatgatttgccgacgcccgcaggcccatcaatagctacacggatcacagtcccaccgccttggatagagaacggacctcagcctgcgacaacacgcgatacgtgccgcttttcaggtcgccgagtttgatcggaccgatctgcgtgcgtaccagacgcttgacgggaaaaccgatcgagccgaaaatacggcgcacgatgcggttcttgcccgaatgcagcacgaccttgaccaacgtgctttcgcggctggagtcgagaatagcgcagcggtcgagtttgatccacccatcgtcgagcttcacgcccgtggtgacgagcctgcggcacacctgaccgctgatgcgtccttccagcgtggcgatgtaggtcttttcgacctcatatttggggtgcatgacgtgctggctcagttcgccgtcgttcgtcatgaggattaggccttccgaatcataatccagacggcccatgtggaaaatacgctcgtacttgtctccgacgatgtcgcgcaaagtgtagcgtcccttgggatcctccatggcgctcagcacgcgtttcggcttgttcaacgcaagcgtgacatggttagggttcacacgcacgcgagaaccgtcgacacggacctcctgacgtttcggatcgactcgggtgccaagttcggtaatcagctcgccatcgatctcaacgcgaccatcggtgatgatttcctcgcatttacggcgcgagccgaagcccgcctgagcgagaagtttctgcaggcgaatgccttcattgtcatgattgtgcgccttggcggcgcgagaatatgcgtttggcatcgttctcccaacgtggccggataatacttacagggactgctggtagtatggcagtcgtttggcggctttcataaaaaccgcaacttgtccactatatgacagaggaaagactatgactgctgttgaagcaacgtccgtaacagaggaagaacagagcaagccactggcccttcgcataggcgcggagctggtgggaagcttcatcatctgcttcgccatctactcgatttgcacgcttggttccgcgatctacggcgtgaatatggcgttcatcgccttgctgacaggtttggtgtacgccgccgccaccctgatattcggcacgatttccggcgcccagttcaatccggcggtctccgttgcggcgatgctgtccggcaaaacccatgtgcttgacggagtgctctatattatcgttcaggtgctgggtggtatcggcgcaggcgccgccatccgcttcctgctgccgacatccgagcaggtaacgctgaaaatctggctgacgccggtcattaacggttttgacaagaattccgtctcctatgccacgctcggcaactatggcgtgtccttcagcatcactctggccatcgccgttgaactcgtcgcgggcatcatcatcgtcgccaccgcgctcaacaccaccagtgaatccggaaagaccaataccagccatgccatcgccatgggtctcgcctacggtgtcggcgccgcaatctcctatccggtaacaggcgcagctctgaatccggctcgtgccactggcatcgccatcttcgcccagaatcagggcctttcccaagagcctctgcagcagctgtgggtgttctggatctgcccgattctcgcagccgccatcgtctcgcttgtggccatagtcgcgtccatgatcggcaccaagaaaaacgtttcggaagccgagcaggattccgaaacgctggaggccatagccgacgacgcgtcagacgatgccgacgggcacgagggcgagcaggatgaacagtccgacgcccagaccgatgccgatgaaagcgtcgaagccaactgaacggactttccaaggactacgctcgcgcattacgagtctgattagtcctgttatgatggccgtcaccgcgattaccatggtggcggcttttacatggcctaagaccgcaagcactgtggctataaccaccattgccgcaacgatccattcaaaccacggcttgccttcatggtcttcggaaacgtagggatgactcatatcgcaggcctttcgttatatgtcaacgcgcgtccgcgcacggaacccaatcataataataaaacgtggcgtccgaaaccagcgaatggtttcggacgccacgtcatttatcgcgccgcaacgctcccagcttgccggtcgacgcttccactgaactcagtggaagaagtgtcgggtaccggtcacatacatggtgacgccggccttgcgggccgcctcgaacacttcctcatcacgaatggacccaccaggctggacgatggccttgacaccggcgttgatcagaatctcggcaccgtcggcgaacgggaagaacgcgtcggacgcggccaccgctcccttggtgcggttggctccgtcagccagcgtgttggcacgctcgacggacagattggcggaatccacacgattgacctggcccatgccgatgcctacggttgcctgatcgtgggcgataagtatggcgttggatttgacgcaccggatggcacgccatgcgaacaccagatccctgacggtttcagcgtcggccggctcgccggaaaccagcttccacgcgttcggatcgtctcctgaagcgtcaatcagatcggtggactgcacgagcagaccgccgtcaatctgacggaactgggtcttggtcttcggaggctcagacaccttcaggatacgcaggttcttcttcttggtctggagcagttcaagcgcatcggcgtcgtaatcgggcgcgacgatgacttcggtgaagattggacgaacactttcggccatttccatggtgaccttgctgttcgcagcaatcacaccgccataggcgctcatcggatcgcatgcgtgcgccttcttgtgcgcctctgccacggtagcgccgatggccagaccgcatggattgttgtgcttgaccactgcgacggcgatctgaggcgcgaaatcccacacggcacgccatgcggcgtcggcatcgacgtaattgttgtagctcatcggcttaccgccaagctgttcggcgtgtgcgaagccgttctggttgagcggatccagatacagcgaagcctgctggtgagggttctcgccgtaacgcagcacgtgcgcgcggtcccacgtacgggtgaacgtggctgggaacttggcctcattcacttcggtctcgccttcggaaaccggctgttcgatggacgccggcttcggccaatgcttcgcggtccactcgttgatggtggcgtcgtaggcggccgtatgggcgaacgcctttcctgcgagccagcgacgctcatcaagggagaagccctcgccgttctcgatgcgggaggcgacgagtgcataatcgttcggatcggtgatgatggcgacggtggcgctgttcttggctgcgccacgcaccatggacggaccgccgatatcgatcttttcgatggtggcggcttcgtcagctccggagcggaccgtgtcggcgaacggatacagattgacgaccaccagatcgaacggcttgatgccaaacttctcgagctgggaggcatggtcggggttggtcatgtcggcgaggataccggcatggatatgcgggtcaagggtcttgacgcggccatcaaggcattccgggaaaccagtgacttcggagacctcggtcactttgacacccagctcagccagacgcttcgcggtggaaccggtggaaaccacctcggtgcccgccttgatgaacgcttcggcaagcacctcgatgccttccttatggaagactgataccagagcccgtcgtatcggtcgattcgttgttgtcaccctgatcctccttgttattgttgttcgaggcgaccgtgcgaagcgcacgtgtttcctcacggctgttttccgtggattcgggagcggtctccctctttccacgttcgcgtatacgcttcatcatccagcgtatggcgaaaaatatgctcacggccaccaaagtcagcagccatgcggagaacaaacccatggcggtgggttgtcccaccttacgggttgacgcgatcacgtctacgccgacgtgcgcaagatgtttcgatcccaagcctccgtttcccaaggcgaacagcaagctggaagccacggacacgacggcgctggtaatcgaaaaagcagcaatcggataggcaaaactcagcacaacgcgtttgacgtcgatgttccgtcctgattcacctactctgatatggaatcccttattaaacaacatgacgaccatgccggtagcaaaagcggatgccaatggtatgcacatcagcgcgattctcacccaatccgtctcaaccgcctgtggcatcataccgaaaagcggcaaggcggggagcccgtcgccctgcccggtccataatgtgaattcggctaaatcgccgattgagaagccggcgccgaaagtccatgagacagcccaaatcatcagattcggaagccatgcgagcatactgatcgtggtaagaatacgagacccgttctgcatgcccgaaagttcatatagcttcgctatcgatgattgattgcttattgcccaaaaaacaacgacgatcagaccgaccagcagatacgccgcctccagcagcagccctaggacggaaccgatgaccatggtctttcgcaccggcgatgacacatgagatcgaatccattcggtacaggcttgggtccatgacgcattcggaatcgccgcgaccgcatatccgaggatgaaaacaagcgccgttttgatggcgatcatcgtcatcgaatcaacgatttcgatatttatgcttctggcgaagaagatgtttacggcttcccaaaagaccagaccggccgcgaatccacgcagactcgtgccgaatcttctggcgagctgcgcgataagggcgataagcagtaccgtcaagagcaacggcacaatcgtcaacgtgatgacatcagtcttgaacccgataccttggctgagcagcaccaacgcctcggtaagaggcaccgagaaggcggagagattgcccccgccttcttccatggatatgaccagaagcattagggccatatagcagcccaaggcaacggcgtaaataatcatggacgctgccgcgacggcaagccctttcagccaatacttcaggttcgtcatcatagcgattgggaagcgagcacctctcgcatgatttcagcggtctgtccgggagtacgaccgacacggatgccaacggcctcaagggcttctttcttatcctgcgcggtgcccttgccgccggaaacgatggcgccggcatggcccatctgcttgccttccggcgcggtgaatcccgcgatgtaggccacgacgggcttggtcatatgttcggaagcccacttggcagcgtcctgttcggcgctgccaccgatttcgccgatcatgacaacggctttggtggcttcatcgttctcaaaggcttccaaagcctcctgcaaggtcgtgccgacgatcggatcgccgcccgcgccaaggcatgcggtgaaaccgatgtcagacagctcccccatcagctgataggtcaacgttccggacttggacaccaaacccaacgggccgcgggacacgatgccatctggaataatgccgaggttgcagcccttggcgtccttagaagatggcagcgtcaacagaccaggacaattcggcccaacgatgcgcacgcccttacgcaaggccaactcgacgaaatacgcgctgtccgccaccggaatgccttcggtgatgacgacaatcagttcgatgccggcttcaatggcctcaacgacggcgtccttggcgaagcgcggcggcacgaacacgacgcttgctttggctccagtggcttcgatggcttcagagcagttggcgaacacgtgaatggtggcgtcctcgccatttttggcttcagggaaggtgacgtccagcccagccttgcgggcgttcacgccaccgacgatgttggtgccggccttgagcatgcgggccgtgtgggtcataccctgatgcccggtcatgccctggacgatgaccggagcgccatcttcaatgaaaagcgtcatttcagcgaacctccttggccgcgaaacgtgcggcctgctgtgcggcttcctccatggtctgagcgacgtgcaggttggcgcggccggcttgggccaaaatgttcagaccttccgccgccgcattgccatcgaatcgcacgacgataggcttgctgctgccaagttcgtcaagcgcctcgagaatgcccttcgcgacctgttcacacgaggtgatgccaccgtacacattgatgagcacggattcgacctgcgggtcggacagcacgatttcaagactattcgacatcacttcggcggaagcgcctccgccgatgtcgaggaagtttgcgggcttgacattcgtgccctgatcctcgcctgcacctgacaccgcgtcaagagagctcatgacgagtcccgcaccattgccgatcacaccgacggaacccttgagatgcacataatgcagtccatgttcgcgggctttttgctcatatggatcgacatgaatcggatcggtgaaacgtttccaaccatcatggcggaacgatgcattgtcatcaagggagatcttggcgtccagcgcgcacaacgacttggaagattcgtcatccggatcgccgatttttgcaagcgggttgatttccacaagcgtggcgtcgttctccttgaagcaatgccacattttcagcagaatctgcgcggcctgatcaacatcggcatgatagaagccgatgctttcagccatcttggtggccgcttccaaatcgaaatcgtcaagagcatcgatatgcagacgcttcacggattccggatgctctttggcgatttcctcaacctcagtaccgccattcgcagtggcgagcacgtcgaaatcacgagaggatcggtccactgagatggagacgtaatactcgtgaaggatgttcttcgcctcggccaccagcacgccgctgaccttgtgcttgtgaatggtcatcggcagaatgtcttccgacgcgagaatggactcgtcacgggtcttggcgagcttgactccgccggcctggccacggtgtccaatcttcacctgcgccttaatcacattgggatatccaatctggtcggccgcttcggcgacttcatgggagttctgggcgaatattgccttaggagtcgggataccctgttcttcgagcaattccctggcttgatactcatagagatccatggatcattccctttggttgtttgttctgaatggttgacgaaaacggagttatcaggcaggcatgcacaccagcgagcttgtcggataatcgcctagcgatttcatgccgtcaataccggtaagttccatgacgaagctgaatccagcaacgacgcctccgcacttctcgatgaggctacgcgctgcattggcggttccaccggtggcgatcagatcgtcgacgatcaatacgcgcactccctcatggacaacgttggtttcgatttccattgacgcctgaccatattcgaggtcatagctttgcgacatggtttctggaggcaatttgccggctttacggaccgcgataaacccctttccgagacgggcggccaacgctggaccgaacaggaatccacgagcttcaaggccggcgaccatgtcgaaatcatcgacgtctactggcaatgccgcttcaagggcccccatcaaaataccgaacgcgcgcgcatcagccaacaccggcatgaaatcgcggaataggatgccctccttcggaaagcccggaatagtacgtattttcgatacaagatatgctgcgtcttcggctccaactttgttcaagcccgaaacggtgatatccgatgctgccatgacagtggtttccttctaccttggtttacggcactttgaattataggtttcccgtgcgaaaaagaacggcgaaaacctcaaaaatgaaattttcgccgtctaaaaatcaaagaaatcaattgttcttctgctcgtcaatgggctgctgaataacatcggcatcctgtgcgggctcttcagtcgcgtcgacgataggcttctggtcgggctcgtcttccttggatagcggattgccgttctcatcgacctcatcatcatgcacgtatgccggacggacatattcacggctgatggcgttgaagccgaaacgcagttgcgatccttcggaatcaacgacgatctcctcgtattccgtatcgacggaaacgaccttgccgatgatgccaccgatggtgatcacttcagtgccgggctgcagactagaacggaaatcctgacgttcagcttgctgctgcttggctttcttggactgccagaacatcatgccgaacattacaacgataagaacaacgagaaaaaggatatccaaaataaactcctcggagtcagggtctcaaccggaacacattactcaagatgtgaagtctatgacatcttattgacatcatatgcggattcgtcgggagtgataccaagatgctcccatgccttgcgcgtggccacgcggcctttcggcgtgcggatgaggaagccctcacgtaccagatacggttcgcataccgtttccaccgtttccgattcctcgcccaccatggccgccagattgttcaagccgacggggcctccgttgaaattggtgacgatggccttaagcactgctatatccagacggtcaagaccttcggtatcgatctgataaagcgccaacgcctccttgacatcatcgggacgcaccgattcgagatcgtgcacgatggcccaatccctaacacgacgaagcaggcggttggcaattctcggcgtaccgcgggaacgcatggccagttggcgagcggccccgtcctccaactggattcccaacactgcggaggaacgctcaatcagcttttcaagctcctcatgcgggtagaaatccagatgcgccgtgaaaccgaaccgcgcacgcagcggcgagggaagcatgccctctcgcgtggtggcaccgataaccgtaaaccgaggcaatgtcagcggaatggatgaagctccagggcctttgccgaccatcacatcaacacggaaatcctccatggcgatgtacagcagttcctcggcggcacggggcagacggtggatctcatcgataaagagcacctcgccggcgtccagcgaactcagaatcgaagccaaatcaccagcatgttggatggcgggaccggaagtgacgcggattggaacttccaattcattggccacaatcatggccaaagtggttttgccaagtcccggaggccccgcaagcaggatatggtccggaggaacgtcacgttttcgagcagcatcgaggaaaagctgcaactgcgctttgagtcttggctgtccgatgaatcccttgaggatatgaggacgaagctcctcgtcgctgaccggttcgttgccgacgggtgcggcggaaaccatacggagggattcctcattcgccccggtgttcggctgttcgaatgtatcagtgttcgtcataatggtccgtttcatctacctctatccaacgatgtcagcgcgagcttcagcacgcgtggaacatcctcggcgttcaacggcgtctcgatttgattatcggcgcagaccgtctgcaccgcatggacagcgtcctgctggtgccatcccaaagacatcagaccttcgacgacctgttcggccccagtgtcttcaggagtcgaagcggttgcggaagaaccctcgatctggctcagatcaatggaacctttcagttcgaggatgattttctgcgcgcctttcttgcctaatcccggagccttggccaacgcagtggcatcaccatccgccacagccctcgcaagtcgatcgggaggcaaagtggacagcaacgatagcgcgactttcggtccgatgccactgaccttctgcaattgcaggaacatgcgtttcgaggccagcgtgccgaagccgaataaagtgatggcgtcctgggacacattcaacgaagtgtagaccttgatttcctggccggcgtgcatggaagccaagtcggcggatggcatcctgacctcgtagccgactcccccgacctcgataatggccgatacggcgtctaccgactccacatggccacgtagcatgccaatcattatggacgtctccttcgcacaggtctagaacatctgttcgatacagcttacatgcctctgcggacgccttgtctgcgcgctgctttttgcgaagcctgcgcccactgtcgttgcgccgccgtgagatgctgttcgcgttcgccgccttgcagcgcaccagccggacgcaacgcgtgacagatcgcaatagccagcgcgtcagccgcatcagccggctttggcagcgtgttcaagcccaatatccgcgccaccatacgttccatctggattttctctgctttgccgttgccggtgattgcaagctttgattccgtcggcgtatgcaacgctacaggaatgccgcgttgcgccgcagcgagcatcgccaaccctgccgcctgtgcggttcccagcaccgtgttacggttttcttgcgcaaacactcgttcgatggacaccgcatcgggagtaaatcgttcgattttttccaccaagccgttgtagatggccagcagacgcagatcctgggaggtttttggatcggaacgcaccacatccacgtggataaaagaaagccggcggtatgcgccggcttcaatcacgccgaccccgcagcgagtcagcccggggtcgacgccaagaataatcacgctggattactcctcgtcaagctgggccatgacctcgtcggaggcggtccagttggagtagatgttctggacatcgtccagatcatcgaggttgtcgatgagcttggagaccttctgggcatcctcaaggctcagctcgacctcgttcttcggcatcatgaccagatcagcggaatcgtaatcgaaaccggcgtcctggagagccttgcgcacgtcgatcatgtcggacggatcggtgatgacggtgaatacctcaccatcgtcggtcacgtcttcggcaccggcttcggcggccttctcgaacaggttgtcgaagtcaacgccttcggccggaacaacgatctgtcccttgcgttcgaagttgaagctcacggaaccagtggtggccagggagccattgcccttggtcagggtggaacgcacgtcggcggccgcacggttgcggttgtcggtgaggcattcgatgatcaggccaacacctgccggggcgtaaccctcgtacacgatgtcttcatagttggcgccgccggcttcctcaccggaaccacgcttgacggcgcgcttgatgttgtcggccggcatggaggccttcttggccttgtagatggcgtcatacagggacgggttgccgtcgggatcgccgccacccatacgtgctgcgatctcgatgttcttgatcagcttggcgaacagcttgccgcgcttcgcgtcgatggcggccttcttgtgcttggtggtcgcccacttggaatgacctgacataatgctcctaggcaggttgcggatgtttcaaacgaaatgattctaaagcggttcgccgacaaaatgccgaatacgaacctgtggcatttcgcttttcgaacttttggatggggtctgcccccggctgtgactaccgccgatatgttttctcccctatgaccatttggcgcttggcttcgaagatgcgttggaatacggtgactaatcccaatccggccaacagtatcatggcgatggcgagccacaatccctgacgcgtcaatccggtgatggccatgcccaccagaatgatggtcaagcgatcggcacgagtggcgatgccgtttttcacctcatagccgactgattcggcacgagcacgggcatatgaagtgacgaacgatgtcatcacggccaccgcggcggcggcgataccgatcatgctcgtatagtcaggcgtgttgtcgatggccgtatgccaccagtcacgatgcataagaaagaagatgatcacgcctacgagcatcgcccaatcagcgatgcgatcgagcgtggagtcgagaaaagccccgaattcggtcccacccgtggtaagcgcggcgatcgagccatccaacgaatcggcaagcacaagcagagtcagaacaaccgctcccccaaatagccatccggtcacaccggtggcgatggccacgacgatggtgccgacagcaccaatcaccgtcaccgcattggcggtcagtcctatggcgatcaacgctttggctattggctcgatgagttttttgaacggcgcacgaagatgctcaagcatgtgttacttccttctcgatgagaaaatgagaaacggcgcacaaacctcttgtcgagattcgtgcgccgtttcacggttcatggtcgcgtgcgacttgttgccaccggtctcgctcagtcggcgagggcggccttgaagtcgtctgcggtgttgacctggacgcgcttcttgattacggtcagaatgttcgccttcgcctcatcgaccggcacgccgttcaactggctgccgtcgcggaagcggaagctgaccgcgttgttgttcatatcctcttcgccgacgatgaggatgaacggcgccttggacttggatgcgttgcggatcttcttgccgaagcgatcgtcggacaggtcgatctcgcaacggacggtctcctcttccaagctggcgatgaacttctgcaggtgcggggcgaactcgtccgcgaccggcacgccaagcacctggaccggggcgagccacgccgggaaggcgcccgcgtaatgctcaagcagcaccgcgaagaagcgttcgatggagccgaacagcgcgcggtggatcatcaccggacgctggtgcgtgccatcggcggcgatgtattcgagcttgaaacgttccggaaggttgaagtcgagctggatggtggacacctgccaggtacgtccgatggcgtcacgggcctgcacggagatcttcggaccgtagaaggctgcgccgcacggatcgtcgaccaagtccaaaccggattccttggcgacctcggccagcgtgttggtggcttcctcccaaatctcgtcggaaccgacgtacttgtgcggatccttggtggacagctccagatagaagtcatccagaccgaagtccttcaacaggccgagcacgaaggtaagcaggctcttaagctcgtccttcatctgctcgcgggtgcagtagatgtgggaatcatcctgagtcaagccgcgcacgcgggtcaggccatgcacttcgccggacttctcataacggtacacggtgccgaattcgaacaggcgcagcggcagctcacggtaggaacgctggcgggacttgaagatcaggttgtgcatcgggcagttcatcggcttcaggtagtaatcgaagccttgcttgatgacgttgccgttctcgtccttctcctcgtccagacgcatcggcggatacatgctgtccttgtaccactgcaggtggccggaggtctcatacaggccgcccttggtgatgtgcggggtttgcacgaagctgtagtggtgcttgcggtgcatctcacgggagtagtcctccatggcgttgatgacggccgcgcccttcggatggaagacggcaaggcccggaccgatctcatccgggaaggagaacaggtccatttccgcgccgagcttgcggtggtcgcgcttggcggcctcctccagacgggtctggtatgccttcaggtcctccttggtggcgaaggcggcgccgtaaatgcgctgcagcatcggattggcctcgctgccgcgccagtatgcggcggcggaacgctcgatcttgaacgccttgatgtaacgggtgttcggcaggtgcggaccacggcacaggtccttccaaaccacattgccttcacggtcgacgttatcgtagaagctcagttccttgccgctgatttcggtggcggcttccgggtcaagatgcgcttccttatccttgataagttcaagcttgtagggctggtcggcttcctcggcaagagcctcttcctcggtcaccacgcggcggcggaaggactgggaggacttgataatgcgctgcatgcgcttttcgatttccttgaggtcctccggagtgaaaggagtctcgacatcgaaatcgtagtagaagccgtctttgatgaccggtccaacaccaagcttggcgtcagggcgaatctcctgcacggcctgggccatgacatgggttgcggaatggcgcatgatggccacaccgtcctcgctatcgagcgcgatgggttccacaacgtcgccgtcgtgcagctcggtatagagatcgcggggttcgccgttcaaacgcaccgcgatgatgttcttgtcgtcggagaagagctggacgccggtctggtctgccgccacctccttcttttcgccgttgagtgtgatggagatggtctgttcagccatgagttgtcctttgctatcggggtccgcgttaccaatgtgcaggcctggactatatatcaacgatgaacaagatagggtcaagcgcagacaacggcacgccatttcggtgaacggaagaacaacgctgattgaatgtcgcgaaaggaaaggtcctttactgtttactgtccgatgacgtgcgcatatgtatactgcggagcctgacgtgtggacttgatcatcactttgtcagaggggctgaccgataccgtagcgccatacttcactttgagccgcgacccgacgccaccggccagattaaccgcgttctgcagattgtcgctgtcgccgatcgcgcgaatggtgaatggggatttcagtttggtgccatcgcagacgagactgccggccgtgccactgatgtaagtgctggttaccacgcggacattgttgatctcaatgacctcggcaccactgttgcgcaattcctcaagcaacgtgaacaatatcgcggagtcaatcttctgtttggaaccctgcgatatgcggatgaccacgccttctcccgtagccgcgagacggccggataggatgccgttggtctgcgcgttctgcttggcgatttccgcggctttctcatttttgtccgcggtgtctttcaaagcgttcagctggctggagagttcgttcttacgctgttcgagcttttggacctgagcattggtctcgctgatgagcttggtcaattcatcttcgctcatcgtctcataggtggatgtcgtgttgtttatctggatcacatagccgaagccaagcaaggcgcacaatatcgtgaccagaatgctggaatacagtcgggttcgtgtgaccttcgcatcaagtgagattcgcttcttggccttgaccatggggaacgcaccggtttgggtgctgtcattgttctggtccttgaccctctgctcatggattctggacagcatgtccttgctgttcgcgtcttgtccgctcataccgcatcaacctttaaagatgaagcgtcgaatggaggacacattggtaaagattcgtatgccgagcactacgatcactgcggtctgcagctgggagccgactcccaactggttgccgaggaacaccagcagcgttgcggtgatgacattcgagaagaaggagatcacgaacactttatcggaaaagctgcgttggaaatacgcgcgtgcggcgcctagcaacgcatccaacgcggccaataccataatcggcagatacggttggagctcgatggggatgtccggacgaacgaatacaccgattaccacgccgatgataagtcccaagacagctgccattacttgtccttcctcacatgcgtcgtgtcgccagccactgcagcatcaagtgtaatcgatttgcttttgcttatctgcggatagatgccggcctttttgaaatcgtcatacagttgtttctgcgttgtcttgcttaccgatttcgccaaggtcgcctgattgcctatcgcctcgattcgatatgggctttgcaccgaattgactccgatgagaatcgtcgatccggcggttcgaatcgaggtttgcacgccaaggcggttgccgttgatcgcgatcgcctccgctccggattgccatagcaaggagacaagcagctgcaaatcggaatcggtgacgactcgaacctggctgccattttctcttggcagtgaggagtcggcattgtcgccgctgacggaaagcgggttggctacggtcaggacaatgccttccccttgcaccggaagcgttccattgaccatttcatcatcctgcatcgtctggtttagggaccagcttgccaaggattccgattcagattcgatttgcgaccgcaagtcgttgacatccttggtgaggtcgccgacccgcttcgtttgttcggtcagctggcttgccaactgcttgcgtacttctttgcgtgggtcagtgctcagctggcgcacgaaaacgcttcccgcggcacccacagcgatgcagatgaggaacaccagaatcctggtggcccaaatcgaaaccgccgaacgttttttagtggccaggcgggagtccgaatacaggacgtccatcggacgattggtcaaatcgtcaataagccgaagcgaatcgtcatcgacatgtctatggcgttgcggcatggcgggcatggaggccggttgcacatgatgggatgacaggccggcgaaggatgacgaaaaaatggcacgatgctttgtgggtacgttctccggggaaacggggaacgacgcgaaacgtggagcatcggacttcatatatgcgtcaatccttgctgtttgtatcgttcttcaacagttggatgccttggcgcatgtagatgtaccctgcaagccaatacagtccaacgccccagattccggtggcaagaccgcatagatgcagtgtatccgcagcggagttggaccagatgtcggcgaagatcaacgcgacgatggcgataagcagcatcgcggtaccggccttgcctacgaaatgaacaggcaatgggccataatcgtgctgcgccaaaaccagtatcagaacagccatgatcaaatctcgcagaccgacgacgatcagcatccaccatggaatgatgttcgccacacccaaagcaagaatgctgcagaagatcagcagacgatcggcaatcggatcgagaatttgcccgattttgctcacctgattgaatgatctggcgatcagtccgtccaaaccatcggatatcgccgatagcgcaagcacgaccaaggcggtcaccatcctgtgatgagagaccagcatcgcgataaaaggaatcgaaatgattctcagcaggctgatgaagttcggaaccgtgaaatagatgtctcgcggttccggactgtattgcttcttaataatcagtttgctcatattacgagctacactacattctcgaagcctgcaacgcggtgactattatgccacgggcaccaacttcatacaactggtccataagctggttcaccttcgccttcggaaccaccacacgcacagccgcccactgcttatcatgcagaggcgaaatcgtcgggctttcgaaacccggagtgatatccactgcggcggacaccttctcgaccggaatgtcgtagtccataagcacattacgctgggcagtgagcacgccttgcagacgcctgctcagaatcgtcagacgctcgtcatccgcctcaagacgaggggaacgaatcaatacggcttcagagtgcatcagcggttcagcgaaaatgcgcagtcccgcattacgcagagtggtccctgtggaaaccacatcggcgatcagatcggcgacgccaagctggacggacgattcgacggcgccgtcaaggtgcacggtttccgcgttgatgccatgctcgaccagatagtcgtgtacgagcttgtcgaatgtggtggcgactcgcttgccttcaatatcctcaagcttggtaatcggcgaatcgttcggggctgcgaaacggaacgtggaggctccgaagccaagctgcatatgctcctccgcatcggtgccggagttcacgagcaaatcatgcccggtgattccaacgtcgatggtgccgcgaccgacatagaccgcaatgtcgaggggacgcaggtagaacaactcaacatcattgtcgggatcctccacgaccaactggcgagggttgctcctcaaacggtagccggcttccgccagcatgttccaggcgggttcggacagcatgcccttattaggcacagcgattcttagcatgtttctcctctaaaaaaggccacaccttcaactggcatggccccgggtttctcacaggttcttgtagatgtcctcgagtgtgatgccacgatcgatcatcatgacctgcagatggtagatgagctggctcatttcttcggccgtacgatcagcaccctcatattcggcggcgatccaggtctctccagcctcttcgacaatcttcttgccgatgaagtgcgtgcctttggcaagctcatcgacggtcagggaaccggcctgcttggtggcggctttctcgctcaattccgcgaacagcgattcaaaagtcttcatagtcgtatgcttccttgtatggtgggcgttcacgccttgaaggctgcttcggccttctcgcggatggagtcgatagcctcggccggattctcggcaccgtacacggcggaaccggcgaccagcacatcggcaccggcttcggcaacgatatgggcggtcttggggctcacgccaccatcgacctggatcttcgtcttcaggccacggcgggtgatttcgtcacgcagacgacggaccttggccatctggttgtcaaggaacttctgaccgccgaagcccggttcgaccgtcatgataagcaccatgtcgaattcgtcaaggatgtcgaagatcggctcgaccggttcggccggacggaccgcgaagcatgccttgcagcccatgtcgcgcagctgacgcgcaagacgaaccggagcatgcgtcgctcccatatggaagctgacggaagccgcaccaagcttggcgtattccggagcccaacggtccggatcctcgatcatcagatgcacgtcgaccggaaggtcagtgacttggcagatgcgagccacaatcggctcacccaacgtcagattcggaacgaaatgatggtccatcacgtccacgtgaacgagatcggcgttggaaatggccttaaggtcacgttccagattgcagaagtcagcggacaggatgctaggtgcgatttgaatagtcatggttctcattctatggaaggtaatcgacttgatgttacttgttgtcggactggtcatcggcatatgagacggatgagccatcgtttgccgtgatttcatccttggttttcgtaaggttggccttcgcggtcgggagaccggtttctccatcctcgacgaggcttagctcaatctcggtgacggtgcgcaacttctcggcaagcagctcggtggactttcccatctgctgaataacgatgaaagccaccacgccaagcacgaacaccgccatggacacccatacgttgatgcgcacgccaaggaactcgtgcgcgaaatcaatgcgcagagcctcgatccaagtgcgtcccgccgtgtaccacatgatgtatatggcgaacaaggacccggccttgagttttttcatgattttggaaccaaggaaaacgatgagcgcagcaccgatgagattccaaatcatctcatacaggaaggtggggtggaacagcgtgcctgtcgggcaggtcgctccgtcatagcattgttcgctgtgaccgatggcgcttccctccatattcaacttcaaaccccaaggcaaggtcgtcggcgcgccgtagagctcttggttgaaccagttgcccagacgtcccacggcctgcgccacgagcaatcctggcgcgacggcgtcaccgagcagagccattggataatgcttgtgacgacaccatgcccaagcggcaagcgctccaagcaggacgccgccccagatgcccagtccgccattccagatgcggaacatctccacccaatcgccggtcggtccgaagaaacgttccggagtggtgatgatgtggtatatacgcgcaccgatgatgccgctcggcaccgcgacaagcgtgatgtcgagaatctgatcgaaattaccgccatatcgtttccaatgaacggttgtcatccataccgccagcacgatgccgagcagaatgcacagcgcgtagaaatggatggtcaccggcccgatggaaaactgcgaaatggtgggtgacggaatgtaagcaagtgtcatagtttcctgatggtagtccacgtatacgatatggtacgtggactaccagtatgttgtctttggactggttcagttgcgggcgttgtggatgccttcggcaagctcctcagtcttctccgccaaggccttgagaccggtggcttcgtcgactgcatgcttgccggattcgtcaagcatggtatgcaccagagccgagcctacgatgacaccgtccgcatacgatccgacacgagccccctgttccgcggtagacacgccgatgcctacgcacacgtttttcgcaccggccttgcgggtacgggcgaccagttccttcggggacgcatcgatggtggagcgttctccggtgacgcccatgcgggcggcagcatagacgaaaccccgcgcattgtccgcaacgactttcagacggtcttcggtggaatccggagataccaggaagatgcggtcgagtccgtgacggtcggaggcttcgatccactcgccggcctcgtccggaatgagatccggggtgatgagaccggctccaccggcgttttcgaaatcacgtgcgaatcgttcgacgccgtaatggaagatgaggttccaatagctcatgaccaatggcactcccccggcgttcgccactgtttccaccgctttgaatacgttggcgattttttcaccattgtcgatggcgatttgcgatgccgcctggatgacgggaccgtccatgacggggtcggaatacggcagcccgatttcgaccgcgttcacgccgtgttcgaccatggtgcggaaagctttgagcgaataatccggatcagggaatccgtatggcagatatccgatgaatgccggcttgtcggcggctttgaattcatcgaacatggtttccgtcgggcttggcttgtggctgatgccgagtggctggccggacggcgtggatgatgttgcgttcgtcatgatggttgctccttttctcactcgccgtccgcgttgttgccttgcgcgccgttggcttccaaggctttggcctgctcgtcggtcaggtatccgaaccatttgccggcggtgttcatgtccttgtctccacggccagagatgttgatgatcatgaccggatgctcataccctttggccttgaggtctgcagctgccttgtacgcgccggccactgcgtgggagctttcgatggcagggatgatgccttcggtttcgcacagatccttgaacgcgctcatggcttcctgatcagtggcccaggaatagttgacgcggccgatatccttgagccatgcatgttcggggccgacggaggcgtaatccaagcctgcggagatggagtacgtgtcaagggtctggccttcggggttttccaacagatagctcttggctccttggaacatgcccagttcaccggtacctggcgcgaatcgaatggcatggcgaccggattcgggcccgttaccgccggcctcgtaaccgtacaggtttactcgttcgtcatcgaggaaggcgttcatgatgccgatggcgttggaaccgccgccgacgcatgcgcagatagcatcgggatggtcgatgccataccaatcctgcagctgctgtttcgcttcctctccgatgatcttttggaagtcgcgcaccatggatgggaacggatgaggccctgcgaccgtgccgagcagataatgggtgtctttgacgttggtgacccagtcgcgcagcgcctcgttgatggcgtccttgaggatgcgatcacccaaggtgacttcgacgacctccgcgccaagcatgcgcatgcgggcaacgttcagcgcctgacggcgggcatcgatctgtcccatgtagatgcggcacttgagtcccagcatggcacagaccgtggcagtggccacaccatgctggcctgcaccggtttcggcgatcacacgggttttgcccatgcgcttgaccagtagggcctgtccaagcgcgttgttgatcttgtgggcgccggtgtggttcaggtcttcacgcttgaggaacacacgggcatcaagaccggttttctcctcgagcctctgcgcgaaacgaggcgcttcagtcaatggggacggacgtccaacatactgctggttcaaccgcgccaattccttatggaattcaggatcggccttggcttccgtatacacgcgttcaagctcgtcgagcgccgtgatcagcgcttccggaacatagcgtccgccaaactgtccgaaatatggtccttcatggcttgccaacggggtctgttcggatgccttcactcttgctcctgcctttactaatcgttccactgcctgctcatggttggccgcggtggccacgccttctcccaccagcaccacatccgcgccggcacgggcgtaatcctcaagctcaaccgaaccgaacacaccggattccgccacgcgaatcacatcgtccggcaaatccgcggccagttcgttgtacttgttcacatccaccttgaggtctttaagattgcgggcgttgatgccaatgaccttggccccggcattgatggcccgttgaatctcctcacgggtgtgtgtttccaccagcaccgtcatattgaggctatgcgcgagatcgagcagcgacttgagcttgacgtcgtccaatgcggcgacgatgagcagcaccagatcggcaccatgcgcacgtgcttcccaaatctgatattcggtaacgatgaaatccttgcgtagcacgggaatcctcactgcggcgcgcaccttgtcgaaatcttcaagagagccaaggaaccaacggccttcagtcaacacggaaatcgcgcttgcacctccctgctcgtattcgcgggccaaagcggccggatccggaatatcgctcaaatggcctttggatggggaggcacgcttgatctcggcgatgaccggaatgccatccgcctttttcagccactgacgcgcatcgattggcgctgaagcctcgaacgccatccgcttgacctcagcgagcggcacgttgttttctcttgatcgctgatcctcgacggctcccgccaccaattcatcgagcacagacattactgcttcctttcacaacacaattgaacggtcagaatgtgactcacaactggcgaagctgcgcggcgatctgtaccgcttcaacgctggcttcggccttgttgcgagtctcctgccactcactggccggcacggaatcgaggacgattccagctccggcctgcacgctcgcttcatggtcgcgaatgaatgcagttcgaatggcgatggccatatcgaggttgcctgaaaaatcaaaataaccgacggtgccgccgtaaataccacggtcggccggctcaagttcatcgataatctcgatggcgcgcggcttcggcgctccggacagcgtccccgcggggaaggcggaagtgaacacgtcgaacgccgtcatatgcggatcgacctgcccggtaacggttgagcagatgtgcatgatatggctgaaccgtttgatgtccatcaaggaaacgacttcgacgctttccggacggcacacgcggctcagatcgttgcgggccagatcgaccagcatgatatgctcgctgcgttccttcgggtctgccaatagttccttggcgagacgttcatcttcctcaggagtggcgcctcgtggtctggaaccggcaattgggaaagacatggcatggccgttgtccaccttgatcagtgtttccgggctggaaccgatgacgttgaaatcacgtccttgagcatcggtgagtgccatgaaatacatgtacgggctcggattgagggtacgcagcacacgatacacatcaaacggatcggcgggagaatcaatatccagtcgctgcgaaatgaccacttggaacacatcgccatcgatgatatggcgtttggcctcttcaacggaacgttcgtaatcgcttttctccgtgcggaatcgcagttggggctggccgaccgactcgtcgagcacattgacccgggcttcgttttcgacgggtgcggcagccttgcgctgcatatcatccagacgtgccagcgcttcatcgtaggcggcatcggcacgagtcggacggtcatcgacattcacggcattggcaatcagccataccgagccagacacgtggtcgactactgcgatgtccgtggcgagagccagaacggtttccggctgtccggtctcattcggggcttcggcacggagcgtcggttcccaatgtcggatggaatcccatccgacagtaccaacgaggccactggtcagattcggcaatccctcgacgtgcggagccttcaatgtcttcagcgcggcatgtgccacttcgacaacatcaccgtcggtgggcactccgacaggcacctgtcccagccaatcggctttgccgttgttcgaacgcagctgcgccatggaattcacgccgatgaagctgtatctactccacgctccgccaaattcagccgattcgaggatgaacgtaccggaacggcctcctgcgagacgctcgtagaagccgactggggtcaatgaatcagccagcaaacgacgtacgatggggatgacacggtagccttggtcggccaattcatggaactgctcacggcttggccatgtagcaccccacttgagggtctgtacgctgcattcgctcaccgctgaccctcctgttctttggttcgatggcccacgaccacaggcagctgtccgccttcttcaaagcaggaacgtttgccggtatggcaagccgctcccacttggtcaacttctaccagaatggcatctccatcgcaatccagcgcgaaggacttcacatactgggcatgtcccgacgtatcgcccttacgccaatactcctgcctggacctcgaccagaatgtgacgcgtccggtggtgagggtacgtctgatggcttcgtcgttcatatagccgaccatcagtacctctttggtatcgaactgctggatgacggccgcgaccaagcctttgtcatcgtgcttgagacgctgtgcgatgcgcgggtcgagagtggtggtgttgtcgtatgcttcgttggtcatgatggtattgcgattcgttgttcagtactacagggttggtttgcgtagtttccgtggttctattcagcgtacggtgtatccggctgccttgatggcgtctttgacttcaccgatggtgactttgccgtaatggaaaatcgaggcagcgagcacggcatcggcgcccgcctcgattgccggcggaaaatccgaggctttgccggcgccgccagaagcgataatcgggattttgacttccttgcggacagctttgatcatctccagatcgaagccttgttgggtgccatcggcatccattgaattaaggagaatctcccccgcaccaagttcttgggcgcgcttgacccaccaaatggcgtcaatgccagtggatttgcgcccgcccatggtggtgacttcgaaacctgactgcgtatgtcgttctccctgttcgcgacgtgcatcgacggacagcacaagcacctgattgccgaatcgttcggcgacacgactgatgagggtagggtcattgatggccgcggtgttgacgccgaccttatccgcaccgcaacgaagcagggaatcgacgtcttcaggggtacgtacgccgccgccgacagtcagtggaataaaaatctgttcggcggtgcggctcaccacatcgaccatggtctgcctatgggagcttgacgccgtcacatcaaggaacgtcagttcgtccgcgccctggcggtagtattccgcggcgagttcgaccgggtctcctgcatcgcgaagattctcgaaatgcacgcctttgaccactcgtcccgcatcgacatcaagacatggaatgactcggaccgccagtgacatgctgctctactccttcacgcataacggttgcaatgattgcaagagtaaccgcaatacgttacgtcggttcatgcggattccgagtagcggacagaaccgggcctttcggaggaatcagtcacgttctttggctgcaagctgtccgcatgcgccatcaatgtcctgtcctctggtatcacgcagcgtggctgtgatgccagcgttatggagaatctcaaggaatctacgctcgtcttctggtttggacgcggtccacttcgatccctcgatcggattgagcggaatcggattgacatgcgcccaatcatctccatagtggttcagacgcttcgccagcaatttggcatgttccgcctggtcgttgatgccgcgcatcaaggcgtattcgatgctgactcgccgtttggaagccagataataatcatgcgcagcgtcgagcacctgtttggtgttgaaacgcttgttcatgggcacaagttcatcgcgcaattcatcgctcggcgcgtgcagggatactgcgagacgtactgggatgccttcttcggccagtttcctgatgccaggcaccacgccaacggtggaaaccgtgatgttacgtgcggagatgccgaagccttcgggaggcatggaactaatttggcggactgcactcaagacggatttatagttgcccattggttcgcccatgcccatgaacacgatgttgctcagtcgtccggagcctccggccacttcaccgtcacgcatggccttcgcggccacacgaacctgctcaacgatttcacctgcggacatgttcctggtcagtcccagttgtccagtggcgcagaatgggcaacccatgccgcagccgacctggctggaaatgcaaagcgtggttctggtgggataacgcatcaatacggattcgatcagcgacccatcaaacaggcgccacaacgttttgatggtggtgcctccatcggcgacttggcgtgtcacctcatggatgagttccgggaagaaagcttcagccgcgtcggagcgtcttgccgccggaaaatcggaaaattcttccgcattgacatcgaaatggccatagtaatgattagccagctgtttgaccctgaatttcggcaatccaagttccttggccttaccgatacgttcctcttcggacatatcggcgaaatgcagtggcggcttgccacggcgggcatggtctttcgacagcacatcccggaaggcgcccgaagtgcctccaggagtgatgcctgtttccggctgatcattcatggaattcacggttattggccctttctcacattccggtggcccacaggagcacgcacacgaaaggagcgcacaggaggatggagtcgacacgatccatcactccgccatgacctttaagcagatggcccatatccttaataccaatgtcacgcttcagcatggaagcgcataggtcgccgaaggttccggctataccgatcatgaaaccagcgacaataggcacccaccatcgaaccgtccaaacggatggctcgtaagtgcaaaacatcaccacaaaagaaccggccatggcgaacaagatggatcctgccaggccctcccatgatttcttcggtgagatacggggactgagtttatgtttgccaagccatgcacctgcaaacagaccaccggtgtcactcagcgcgggcatgaagacaagcatgatggcatgtgccaccggatgaccgttgaacgtcaacggcatgatcaggcaggaggcaagcagcggaatgtacagaacggtgaacatggagactgccacatggctcagtcggctgtggcgcacttcaccctgttcatgattgaacgacgattcgagacgagcacctgcatcggtgtgcgacagtttgtccgccacggccagggaaagccgactgccgaacgtcaccttggcacttgcggcgatcgctacaagcagcaaggaggccagtacacagaccgtcatagccacaatatgatgcttgctgtagtaggtggccagcaaagtcaccgcggaacatgcccacagcaccaccacgggaatatgcaatcccgcggtggcgaaatcgacgcgcagctcccacaatgcgagcaccatgaacagcacgacaagatagacgaacaaatcaacgctgatcaacaggcatgccaagatgatggcgatcaggacgaccgccgtggcgatggcctgcggcatgttgcgtccggttttcttgttgatggcgttaatggcctcttcggcttctttttcgcgttgctcctgtttttccatcgtggtctctcctgtggtaccgtgcgtcgattgatgattatggagattcgaaggaatcagacctccatgatctccttctgcttggtttccagcagagcgtcaagctcgtcggtggtctgcttggtgaccttgtcgagttccttgagcagacgatcgccttcgtcctcgcccatgtcaccatctttgatggccttgtcaagggattccttggccttgcgacgaatgttgcgcaccgcgaccttgccgtcttcagccttgcccttggcaatcttgacgtattccttgcgacgctcttcggtcagctccggcatggtcaggcgaatgacgttgccgtcgcgacgggggctggctccgagatcggaatcacgaagcgccttctccacggcgttggcctgggacgcatcgaaaggagtgaccgccaaggtgcgcggctccggaacaccgatggtggcaacggccttcagcggggtcggtgcgccgtaatagtcaacggtgatgccgttaagcagcgccggattcgcacgaccggtgcgaataccggaaaagttctccttggtggattccacggacttggccatctgcgccttggcctgatcgacgatagttgccattgtttgctcctttaatattgttggtttaatcgatattcggctttgaatgtcgtcactcggcgagggtggattccgcggtggaaaccatggtgccgatctcctcgcccagcaaagcctgggtcacattgccggcgccctcgagtccgaagacgcggatgcgctgcttgttgtcccgcgccatggaaagcgccgcagcatccatgaccgcaagattgtcgaccaatgcacggttatagctcaacgtggcgaaacgcttggcgttctcgtctttgcgcggatcggcagtgtatacgccgtccacgccgttcttgcccatcagcacctcatcgcagtggatttccagagaacgctggatggacacggtgtcagtggagaaatacggcatgcctgctccggcgccgaaaatcaccacgcgtcccttttccagatgacgaatggccttaagcggaatgtacggctcggcgacctgtcccatggtgatggcggtttgcacgcgcgtggcctgtccctcctgctcgaggaaatcctgcagagcgaggcagttcatcaccgttcccagcatgcccatatagtcgccgcgggaacgatcgatgccggcctgctgcagttcggcgccacggaagaagttgccgccaccaacaacgatggcgacctgcacaccttgcttgaccgcgggaacgatttcctccgcaatacgacgaacgacggtggtgtcgatgccgactttgcctccgccgaatgcctctccggacagcttgagcagtaccctgcggggattgtcgccagtgttttcgccagtcatgaaatgcctttcttacccgaaaacccatgaaatttaccgttttcaagactatcggcaaacacagacaccaaaacacgatggggtttagtgcaaaaaaatgtccgcaatcctgttggattgcggacattggagatatgccaagcccacgttcgaaagcgtgagctcaattcacatcagattcactcggcgtcgcccttgccgacctccacacgagcgaaggaaagcgcggttcccccgacttccttgaacaggtcgccgacggtcttggacggatccttgacgtacgcctgctcaagcagcacggtctccttgtagaatgcgccgagacggccttccacgatcttcggagcgatcttctcgatcacggcctccggcttgcccttgctcttgagctcctccgtggtcttctcggtggccacgcgacgctcggattccagcacatcagccggaacatcctcgcgggtcagccactgggcgcccatcgcggaaatctgcagagcggcctcatgagccacagcagcgccggcttcatcggtggcaatcatggccacgatgctcggcggcatctcagcggacttcttgtgggcgtagacctcgacatgcgggccctcgaccttggcgaactggcctaccttgacgtgctcaccgaacagagcagcggcttcctcgacggcttccttcacggtggtgtcaccggaggctgctgccagaacctcatccacggaggatgcttcggccttgacggcgtcatcgagcacgctgccggcgaattccacgaacttcggggtcttggccacgaagtcggtctcggagttcagctcgaccgcatagccggtctggccgttggcggattcgacaacggtggaggcgatggtgccttcctgagccttgcggccttcacgcttgccagcggcctggatgcccttggcgcggatgatttccttggcgcgagccacatcgccttcggcttcggtcagggccttcttgacgtccatcatgccggcgccggtttcctcgcgcacctgcttgatcagagctgcagtgattgctgccattgatttgtctcctctgaaaatttggtgatgccccgatgatgggaggcatagcacctcccatcatagagcatggtctcactcggccttggtttcgccttcagcctcagccggggcttcagctgccggagcgccctcggtgaggagctccttttcccaagcagccatcggctgctcggcttcgccttcggccttggcggccttgccggaacgctccagcagaccttcggccactgcgtcagccatgaggctggtcagcagttcgatgccgcggatggcgtcatcgttggcggcgatcggatactcaacggattccggatcggcgttggtgtcgacgatggcgacaaccggaatgcccagcttgtgggcttcctcgacggccagagcttccttgttcacatcgaccacgaacatggcggacggggtgcggttcatgttgcggataccgcccagctgcttagccagcttgtccttctcacgctcgaggagcagcagctccttcttggtcagaccggagccgtgcacgtcggtgaagtccatttcctcaagttccttgaggcgggagacgcgcttggacacggtctggaagttggtcagcatgccgccgagccaacgctcggagacatacggcatgttcacgcgggtggcctgagcggaaacagcttcctgagcctgcttcttggtgccgacgaacagcacggtgccgttgtgggcaacagtggccttgatgaagtcgtaggccttgtcgatcatgtcgagcgacttgaacaggttgatgatgtggatgccgttgcgctgggtgaggatgaactgcttcatcttcgggttccaacgacgggtctggtggccgaagtgcaggcctgccttcagcatgtcgctcatagtgatctgagccatggtattgctacctctttctttgtcggttcttgcctggtcatgcgttcctgcgtgcagccaatgccttgcaggcatcagccgaccgacacaggtcgtcgcgagcatgacgcgaattggttgcgcaccggttgacaataattgggcggtttgaagcactcgcggcagcgcttctcaccaaattggcgcacaaatattaaaaataccatggggccacgtctttctgacgtggccccatggttgaatcgtcgttcgctgtttcgatcacttgcgatgggtgcgcatgtaacgcatcgcctcgcggcgttcttccttttccagacgatcaagatagacgtgaccgtccaaatgatcagtctcgtgctgcagcatgcggcccatgatgccatggccttccaacactaccggcttgccgtccagatcaatgccccgcacgcgagcataatcggcgcgacgagtcttgtaccacaatcctggaacggaaaggcagccttcatcgccatattgctctccgttggtctcctccaacaccgggttaagcacatagccgattttgccgtcgatattgtaggaaaacgcacgcagactcacaccgatttggttggcggacaacccggcgcgtcccgggtcatcaacggtatccaacaaatcctgcaccagatggcgcaccgcgggcgtgatctccttgatgggatcgcatggggtgcgcagcactggatcaggtacgactcgaatctcacggattgccaaaattaacgctcctcgttgttcttggttgcggaaggctcgacggacggtgccgtctcgtcatccggttcatcggactgcttcttgattctctcctgcatggtatcaaatgcctgccgaaccttcgggctgacggattcagaagcctgccgcatgctttccgacgcctgcttgacggtttcggtggtgcggtcgagaatctggacggtcttcggcaacggcctgttggagggttttggcgcgtaaatcacgttttcgatgacgtctgcgtagcgctgcagcaccttgggacgaacaactttcaggcttgccgtcaaggtgccgtcctgttggttgaattcctcatcgagaatctcgaattttcgtacggattccgcacgggaaacgttcgcgttggccttttcgacatactgctgcacgaaagcgcgcacggcatcgttttccgctacctgcttcatggacatatcggcatcaagaccctgctgggaaagccaagaacgagtcatatcagaatccagttcaatcaaagcgctgatgaacggcttgccatcgccaatgaccacagcatgggacacgataggacaggtgtcgatgatgtcctccatcggggcggggctgacgttcttgcctccggctgtgatgatgatgtccttcttgcggccggtgatatacacgaatccatcatcgtcgatggcccccagatcgccggtcctcagccaaccatcaggcattttgacttcagcggtcttctcaggattcttgtagtagccaagaaaaacattggggcccatgacctgcagctcgccatcatcatcggtgcgcacacccatacccggcccgggcttaccaacggaaccgacgcgattcgcattttgccagttgacgatcatcggagccgcggtttccgtcataccgtacccctgaatgaacgtgatgccatccatgccattgaagaagtgggcaaggtcgacgttcagcggggcgccgccgcatgccagatatttcaggttcggaccaagcgcggaacgaatggacttgccgacgacggacatgaagaaggaatgctcggctcgggccaccatcgaatgatgtcccccgtcctgctcgtccttggaccattgcacgaaatgatcgaacgccttggcgaagaccctgccgcgaatacccgcaccggccttctgcgaggcagcgttgtacactttttcgaacacacgtggcacgccaagcaaatacgtcggtttgaaactgcgcagatcggcgagcagatgcttggctccaggcagatagccgaccacgccttgtccgccaatcgccacgtattggatatagcgggcgaagcagtgcgccaacggcaggaacagcatcaacctgttgggctggtacagcatctcgtcaagaatgatgtagccattgagcacgatatgcgtgaagttgcgatgggacagcatcgcacccttcggacgtcccgtggagcccgatgtgtaaacgatggtgagcatgtcgtccgccttgatccgggcaatgacctgatcaagggtatcgtcatcgacgccctctccgaaatcggcgactgcgtcaagaccgtccgctttgaaattgaacacgtaacgcagcccttcatgcatgtcacgaatctgttcgagcgtctgcgtgtggacggaatctccagcgaaggcaataaccggctccacctcttccacgatggaagcggcctgcttggccgaatcggtttcataaatcggaacgcttaccgcgccgatggccgcgcatgcgaaatcgaccacaccccactcgtaacaggtgggagagtaaatgaccaccatgcttccggccttgactccaagaccgataaggcccttcgccacggcgcgcacacgagcgagcatctggcctgccgtcacatcatgccattgccgagtctcatcatcctgccattgtgcgataagatcatccggattcttctgcgcacgacgcgacagcaacgcatataccgtgtcatcatccgtggtgctgtaggccggctctggtacaaattctctcaacatggttctctatagtagttcccgtatgcttaaggcacgctgaaaacccttggcatcgactgcgaacatcgacgccaagggcttttgcagattcctaccgtatcatcgcatcaatgcgatcacccgaaatcagccaagacgcacttccacgtggagcctttgagcctgaatgcggtgttgcatctcaaccgcgtttcgccgatgttgagcaaagccgcacattcgaatttcgtggtcgaagtcaaccagccattaatggcggacacgttgatgggaagcagaccaatcttggcatatagatttgcgtcttccttcatataatggcctattatggaagctgcgattttaagcctacgcatacagtcatccgttagaatacgctctacatgcgccggcttttgccgaccacggaagatgtcgatggcatcgcacgacatgcgcgcgcccaataacgccaaggaataggcttgcttcgcgtcccacggtgtggaatcggaccggataacatggaagggcacccgcatgccggataattgtgtttccaaaaacccatcatatgaaggaagcttctcgacggattttcctatgcactgcagccattggccattgttttccgcttctttaagaccgacatacgaatcagggtctgacggtgggatttcgtcaggctcattgccttctatctccttgtcgtcttccggctcccgctcagagccggactgccattccggaggtgaaacgccatcgtcggataagtcgtccattgccatggatccctcatttctttacctgtttaatgtcatccaactctcttcactgagaaggaccaaaaacattaatacataaagacaatccccccgtcaagtcgacggagggattgtggataactttttttatccacaggacgaagctatctgatcagtggctcgaagcgaccgtaaccggacaacgttggaagctcttcaaatcgacataaccggtcgtggccatggctctgcgaagcgccccaacaaaattggtggttccgtcggcgttatggctcgggccgaacatgacctcctgcaaggaacctacggtgcccacgttagtgcggaatccgcgcggcaacgtctggtggcgggcctcggcgccccaatgcatgcctttgccaggagcctcggaggcgcgtgccagaggcgagcccagcatcaccgcatcggcgcccagcgcgaatgccttgacgaagctgccggaatcacccataccgccgtcggcaatcacctgcacatagcgtccgcccgattcgtccatgtaatcgcggcgggcctcggcgacatcggcgatggcagtggccatcggcgcgtgcactccaatcgtgttgcggttggcggataccgcaccgccaccgaagccgacaagcacgccagcggctcccgtgcgcatcaaatgcaacgcagccgtgtagttggccgcgccgccaacaatgacggggacatccaggtcatagatgaatttcttaaggttcaggggctcatggtccttggagacatgctccgccgacaccacggtgccacgaatgacaaacagatcgacaccggcctcaagcacggtggaataataatcctgcgtacgctgcggagacagcgcgccggctacggtgacgccggcatcacgaatctcatgcagacgttcgacgatgagttccggcttgatcggctcagcgtaaatctgctggatgcgttcggtggccttgtccgcaggcagctgcgcgatttcgtccagcagcggctggggatcgtcatagcgggtccacaatccttctaggtcaagcacgccaagcgcgcccatcttgcccatggcgatggccgtggccgggctggtcacggaatccatcggggcgccgatgaccggcacgtcgaattcataggcgtcgacctgccaagaggtggacacatcctgaggatcacgggtacgacgggagggaacgatggagacatcgtccagcgaataggccagacggcccttcttgcccaaaccgatttcaatttcctgagacatggtttcaaggctaatgctcagctatgacagtgccttcgcgcgtgtccccacggttttggacatttccatacggaattaacacacatgtaataagacggaacccatcaccttcaattccgacagggaggacaaaccatggccaaaatcaaggtcgaaggcaaagtcgtcgaactcgacggcgacgagatgacccgtgtcatctggaaagacatcaagaaccgtctgatcctgccgtacctcgacgtggatttggattattacgatctgggcatcgaaaaccgcgacgccaccgacgatcaggtgaccgtcgacgcggcgaaggccatccagcgcgaacatgtcggcgtcaaatgcgccaccatcaccccggacgaggcgcgcgtcaaggagttcggcctcaagaagatgtggaaatcccccaatggcaccatccgcaacattctcggcggcaccatcttccgcgagccgatcgtcatgagcaatgtgcctcgcctggtcccgggatggaccaagccgatcgtcgtggcacgtcacgccttcggagaccagtacaaagccactgatttcaaggttccgggagccggcaccctcaccgtaaccttcactccggaagacggctccgagccgattgagcacgtcgtttacaattatggccctgacggcggagttgcccaggtgcaatacaacgtgaacgattccatccgaggtttcgcacgcgcctgcttcaactatggtctgatgcgcggctatccggtgtacctgtccaccaagaacacgattctcaaggcgtacgacggccagttcaaggatacgttcgccgaggtgttcgaaaacgaatacaaggacaagtacgaggcggctggcctgacctacgagcaccgactcattgatgacatggtggcaagctccctcaagtggcatggcggctatatctgggcttgcaagaactacgatggcgacgtgcagtcggattccgtcgcacagggattcggctcccttggcctaatgacctccgtgctgatgactcccgacgggcagaccgtcgaagccgaagccgcgcacggcaccgtgacccgccattatcgccgttggcagaagggtgaaaagacctcgaccaatccgatcgcctccatcttcgcatggaccggcggtctgaagcatcgcgccgaccttgacaacactccggaagtcaagcatttcgccgaaactttggagaaagtcatcatctccaccgtcgaaggcggacagatgaccaaggatctggccatgctcatcggaccggaccagccttggctcgataccgagggtttcatgaacgccctcgacgagaatctggcaaaggctctggcagagtaatctatctgagctgtcgaaagcccgtatgcgcaatcacacgcgcgtacgggctttttgacgtccggatattacaatcgatggtcagtataaggaacgtctattcttccgcaaaggacatggcatgattctgcatcgcacaatcccggcgaaacgtctgctcgctctgctggcatcggtctgcatggcaacagccatgggggcctgctcgcccaacggtgattcgcaatcgcagcaacagccgtcatcacaatccagagcaacagccgatgccggcaatgtggcgattttcgctccgacagacagcatcaccatctctcaacagacgccattgagcaaatgggaaaaactcgttcccgaaatcgtgtcctcgttgaaacggaccggtgtcaaaagcggcgacatcaccgtgaaaaccgcttcgaacctcgacaaacaaagtcaaagcgtccaagactatgtggtgaatcacatcaacggaaccgagcattcgtccacgaaagccaaaaccaccttggtggtggcgcctgtcgccgagatgccggaatccgacaggcaatacggcgactatgcgcggcatgatatcacgtggaactccgacgcgtcggatgaggacgaacaggattatgcgcaatcagcgcaacggctggtttcggcgttgcagcttgcgcagaatgaaggaatgaaggtcgttctgatctccaatacgcttcaagggtatgcgccggacgtgtatgtgccgatgaccacggccgagcagattggagaactgcaagccaaagagctcgtcaacaagctcgagctcgacaaggcatcgtccgatgcccccaagcaaatcgaggtactactcccctacgacgcggccgacggacatgatgccaaaacggacacgtccttcgcccagaacatgttcaaaggcatctggaaagtgctcgaaccgtatttcaaggacggcaaagcggcatctccttccgagacgctcaccgcttcgaccaccaaggatgactggcggtccgtggcattcgattcgtcaaaagccgaacaaatcaaatcggtgcttgccgaacgtctcgacgcggacaaggacgattcgcaccctgtccaccttgatggcgtcatctcctgcaacgactatgtggcgaagaacatcgccgacgagttggacaaactcggctacacaggttcctcagccgatatcaacccttccatctcaatctccggcatcgtggacagcatcacgggcaaaaaagacctgaaacggcaggcagtgcctgaccctgcgaagacgtcgtcatcggatgacgacagcgattccgataacaaggaaaacgcaaaatggccgatcatcaccggctatggggcctatatcagttccatgccgaacatcgtcaacggcaagcaatggatgaccgccatggagaaccgcaaggcgttggccgatgacatcgcgcagacatgcgtgcgactgaacacttcgggcaaactttccaaactcggtttcatccgttccgcaacggtcgaggggaagaaaattacgaccatccatgaggagacattggcgatcagcgccgacaatctcaagaaaacgctgattgaacccggctacatttcgctggcggatgcgggcctatgattcttccgggattcttccggatatggtgggggccgatggcatcactcggatgtcaccggcccccaccatatttcgaacatcattcggcgtgagccgccggcttcctcggcacgtagatgaccttgtcgatcaacgtccggtaatgttcaaccactgcctgcctgcgggccttcatgctcggcgtgaccaaaccgttctcctcagtgaactcgtcgggaacgatttcgaacttgcggattgattcggcacgtgaggcgagctcattggctttgttgacggcacgctccacttccgcacgcacaatggggttcttcgaggcttcatccaaatcagcgacctgttccgctcccttggattccagccataggttcgtctccgccaaatcaagggagatgattgcggcgatgaatggcttgcgatcgccgatcatgacgcattggctcaccaccggcgaagtcatgatggatgcttccatctcgcatggggagacgttcttgccacctgcggtgatgatgagatccttcttacgcccgacgatggaaacgaagccgtcatcatcaatggagccgagatcaccggtatgcagccatccatcgacaatttgctgcttggtaacgtcaggattgttgtggtatccggcgcatacggcagggctctttatgcacagctccccttcttcgtcgacccccatggtcacgccttgcagaggcaagccgatggtgccgatcttgtagccttcggtcggattgacgctcgagggggcgcacgtttcggtcatgccgtagccttccaatagcggcagaccgacaccgttgaagaaatgcgcgatagaggaatcaagcggcgctccgccggagaccgcatactcgacgtggccgccgaacacttccatgattgacgaatacaccagcttgttgtacagggcatgttttgcgttcagcgcgagtggaatgctcccaccggactgctgagcatgcgaccaatcgtatgccgtctgggtggcgtcagcgaaaacacgtcccttgaaaccggctccggccttctgcgaggccgcattgtagatcttttcgaaaatccgcggcacggcgaggatgaacgtcggtttgaacgccttgaaatcggcgagaatggtcttcagattgctggacagaccgagtgaaacgtttccggcaaagcagaagaactgcatgtatcgggcgaatacatgggcgagcggcaagaacagcagcagtcgacgattcggtttcatggcgatgtccggcatggagttgacgccggaataggtgatgaacacgaaattggcatgcgtcagttcaacgcccttcggggtgccagtggatcccgacgtatatacgatggtggctagatcggagcctttgaccgcttgttcacgttcaaggaattcggcgtcggagaccgcgcggccgtattcgatgatcgtgtcaattgcaccaagtccgatgacgtacacgtcgccaagatccgggcactgatcacggacggattcgattttgtcgcgctggaaatcatcctcagcgaacgccatcttgacattggcatcattgaaaatcatcttcacctgcgccggcgaattcgtttcatagaccggaacggtaagggcgccgatggacatgatggccacatcaagcgcggtccactgccagcaggtatgcgcgataatggataccgaatctccaggcattacgccacgagcgataagtcctttggcgagggcgacgaccttgtttttgaactccgcagcggtgaacgccgcccattcgccctgagcgttcttgtattcgacaagattgtcgtcaggagtgcgttccacacgctcctcaagtactgagaagatgtttttgtccgagtcaattccctgttccaaagggcgcgtgtattccttgatcataagcttctcgctcctcgaaatctaatgtacagacagcatcatagccggaataccgcactttttctttaaggccacgaccccaggacaacgacaacacccgtggatatggccgttacaacggtttcagttcaacccgcatcgacctcactctgcccgacggatccgcataatcacgtcctccgctcttgaggccccaatgcagacatccatcggcgcaatgttccgagccaccttcaacacgagcgaaacgctcccccttggcgatgacggccccgaccggtcgcgtagtgaccgcgggttcaaacgtcgacgtcaggcttcccgtttccgcaccgtggcgaagcgttaccacggatttgcccgccactttgccactgaaggcgaccacaccatccgcgggcgcgatgatggcgtcttgcggccgtgcacgcaaatccaaaccgcgatgcccaggcaaccattgtttagccggcgcatcatattcgccgattacttgcgcgtgctccaaaggccactgcattgatgtgcggcatgccgcttgtgcgacttcatgcgccacgtcatcagccgattgcgcgtatgccgacgccgtaggttgcgcgcagcatatcgtgaacgcgatgttcgccaatacgcatacggccatcgccgcggcgcaccggtgccggttgcgcttgtcaatgtcatcggacatcttattgtgtcgaacacgccgacggtattcccatttgttcatgaggcctcctgtggtccgcgtctctatccgggaatcgatatcatggcacgttcgaagaccgcccgtcgacttggaacgaccttgtggtcggagaacaacacttatccacagatgccgggcgtgtcgcgccatgacatgccaaaacgccaccgaacgtggcatacgatgggacacatgagtgacaacactacgcaacgcaaggcattgcagcagttggagagcgagccgtccgaggaacgcatcgcctactaccgcaagccattcatggtgctatgggccgccattcaggaggcttcaagcgagctgcaggacgattacacgctttcacccgaattgtcccagttatgggttggcgagcaaatacggcaggtttcggattcgctagtggatcggctcgcggaaatcgccgtggcgcatggcgagtcaaaatcgaatgtggcacgtgcggccaacgcaagtcccgacaacgtcatacgtcgcttccctcgactcaaggctgatgcggcacacgaccgcacactcattgacgacgtgctcgattcgttggaatagcagcgaaaagttcttacggaaacaaaaagcccttggaaaaccaagggctaagaagctcctgcgactgggcttgaaccagtgaccgttcgattaacagtcgaatgctctgccaactgagctacgcaggaatatgttccggtgtacccgaaactgcgctcctgcgactgggcttgaaccagtgaccgtccgattaacagtcggatgctctgccaactgagctacgcaggaatgttcccaccggaagacttggcttccgtgcacaagtcacatatattacacgaatcagccatttacgcaaatcatacgtatcacagcgtgtcgcaacgtcaccattcaagctcttcgatatccatcggatgctcgttgacctcaatcgatgacacacgtccatcatgcatgcgaattacacggtccgcaatcggcgcaatcgcagaattatgcgtcacgatcaccactgtcgcgcccttcttgcggctcatgtcctgcagaatgcggagcacttgcttgccggtgttgtagtcaagcgcgccggtcggttcgtcacacagcagaatcttcggattcttcgccaccgctcgagcgatcgccacacgctgctgctcgccgcccgacaactgcgcgggaaaattgtcgacgcggtccgcaagccctacgtcggcgagcgcctgtcgggcgtcttgtgcgtcgggaacgatttgtgaggcgagttctacgttttcgcgtgcggtgaggttggcgacgaggttgtagaactggaatacgaagccgatgtcggtgcggcggtatgcggtgagttgtttgggtgtgtagttggagatgtctttgccgtcgatgattacttgtcctgaggtgttggcgtccatgcctcctaggatgttgagcactgttgatttgcctgcgccggatgcgccgaggatgatggcgagttcgccttgttcgatggtgaaggagacgttgtcgttggcggtgatggtggtggatcccatgtggtagagcttggtgctgtttttcatttcgatgtatgccatgttccgctccgttttcttgtttggcgtccatgccgtttttgtttgttgtttttaatatacgactaaagtggtgtttgtggttccacgccgagggaaaggattttccatggatgtctccgatgatgccgaccgtttgcagacgttgttgtatagttcctattccgccgatgttgtccggcagttggagcgtcctttgttggatgatggtgtgccgttgatgcgtatggctgcttctgcggtggctcgtgtgacgttgtcgttgcttgatgatgaggatttggatgttgaggatgcgcggatcacggtgttggctggcgctggggacaatggtggcgatggcttgtatgcgggggctgagttggcgcgtgagggtgcgcaggttaccgcggttgctgttggccgttcgttgcatgaggatgcgtttagggcgtttgttcgtgcgggtgggcgtgtgttggtgttggatccggcggctgatatttctgggtgcacgtctggtttttccgcgggtgaggctggtgagcggctgcaggctgcggtcgagtgtgcgcggggtgcgcatgtggtgcttgatgctatgacggggattggcgtggtcggcgcgttgcgtggtgtcgctggcacgttggcttcgtctttgggtatggatggcgtgttgccggacaagcctgcgttgccgaacaatgacccttccgctgatttgccgttggtggtggccgtcgatgcgccgtcgggtgtgggtgttgatgatggttcgttgccggggccgtatattcctgcggatgtgacggtgacgttcggtgcgatgaagccgtgtgcgatggtgccgccggcttcgtatgcttgcggacggatcacgttggtcgatttcggtttcgatgtcgatgatgctgttccgtttgccgagatgacggatggcgattttgtggcggattcggttcgtcttccgtctcttgcggatggcaagtattcgcgtggagtggttggtttggtgactggttcggcgcggtatccgggtgctgccgtgttgtcggcgagggccgcggcgtgcgcgaatgtgggcatggtgcgttatctggggccacagcgtgcgcaggatatgatattgtccgtgttgccggaggctgtgttgggcaagggccgggtgcagtcgtgggtggttggatccggcgtgcccgccgagggtgacgttgcttccggtgatgacatgcaacgtgcgaccattgccgcgctgctggatcattacgcgttggaggatggcgatggctcgcggaacgagcgggcggagggcatgcctcccattgtggttgatgccggcgcgttggatttgctgccgtgccatgttgtgccgcaggtcgttatcactccgcatgccggcgaattggccgcattactgaatcggttggatgccgatatggccgatgttgtttccaggcagtgggtggaggcccggccattgcgggcggcgttgcgcgcgcatgagcttacgggggccacggtgctgcttaagggcgcggtcaccattgtggttggagctgatggagatgggaacacgcggatcatcctgtccgggcgcgcgcctgcctggatggccaccgccggttcgggcgatgtgttggccggcgtgttgggcgcgttgctggcgcagcaggacgacatgctgtccgacgatccggctttggttccggaggtcgccgcggccgccgcgtatatgcatgggcttgccggcgcgatggccagcgggtcggagcagcgcggatggcatcgtccgcatctgtatgggcatgcgggcaagactccggcgagcgcgatcgggcatccgattgttgccggtgatgtcgtcgcggctgttccccgggcttttggcgagctgctccgctgaccgtttcgtggagggtcattccactgatttcaatgcttcgagcatgtccaccgtttcgagctggcggtatacgatccagccgagcacggctagtaccacggccacgacgatggccggggccgccaatgcgatccagctgatggcggggtcgaacatgacttcgtcgggtggcacttcggtgatgatgtatcggtgcagccattctccgaagccgtatccggcgagtatgcccagcagtgacagcaggatcgtttcgcggtagatgtacatcgtggtctcgctggtgtggaagccgagcactttgatcgtggatagctcgcgtatgcgttccgacacgttgaggttggtcaggtcgtagaggatcaccacggccagcagcacggccacgagaatcagcacttccatgatctggttgagcgatcccacgattgtggacaccatgttcttctgcgtcgtgttctgcacgacgccgcgcacggcggccagtttcatgaatttggcgccttggcgttccgtgttggcgttgctgtggtctttcagtctgaccatgtatgcgtttgtgctgtactggtcgccgaacacgtgttcgtagcattgcgcgttcatgaatatgaaatggccgatgtacatttcgctgatgccggcgactttgatggtgcgttgcgcgccgttttcgtcgtttaccgtgaaggtgtcgccgaccgagacgttgagcatttcggcgagccgttcggagattaccgcgccattgttgaccagtatctgtggttggtgtgttttgcggtcgcgtaatgtcaggtattcgttgaagttgtatgcgtcgtcggtggccagcagggtgatcgactgcttatcgttctccttgcctgcggttttcgacagttcctcgtagcgcaccgctgtcgaggattggacggttttgcccttcagcgtcgtggcgatttcctcgcgttgcgcgctgttggtgtcggattcctcggcgacgatcaggtcgtagtggatgagttcctcgaactgtcggtttcctatctgtccgatcgaggattggacggcgaggccggccgtcagcagggataccgctccgcatacgccgaagatcgtcatgaacatgcgtgttttatatcggaagatgttacgggcggtcactttgtgtgtgaaattcagacggttccatagtggtgggaaatgttccaaaagaattttcgagcctttggccggcggcttgggcagcagtaggctcgccggtttttcgcgcagttccttggacgcggccagccatgccggcacgacggcgcttatccatgcaagtgcgaatgcggccatggtgatccaggggtggaatttgagcatgatgtccggcatggtgaatcccgcgctgtatgcgtgggcgacgataagcggcagcagcgtgtggccggcgagcacgccgatgcatgtgcccagggtggatgcggcgaatccgtatacggtgaatttgagcatcacatccgcgttgccgtagccgagcgccttcaacgttccggaattggtgcgttcctcgtccaccatgcgtcccatggtgctgaaggtgacgagcgccgcgacgaagtagaggaagatcgggaagatgtccgccagtttcgccacgatgccttcgatgaccatgtacacgcggtagccttgcgaggtcaggccttcgcggcggccgctgacggaataggccgggacggtgagattgtcgatcttctcctcggcgagggttatctgccgttcggcttcggatatcttgcgttcggcttcgggcttctgcgcgttgaattcggcgagtttgctctggtattccgtttcggccttgtcgatgtccctctggccttggataagctgcgtgacgccgtctgcgacttgcttgccggcctgcgacaccgctttgccgagctcgttttgtttttcggctatctgtttggatgcctgtgcgagattgtccgcattgctccgatacgcctgcgagccttggtcgagccgcgctacggcgttctggtattgttgcagtcccgcattgtaggcgttcagctgtctgttgtattcggcgcaggcttcgttgtactggttgatcgccatgtcgtatttgccgcgtatttgttcgtagagtttgccggtgatgccggtctgttcccatttgccgagcgtcgcgccgactttgtcgagcacggttttgcttgtttcgagttgttctcgcgccgcgtccagctgcgttttgccgttcgccagccggttccatgaatcggagagctggttctgtccttgagccagttgcgtctgtgccgcctgcagttgcgtctgtccggaggcgaccgacgcgttggccgaggccagttgcgcttgcgccgtggccagctgggccgcggccgccgacccttcctccactgcctcggcgctgccttcgctcaactggtccttggcgttgtcgatctgctgtttggcatcgtccagctgccgttgcgcgtcggcaagctgctgtttggatgttttgactttgtccttggcctcgtcgattttcttgcgctgttggctgcgtatcgtcgcttcgcgggcttttggctggttcgcgagcaacgtcacgagctgatccttatgcttctgcacggcatcgcggtattcggcgctccagtagtccaatccctcggtgtcttcgtaggtcgcccgggcgatcatcttcacgtcggaatcgaactctcccggaacggccacggcatagcctttgagctcgccgccgccggccgcggattgtcccatgttgaggcaggacagagtctcgctggcccggacgaaaccgacgacggtgaatttgtggtggcgtagcacggtgccgcctgcgatgtccgttttctcggtgacgttcaaggtgctgccgacggcgaatctgtcgcgttctttcatgtccaacgcgatttcgccggtccgcttcggcagtcgtccttccgtcacgtcataggtggagacggcatcgggtttggaatagatgcgcatgctcctgtcggtgccggagatgaccacgtccttgaagtacccgtattcgacttccttgatgccgtcggccttgccgatgatcctctcgtcgtctttggagatgccgtagttggagaccacggtgatgtcggcgaggttgttacgcccgtaggaagtcggcggcgatcgcctgcatgtccggcccggtgaccttcagtcccaccagcgcgaatgagccaagcgccatgaggcacacgatggacacgacccggcctttcgacttggacagtgtttgccggatgtccttccacagcatgcgtttcaccattccagctcctcgatgtccattggatgctcgttggtttcgattgatttgacgcgggcgtcgtgcatgcggatccccctgtccgcgatgggggcgatcgcggagttgtgcgtcacgatcaccaccgtcgccccgcgtttgcggctcatgtcctgcaggatgcggagcacctgcttgccggtatggtagtcgagcgcgccggtcggttcgtcgcatagcaggatcttcgggttcttcgccacggctctcgcgatggccacgcgctgctgctcgccgccggaaagctgcgcggggaaattgtcgatgcggtcgccaagtcccacatcgaccagcgtctgcactggatcggccgcgttcttgacgagttcggaggcgagttccacgttctccttggcggtgaggttggccaccagattgtagaactggaatacgaatccgatgttgttgcgccggtaatcggtcagttgcttcgcgttgaagtccgagatgtcgacgccgtcgatgatgaccttgccttcggaattcgtgtccatgccgctcaggatgttgagcaccgtcgatttgccggctccggatgatcccagaatgatcgcaagctcgccgcgttcgatgtcgaaactcacatcgttgttggcggtgattatgatgtcgcccatatggtagcgcttgaagctgtgcaccatttcgatatatgccatcgtcggccccttcctaatgctttccactaggacacccgtctattcagacaacatgttgatttaatttcggattgattgtatgttcgaaatggtcggcatgacaatcatcgcaatcgccgaaaacgtctagattagcctttttcaaaacccaagcgagcctttccgccccaatgactttcaggaaacgccgcacgcgaagacgaaaacgtccttcacgaacatgggtacggtacactggcggaagacagacgcacgctacaagaagggtttcccgatgaccgttgcagttccgaccatcaccgacgtcgttttcgatttctgcggagtgttgctggattggcggacacgggcatgccttgaaggcagattcgacgacgcgaccgtcgaccgcatctgcgccgacgacgacccctgcggcttcttcggatacgaggaccgtatggacgccggggaggacttcgattcgatatggcccgatgtggtggccgagcagggagaacgcgtcgccgggatcttccgttattacatcgcgcattacgacgacgcgctgccacgcatgctgcccggcatggagcggctgctgcgcgatctgaaggcggccggctatggcgtgtggggattgacgaattggtcccatgagacgttccatttcgcattcgagaagttcccgcagcttgccgaactgctgcagggcaccatcgtctccggcgtggagaagatgcacaagccgaacgccgacatctacgaactggcgatgagccgtttcggcctaagccccgagagcagcgtgttcctcgacgacaccgcgaagaacgtcgccggggcgcggtcggccggcatgcacgccttccgtttcgtcgacgccgaccaggcgcgcagggacctggaatccttgggcgtgcgcgtgtgagcgcggcggacgtacgcctgcgtcccgcggaacgggcctcggccatgcgcccatatcatcgtccgctgtaggccgcgcatccaccgaccgcgtgtccactatgcaaaacgaagcgctataaatcgtcgtttcgtaaagcgacgctggtataaatgggcgttatgaccctccttcagctgaaatacatcgtcaaaatagtggaatgcggctccatgaacgaggcctcgcacgagctgtacgtatcccagcccgcgttgagctcctcggtgaaggagcttgagaacgagctcggcatcgagatcttcacccgttcctcccaaggcatcgcgttgaccgtggacggcgcggaattcctcacctacgcgcgtcaggtcctcgatcaggcgtcgctgctggaggaacggtacaagaacgcgaaaccccgcaaacagctgtgctccgtgtccacgcagcattacatgttcgccgtggaggcgttcgtggagatgatcgactccaccaagtccgacgaatacgagttcaccatccgcgagacccgcacgaaggacatcatcaaccaggtggcgaacatgctttcggagatcggcatcatctacctgtccgacttcaacaaggacgtgatcggcaagctgctgcgcgagaagcatctcgagttccatccgctgttccgcgcgccgttgcacgtgttcatctcgcgcgacaatccgctggccggcaagaagaaggtcaccatggacgatctgaagccgttcccgttcatccaatacgagcagggcgaggaaggcagcttcttcttcgcggaggaggccgtctggccggagtactcccccaagcagatcaacgtgaccgaccgcgccacgattctgaacttcatcatcggcctgaacggctacacggtgtgcaccggcatcgacaacggcgatctcaacaacgagaagatcgtcaccgtgccgctcgacaccgatgagacgatgcttgtcggatggatcaccaatgagcgcgcgaagctgtccaaggccgccgaaacgtacttggagaagctcaagtcggtggtcgccagctacggctacacgctcatcgactgaccccggaacagaggaaccacaacgaaaaggcactgtactgcccgaaagcagcacagtgcctttctgtcatatccgagactatgacagccgatgagcgcggttcagcgcgaacgccgcagtcaggcgccgtactgttccaggtacgcgtcggcggcggccttgatctccggtgtgacgtacggggtgccgtcggcgttctggatgtgctggccggcttcgaagatctccttcacgttggcgatggcgaacaccgggaagccgaattcggcttcgacggccttcaccgcggacgtgtcggaatccttggtcttctccatgcggtccacgctcagtaccaggccgatgacctcgacgttcgcctcggccttgagcttcgggatgacctcgcgcacagcggtgccggcggtcatcacgtcgtcgacgagcaggaccttcatgccgtccgcaagctgcgtgccgaccatcatgccgccgtcgccatggtccttcttctccttgcggtcgaaggtgtagccgacctccatgccatgggcggacgtcagcgcgatggcggtggacacgcccagcgggatgcccttgtaggcagggccgaacacggtgtcgatgtccttgggcaggttgcccgcctcgatctcctcgacaatcttctcggcgtagaacgcgccgagacgggcgatcttgcgtccgtcgttgaatgcgccggcgttgatgaagtacggcgacttgcggccggacttcaatgtgaactcgccgaatttcaacgcctgcgattccagcaggaactcggtgaaacgatggtcgagcgatgcggtcatttgcttgttctccttacattgatcgattacgaaatttcagcgccaggtctcgcctttggcgagcttgtcggcgagttcgggacgttcgtcgagcagatcgtcgagttcgcgggccacgcgcagcggcgcggtcggctcgaacaatgcggccgcgccgacttcgacggcgttggcgccggcatacaggtattcgagcgcggtctcgccggagtcgatgcctccgatgccgatgatcggtatttctggcaatgcggcgcgcacgcgccataccgcggccagtccgaccggcaggacggccgggccggacacgccgccggtgacgtgcgtgatgaccggctcgccggtgcggatgttgatgcgcatgccgagcagcgtgttgatcaggctcaatgcgtcggctccgctttccaccgcggctcgtgccggcacggtgatgtcggtgacgttcggggtgagtttgacgatcatcttcttgtcggtgagcttgcgcagtctggtgatgaggcggctcaaagccaccgggtcggtgccgacgctcatgccgcctgcggacacgttcggacagctcacgttgatttccagcatgtcggccggggaatcgtcgagtttggacacgacttccgcgtagtcgtcgtcgcagtgtccggcgacgttggcgatgacggtggcgttgatggccttgagtttcggcagatcgtcctcaaggtaatggtccacgccgggattctgcaggccgacggcgttgatgttgctggaggggccttccgcagtacggatgccaggattgccttcccatggcaccggagacacgcctttggtggtgacggcgcccagctggctcacgtcatagaaccagcgcacggcagcatattggaacgtgccggaagcggtcgccaccggattcttccacgggataccagccacctgggtgggatgcttccattcgtgctgttcgtacaggttcgcatgttgttctgcggtcatgctcactccccccatcccaattgttcgcgggtgaacacaggtccgtccgagcagaccttcaatcgtccttcggcggtgtcgacggtgcacagcacgcatgtgccgtatccgcagcccatgcgctgttccaagctcagctgtgcctcgatgccgcgtttcgccgcccatgcggcgacggccttcatcatcggcaacggcccgcatgagaggatgaccggcttcagctcgccgttcaccagttcattttcaatacggtcaaggagcgttacgacattgccttcggattcgtcgatgctgtatgtcttgtccgcgtaccggccgacgtatccgtctccgaaacgcacgttgcggtatccgaacaccgcggtgctcgtcgacccctccgattcggcgatggcctgcgcggcgcgcaccagcggcggcacgccgagaccgccggccaccagcacgtagttcgcgttctccttggtgttgaaggagttgccgagaggacccatcacccgaatggtgtcgcccgcacgcaattcggagaattcggcggtgcctttgccgacgacggcgaagataaggctcacctcatcgccatccacttcggccacgccgaacgggcggggcatcagtctgctcggattgttggaatacacgtcgacgaactgcgccggcttggcatgtcccgcgatgaattcgtcgcggaatgtcaatcggtacacgccatcggccagcatgcggttgtcgacgatttcgaccgtgtgcctgctggggaagaatcccgcttccctcgcctggccgacggtcggcatgaacgttgctgcggcggtcatgactccctttcctgtgtttcgttcgattgttctggtagcttacggcagtaccgcgcgcagattgtcgcgcatgtccttcgcggcctcgcgcgccgattcggcgaccaagtcgagcgcatcgtctgcgctcatggattcgctgtatttgccggacttcttccaggctccgatgatgccacgcgacgaattgacgagcgcgcccatgccgtctttgtcgaacatgccggccacgccttgggcggtaccgccctgcgcgccgtaaccggggaccaggaagaacgtgtgcggcatgcgcgcccgcaacgccttgccttcctcgggatgggtggctccgaccaccgcgccgacacgggaatacccgttcgcgccgatggtttcggctccccagccttccacgaggccggcgatatgctcgtacacgcgctcgcctgaggcgagttcgagttcctgcagttcgctgctggatggattggaggtgcgtaccagtacgaagatgtccttgtcggcaccagtggcggcttcgacgaacggggtgatgccgtcggtgccgaggtaggggttcacggtgaccgcgtcctcatgccacgggtcgaaagcgcgctcccccgcgttcacaccgctcagatggtgggcgtaggcggctgcggtggagccgatgtcgccgcgcttgacgtcgccgaggacgtacagtccctgctgtttggcgtattcgcaggtcatgctgtaggcgtcgatgccggctggtccgagcgcctcatacatggcgatctgcggtttgacggccgggacgatgtcggctactgcgtcgatgatggcgcggttgaattcgaagaaggcgacggacagttgggctgccggcgcttccgtcggatcctccacctgttcggcgatttcctcggcgaagctggccacgacctgcttcggcaccagcgcttcggtggggtcgagtcccacgacgcttggattctgcttgtcttcgatggcttcgatcagacggtccatcagtcctccttgtcgatgcggctgaaggccagcttcgagccgatgatggtggcgagcggccggccggtgacctgccatccgccgaatggggtgttacgtgccgaggagtggaacttctccgggtcgacggtccattcctctccggtgttcagcaccacgagatccacctggtcgctttcgggcacgcggcccagatcaagcacgcgcttggtgtcgtcgtctcccggcacggcgtcggcgtagtcgtcgagcaccgccgtgatgtccgttttgtcgtggcccatgagttcggccggaccggtggacatgagttcgatgagacgttcgtcggaaatgaatccgccgtcgacaagtaccttgtggcagacgccgtatgcgcattccagcccgatgatgccgttgggcgcgtcgaggaagccgagttccttctcttccatggtgtggggcgcatggtcggtggccaacaaatcgaccgtgccgtcggcgacggctgcgatggtggcctggcggtccgcttcggagcgcagcggcgggttcattttggccaaagtgccgtacttaagcagcgcctcgtcgttcaatgcgatgtaatgcggcgcggtctcgcaggtgatcggaagtccttcggccttggctttgcggatggcgtcgaaggagatcgcggtgctgacgtgctggaagtgcacgtgcacgccggttttgcgggacatgtcaatgtcgcgttcgacgattttgagttccgtgtcctccggaatgcctggaacgccaagcttgcgggacaccggaccgtcattgaccgcgccggtgtcgtggtgttcgcaatgctcgatgaggtacagtcccgactccttgacgttttcgaacacctgttcgagaatgctgggggtcaccgcggaaccgtcatcgctgatggcggtcaccggatgcgccagctggtaggcgtccttatgctcgtcgccatgttcgggcaggtagccgatccagtcggccacttcggtggcctcatggccggcacgcccctttgaggcgcatacgcataggtcgtagcgcaccggcagtttcacgccatgagcggcctcgtaatgctgcaggtaatcgatgaccgtgtcgtattcggcgtcgagcacttcggaggcgcccggctggccggcctccaccttcacgccatccatggccggcacggtgtttggcatgatgagcacgttcgtgtatccgccggatgccgccgccgcgcagccggagatcatggactccttgtaggtctgtccgggatcgcggaaatgcacgtgcgggtcttcgaatccgggggcgatggtcatcgccgaggcgtccacggacgcgtccgtgtcggaggggacgacgaggtcaatgacttcgccggtgttccagaccttgatgtcgtgaagggtgagggtcatgatttcagaacttcgcttcctcgtcgcagtagtcgcaacggtattcctgacggtcggaatgcaccagatggaacatctgcaccgcaggctcggtggtggtgacgcagcgcgggttcacgcatttgatgatgttgacgacatgttccggcagggtcggcttcttcttttcgacgattttgccgccgcggacgatgccgacggtcgcggtgcgcgccacgaggccgagcacgtcgaggtcgatggattcggtctcatcctcgattttgatgatgtccttcgtgccgtacatgtggctgtcggtgttcatgatcaacgcgagcttggttttggacgggtcgatcttcagatactcaagtaccttgagcgcggttccggcgggcacgtgatcgatgatgatgccgttctgaatgctggtgacttccatcaggcttcaacctccttggctgcgagcggttcgtatcccggcagttcgtcaccgaccaccgagctttccaatgccatgcgcatgagcataccgttcttgacctgttcgaagtaggctgcacgcggatcgtcgtcgacttccacggcgatttcgttgacgcgcggcagcgggtgcagcacggccatgtccttcttggcgtacgccatcttggcttcgtcgaggatgtaggtgtcacgcagacgcagataatcgtcctcgttgaagaaacgttctttctgcacgcgggtcatgtacagcacgtcaagatcgccgatgacggagaccagatccttgacttcggtgtaggagcaggattcggtggcgttgatgcggtcaagcacgtactgcggggtcttgagctcgtcggggctgatgagcacgaagttgacgttgccgaagcggcacagtgtttcgatcagggagtgcacggtgcggccgaaggtcagatcgccgcacaggccgacggtcaggttggtgacacggccgaagcgcgattgaagcgtggccaggtcggcgagcgtctgcgtcggatgcatgtgtccgccgtcgcccgcgttgatgaccggcacggaggcggcgcgggatgcgaccagcgcggcgccttccttcggatggcggatggccaccacgtcgacgtagttggacaccgtcttcaacgtgtcggcgatcgtctcgcccttggtgacggaggcgagctgggcgccggcgaaaccgatcaccttgccgccgaggcgcagcatggcggtttcgaaactcagacgcgtgcgcgtgctcggctcataaaacaaagtggcaagcaccctgccttcgcaggtgtgtgccacttctttacgatgggaatcgatgtactgcgctttgtgcagcatttcctgaatctgacgaatggaaagatcatcgagagtgatgacgctttttccgaccatcggcgtttcgaccgccggttcgagtactgaggacaacggctcacctttcatgcaacttgtggttgaaggtggccactgaaagtgacctagccaactatagcccgaaacactgacccggagcgttcaccgcgtgttcaccgagcgcccgctcgaatcgtttcatgaaaggccgtagaacagacgttccgtcacgtcgcgcgccttgcgcattacggcaagcagatcgttttcgaaatgctgtccgcgattcgcgtcgtatccgagatagacggcgagtcctcccagcgaatacgtgtcatccggcaggatatccgcctggttgacgcgcccgctccacaggtagctgccgttgcgcgcggccgtgcacatccaccatgcgcgtcgcaatacgacggcgtcgccggcggaaaccagcttgcgccgctccaactcgtccaacgcctgcatcgtgccgttgactcgcaggttcgcgttgtcgccggcatgctgcaactgcagcagctgaatcgtccattccacgtcggacagaccacctttgcccagcttcaggtgacggtccctacgcacgccgcgcggcaatcgctcggcttccatacgcgccttgagcttgcgtatttcggcgacctgcgcctccgtcaaatcgatcttcggatagcgcagcgggtcggcgacgttcatcaggaaatcctcggcgagcgccgcgtcgcctgccgcgtaacgcgcacgcaggagcgcctggtgctcccatgtgctcgcccaggaacggtagtattcctcgcaggacgcgtaggagcgcacgaggggtccgtttttgccttcgggccgcaggtccatgtcgagttcgattttgggttcgagcgtggtcggtccttgcaggatggcgcggaggtcttcctgcactttgcgtgcgaagaggttggcttggttgtcgtcggcgttatcggacggccggtagatgatgatgacgtcggcgtcggagctgaagttcacttccctgccgccgtagcgtcccatgccgatgacggcgattgccgccggcgcttcgtcgagtcccatttcctgcgtttggtggcggatggcccaggtgagcgatgcgtagatggccgcgtcgtatacgtcggtcatacctgcgagcgacgccttgtcgtcgatgacgccgctcatccaccctagtccgatgcgttcgatttcgtggcgtcgcatggcgcggatggagttggcgaagtcgttgatgctgcctgcgttgcgttcgagtgaggcgtgtgtctgcacgtcgaggctttcgcgtgagcgtggctgcaggtcgttgtcgctgccgagccaggtgacggattcgacggatttgttgagcgcgtcgcccaggaaccgcgaattggacaggatgtggcacaggcgttgcgcggcggacggcgagtcgcgcaggaagccgaggtattcgctgtccgtgccaaagtgttcttcgagtttgcgccagttgagcagtcccatgtcggggttctgcccttcgccgagccattggagggcggcgggcaggaggatgcggttgattttcgcggcacgggagatgccggcggtcagtgcggtgacgtggcgcatggcggcgtcggggtcggcgaatccgatggaggcgaagcgttcctgcatggcgttggcggacagttccacttgttcgtcgtcgaggccggcgttgatgggcagcatgggccggtagtagatgtccatgtgcaggtggcgcacttcacgtcgggtttcgtcgtatttgtcgacgagttcctcggggtgcatgtggaaggcccgggcgagtctgcgcagttcgaggttgtggttgagttcgtcgtcgttggtgtcgcgtttgcgttcgatgccgccgagactggctttgccgaggtccgggaacaggtgggtgcgtttgagcgcccacatttgctggcggtgttccatgacgcgttcgaagcggtagtcccaggagagcttcttggcttgtctgcgtgagacgtatccgccttcggcgaggcgttgcagcgattcgagggtggagctggtgcgcagggtctcgtcggcgcggccgtggacgagttggagcatctgcacggtgaattccacgtctcgtaggcctccgcggccgagtttgatttcacggtccttcaggggcgcggggatgaggtcttcgactcgtttgcgcatctgctggcagtcgtagacgaagttgtcgcgtttggatgcggcccatacgaacggtcgggtcatgtccatgtacgcttggccgaggtcggggtcaccggccacggggcgggccttgagcagggcttggaattcccagttttccgcccactgttcgtagtaggcttcgtgcgattcgagtttgcgtacgagcgggccgtccttgccttcggggcgcagtccgccatcgatctgccacaatgtaggttcggcgacgcccatgatgacggattggcatacgcgctgcagggtggtggccattttggtgccgacacggttgagggtcatgccgttggtgtccgcgtccgccggttccaccacgtagatgaggtccacgtcggatacgtagttgagttcgcgtgcgccgagcttgcccatgccgatgatggcgaagcgcacgtgttcgctgccgtccacttcgttgcgggcgatggcgagcgcgccttccagggccgcgtcggcaagatcggacagttcctggctgattctcggctggatttcgatgggatcttccgcggtggtgtcctgcgccatgatggcggcgagctgttttctgtaggtctgtcgcaaggcagtcgccgcctccgcaaggggtttcgaggctttcggcgtgcggctgtcgacagggtcggcaccgaccgcttcgagcacatgtgcgcgccgctgggcgtggttgtacaggtggctttcgcatgagtcgctggctgcggccatgacgagttcggggcggaagcgcatgagcttgcccatttcgtcggacacgccgagcacggtgacgagtcgtacgagtccggcgtcgtcggtgatgacctggtggaagtcgcggccttggctttgcaacgctttgatgatgtcgacgaggttgcgtagcgcgatgtcgggctcgcaggtctgttccaatgttttcatcagcaggcatagccggtcgtcgtcgatgccgtcggcgcgcaactcgtcaagcagcgtgcgtgccgtgtccagatcctgcaatcctgcccgaatcagatcgagcaccccaaactgatgcgtagaagaagccatggttcccatagtaatcgtttatatccgtaagtatggcgaaagggatggtttccgacagctgccggaaaccatccctttcgtgtttgttgcatcgtccggaatcagacgaagaatggtttgacgttggaccagatgcgccggctgacgcatggatggttcatcgtgtacaggtgcacgccgtcgacgccgcgtgccgccaagtcgcagatctgttcggacgcgtaggcgatacccgcctctttaagcagcgcggtgtcgctcccccacttgtcaagcaggacggcaagtttttcaggaacacgcgattcgcacatcttcgacatgcgcagcaccgacttcgcgttcatcaccggcatgatgccggcttcgatcggaacgtcgatgccggcggcacgagccttgtccacgaatcgaaggaaatcctcgttgtcgtagaacagctgggagatgaggtggcttacgcccgcgtcgaccttcttcttgagattgtcgatatcctcctcaagcgtggccgcctgcgggtgcttttccggatagcaggcgccgtagatcttgagattaggacgcttctcgcggatgtaggccgccagatcgctcgcatggtcgaacactcccgccggttcggctccttccacacggtcgcctcgcaaagcgagcacgccggagactttggcttggtcgaacaggtcgagcgcctcgtccacgtcgtctttgtcaaggtattgcgcggtcaggtgcgccacggccggaatgccgtattcgttcaccgtatgcgcgatgcgtgcggtcaacgtgcggtcggacgatttgccggtgccgtaggtgacggagatgaagtcggggtccagcccctgcaggccatccaacgtatcgtagatggtacctacagggctggtgcgcttgggagggaacacctccagcgagaagattggcgaatgcatgtgattccttggaaatcttgcctgttattgccgatgccggttacttggcgagtttggcgcgcacggccttggccgctgtgacgaggttctccaggctcggccaggtttcggcgttgccacgggtcttcaggccgcagtccgggttgatccacaccttttcgacgtccatcttcttcaggatctcgtagatgcggtccttgatctcctgttcggacggaatgcgcggagagtggatgtcgtacacgcccgggccggcttcggtttcgaagttggcgtcgtggatggcgtcgagcaccacaaggtcgccgcgggaggcttcgaaggagatcacgtcggcgtccatcgcgtcgatgtccttgatgatgtcgttgaactccgaatagcacatgtgcgtgtggatctgcgtggtcggcttgacggcggaatgcaccagacggaacgccggaatggcccagtcgaggtacttcttgtgccagtcggtcttcctcagcggcagcttctcgcgcagtgcggcctcgtcgatctggatgaccttgatgccggccttctccaaatcgagcacttcgtcgcggatggcgagcgcgagctgctgggtctgctgctcgtgggtgatgtcctcgcgcggccaggaccagttgaggatggtgaccggaccggtgagcatgcccttcatcacatggtcggtgcgggactgcgcgtaggcgctccattccacggtgatcgggttggcgcgggatacgtcgccccacacgatcggaggcttgacgcaacgtgtgccgtaggactgcacccacgcgttcttggtgaacaggaagccgttgaggttctggccgaagtattcgaccatgtcgttgcgttcgaattcgccgtggacgagcacgtcgaggccgatttcctcctgatgcttgatgcaggcgtcgatctggtccttcatgaattcgtcgtattcggccttggtgatctcgcccttgcgcagcttggcgcgttcggcgcgcacttccttggtttgcgggaaggagccgatggtggtagtgggcagcagcggcaggttcagcgcctcacgctgctccttctggcgttcggcacgtgccggctgacgtacgaagtcggcgtcggtaaggcttgcgattcgcttggcgaccgcaggatcggcggcgacgcgggtgccgtcgaacagcgcctggttggctgcgagttcggcggatgccttcttctcgtcgtcggaagcgtcggcaagcacggcgacttcgtgcagttcgtcgagcttctggactgcgaaggcgaagtgcttgcgcacgtcgtcggcgagaccatcctcgccttcggtgctgaacggcacgtgcagcagggagctggcggtggagacggccacgttggcggtgacctgcttcagcgcgtcgaccaggccgaggctcacggcgtagttgttgcgccagatgttgcggccgttgatcacgccggcgaagatggtggtgttttctgccacgccgtacttttcgacggcggcgaggttttcgtccttgccttcgttcaggtccaggccgataccgtcgaagccgagcaggttgacggtttcgtacacgtcggcgatatgtccgaagtaggtgttgagcagcaccttgaccttgccttcgcgggcgggcaggatcttggcgtacaggctcttgaacagttcgacatcgcccggctccttgtcgagcacgaggtacggttcgtcgatctggatccactgcgcgcccagttcggcgaacttggcgacgacttcggcgtacaccgcggcgaccgcgttgacgaggcccttgtcgtagtcgagctcctcggcctgcggattgcgggcgagcttgaggaaggtgtacgggccgatgagcaccggcttggtggcgatgccgagcgccttcgcctcgttgaattcgtcgaacggcttggtgctgttgagcttgatgtcggtggcggagtcgatttccggcacgaggtagtggtagttggtggtgaaccacttcttcatcggcagggcggtcacgtcgcccttctcgccctgatagccgcggcccattgcgaagagggtctcttccgggttctcgaaggcgagacgctggtagcgctgcggaatgacgttgagcaggatggcagtgtcgagcatctggtcgtaatagctgaagtcgttgctcggaatcaggtcgatggcggcggcctgctgcagcttccaatgcttggcgcgcagttccttggcggtggaacgcatctcgtcgagggtggtgttgcccttccaatacgcttcgatgattttcttcagctcacggttctggccgatgcgcgggaaaccggagacggaagtaagagcggacatgaatcctccatctgatatgaacaatgcaacccgctcaagctatcacaaaaccgccagctataagacatcaagaaaatttgagtgtcgttataaactgtccttataacgcagtccgtatgccgtctatattcacacatttatgtttatggatcaataatgcagaacagcccggcaagcggatttaacgcaatgtcccgtatgcgtcggggtccacgggttccagccattcattcgtcgcgtcgcccgtgccatccgcaatcatgaacgccaaatggctgaaagcttcgtgaggggcggcgccgtgccaatgcttaacgtccggcggaatacggacggcctgtcccggttcaagctccttcggctcttcgccctcaagctggtagtagccacgccctccgaccgcaatgagaatctgggccgcgtgatggtggatatgccagtggttccggcatccaggttcgaacgtcacattgtggattgacacttcaggcgcgtcaagtaccggcgcaagccagctctgtccgtcgaaatactgggcgaaaccgtcatttggttccccaagagggaacgcactgggattgttcatatgggctttcctatccatcattctgaacatcggttcagaaagcaccatacaaccttgaagccgcttgaagtcaaatcacagcactctgcggaatgctcatcgttccgaatcagcccggaacacgcaagccctactcgaagtctttggcggtaagcagcgcgatgagttcgccgctgtgcagctgccactggttgaatggctcgttcgagccgaatacggcgatcgaggccggggacatgccgagattcagcaggtcaagcaacgtcggatcggattcggtgctggccagccattggcaggcgatcgaaatggtcggttcgtggccaagcacgagcagcgtgcgatgcttttccttggtttgcgcgagctcgtcgaacacggattgcacgccgccttcgtacaggctttgccggtagtcgactttcggatcgtcgccgaacaccttgagcatgcgatcgcaggtctgacgggcgcgggtggcgctggagcatgcgatgcgagtgggcaccattttgaacgccgccaatcctttggccacggctttggcctgcttacgtcctttgtcggtgagctcacgtcccacgtcgctgccgttgccgccgaacggctcggttttggcgtggcgcatcgccagcagcacatacttgtattccttggtctttttggcgaccttcttcaggctcgttcccataatcgcacgctccgatccggttccagcgccgcatttcaaatatctaatatccattgtctcagattttccgctgggacatggcatgaaacgctctaaatctactcctttatggcttcgacctgcgcgtcgaggtcacgcagcaccttgcgcagcttgcgatcggaaatgtcacgcaattccagatcctcaagctgttcggcacgctcctcgagcgtcaacgaatcgatgtcggtcgtcgtgtccttcgtggcacggtcgcgtttacgcaacgcctgaaagcccggagccatcgcgcgagaaaccatgaggaaaccggtgtgtccaatcatctggtgatcgggacggatggccagtccttgcgccttccaattacgttccaaagtctcctgaatgtccggctcggtccagcaaccggcctcgcgcaacgcttcggcaagacggctcaactgcgtggtggtggtgacgtacgcgacgagcacgccgccaggcgcgatcacgcgatacgcctgttcaagacggttccacgggtcaagcatgtcaagcatgatgcggtcgaaggagtgttccggcaaaccagccgcgaccgaatcgaaatcgccggtcctcaaatcccaccatgcgggacgttcgccaaagtaaaccgtcgcgttggcttcggcgacgcgcgcgaattccgaacgcatctcgatggtggtgaggcttccgccctcccccacggcatccagcagattgatgctcatcgcgcccgaaccggctccggattccagcacgttcataccggaacgaatatcaccgagctgaatgacctgcgcgatgtccttcggatacatgatctgcgcgccacgcggcatggacagcacatagtcagccaagcgcggacgcatgacggcgaactcccaaccaccgatggcacgcgtccccttccacggcttgttcgcgtcgcgttccggatgcgtctggttgacctgagcctcacgtttcgcactcaccgtcacgacaacggatccttccgtctggccaatcacatcatcatgcaggatgatgccatgcgaagtctgcgtcacaccacccggcaccagctgatcggtgattttattcgacctgcggtccgtaaactgcactttttcaccggcggcaagcggccctcgacgcatggttcacgctccttcgtacgttcgttcagtatacgatttcacgactatggcttacgattgcagaccgcattattccacggacagcaacgaacctatgctaccgtatccgccgtcataccggcagacggcacgaagcgacggcaatgtgacggcaacgtcaacatcacaccgcgtacgcgttccaacgaccattcgcatgcgtgaccttcaaatccaaaccaaacacctggctcaaccgttcagaagtaaaaccatgctccaaatcacccgtatacacgatagtgcccggcgccggatcgttgccggccacattatccgcatacgcgtccgcctcgttgccggtgatacgtcccatgatcgccacatggtcgaagccttgcggaatctcctcaagacggtgcgtcaccagaatcacggcgcggtcagactgctccgcaccaacacgactcaacgcacgcaaagcaatctcacgcccacccaaatcaagacccgtggtcggctcgtcaagaatcagcaaatcgggatccgccatcaacgcacggcagataagcacgcgagtgcgttcgccttcggaaagcttgaacatcatcttgccttccaggtattcgatgccgaattcacgcatcaatgagcgggctttggcgtaatcctcgtcagtataggtgtcgcgccaacggccggtggttgcggtcagcgccgtcacgatggcgtcaagaggatcttcctgcggtgggaacgcacgtccgagttcggccgagctcaaaccgatgcggttgcggtaggagaacacgttcactttgcccagacggtttccaagaatgtcgactgtgccttcggatgggaatccacgggtgctcatcatctgcaccaacgtggatttgccgatgccgttgggaccgaacagcacccatttctcgccttttttgacttccagattgactttggtgagaattacgcgcctgcggcgacggaattccacatcgtccagtttcaacgcgatgctctgttcgttcatggtcccctccattttcacaaaccacttggatgcgatgatgcctcctgccagcatagtgcgtcggcaggaggcatttcaggaatattctggctatcgatcagccggatcggttatccgcgatcagacaggttcggttctacttccgttcggcaagcacgtcctcgtagactttgacggtcttgtctgcgatggactcccagctgaagtggtcgcgggcacgctcgtaaccggcctgtcccatccgcttcgccttttcagggtcagccatgatgcggttgatggcgtcggccatatcgtgcacgaatttgtcagggttggtgggggtgccagtgccgtcatgcagttggtcgaccggcaccagatatccggtctcgccgtcgacgacgacttccggaatgccaccggtcgcagaggcgaccaccggcagaccgcatgccatggcttccagattcacgatgccgagcggctcgtagatggatgggcagatgaatgcgtcacagccatgttcgagtgcgttgagttccggcttcggcagcatctcctcaatccagatgatgttgccgcgttcctcgtcgagcttggcgaaggcggtcttgacctcttccatgatttccggcgtgtcgggagcgccggcgcacagaacgacctggatgttcgggtccacgaagtgcagtgcctgaagcaggtacggcagacccttttgacgggtgatgcgtccgacgaacagcaaggtcggtttgctgcggtcgatgttgtaacgttcgaacaccttccagcccggatcgtcatccgccggggtttcaaactggttcatggtgatgccgttatgcactacgaccaccttgtccgggtcaaggttcggataggcggtgaggatatcctcacgcatgcccgcggatacggcgatcacgcggtcggcatgctcgtaggcgtctttctcagcccaggagctcagattgtagccgccgcccaactgctcacgtttccatggacggaacggttcaagcgagtgcgcggtgatgaccaatggggtgtcatgcagcattttggcgagatagccggcaaggcatgcgtaccatgtatgcgcatggatgatgtcggcatcaacgtcgttggcgatttgcaaatcgacgccaaacgtcttcagcgcaccgttcgcatcctcaagctccttcggcacgtcgtagccgacgaccgtgagcgaccctttcgggtcggttccgggaatcgcgggaatgtcggcggccgcgcgcggcccgtcgaatgcgcggaccgtcacatcgacacgttccgccagcaccttggaaagctcttcggcatgcacccccgcgccgccatacaccttgggcgggtattcacgcgatagaatgtcaaccttcatgtctgtaatctcctcctcgagtcttccagcgtttcctgttctactgtaaaacatcagacacgaaaaacacttattgttttcatcgtttttcagaaagttccattctttttctgaaaaacgatgaaacagcattctcgcataccctttacggttagtcgaagtcaagtagcgcatacctaaaatccgatagaaaaagcggtgagacaaatgcttctggttgtctcaccgctttccatcgtttttgtgatcagacggctgttccgttttggtcgagattcggattgtgcttcgggttgccggccgtgaagaacaggctcagcacaccgactgcgaagacgatggcgactgtggagatgagccacatcggatgcgacggcagccacatgaccacgaggaaggcgatggccgacagcgcaatcagcacccagctggccacacggaaccattggcggacggaatggggtgccttgaacatcttcggattcttgtaatcaggattggtgttcaacacgttttccgtttccgtgatcgtactggcactcggcttccatggcccatcagtgccgtcctgcagacgacgtgacttttcctgcagctgatactcgtccaacatgccggaacgtgcgcggccttgggtttggtcgtattgctgtggcactcccctgcgattgcgcttggcttgggcacgtcgttctgcgcgatttggcattagtcactcctttgttgcatggtgctgggattactttaccgcattttgggtgaaaaacaggtagcccggctcactattcgcgagccgggctacctcgttcatacccttacaacagtgttgtctatcgcggcagcatcatcggacgcttggaagcgacgatcggtgccggcagttcggtggagccggtaaggtactcgtcgaccgcggcagcgcaggagcgaccttcggagatggcccacacgacaaggctctggccacgtccggcgtcaccgcaggcgaagacgccgtcctgggaggtggcgaacttgtcgttacgcgccacattgcctcgaccgtcaaggtcgaccggcagctgatccaccagcgtggtggtgtcagggtgcaggaagcccacggagataagcaccagatcggcgggaatcactcgttcggtgcctggctggcgggtgaacggcccgttctctcctggagcgacgttgacgaccttcagaccggtgacatgtccgttctcgtcggcgacgaagccttcggtggcggtgaagttctccaccttcaccttggccttgtcctcgtcggagccctcgaagttgaccgagtcggtgttgtacacgtattcggcgcgctgcgtttcgaaaccttccttcatggaggaggtttccttgtacaggcgggcgaaggtcggccatggctggttggccggacgctcctttggttcctgcggcatgatctgcagcacggtgacgtccttagcgccttgacgcagggacgtgccgaggcagtcggaaccggtgtcgccgccgccgatgatcaccacatgcttgccttcggcggtgatgtcgttgaccggcttgacaccgtacacgcgacgtgtggcgtccggcaggaactccatggcgaaatggatacccttgagatcacggcctggaatcttcatgtcacgcggcacggtggagccgatggcaaccaccactgcgtcgtagcgggaacgcaggtcatcccaggagatgtccttgccgatttccacgccggtgcggaacacggtgccttcggcttccatctgctcgactcggcggtcgatgaggcgcttgtcgagtttgaagttcggaatgccgtaacgcatcagaccaccgatggcgtcatcacgctcgtatacgaccacggtgtggccggcacgggtgagctgctgggcgcaggcgagaccggatgggccggaaccgaccacggcaacggtctggtcggtcagacgctgcggcggcagaggcttgacgtagtcaaggctccatgcctgatcgatgatggtgcgttcgtcgttctgaatcatcgtggccggctggtggatgccaagcacgcaggcggcttcgcacaatgccgggcagatgcgaccggtcacttcggggaagttgttggtctcggacagacggttgtacgcgtcctcccacttctcctgacggaccagatcgttgaactccggaatgatgttgccgagcgggcatccgctcatgcagaacggagtgccgcaatccatgcagcgggccgcctgctcggtggtccaggactgcaggccggattcggtgtgaacgtcgaaccagtccttgattcgctcttcaacggggcgttcggccagttcgcgacgggtacggaccttcaggaatccacgaggatctcccatgtcagcgcgctccttccataacctgctcgtacacctgttcccagacgccgggcgtattgaaatcgatgttcttctcctcggcttccttcatcgccttctgcatggcgaggaagtgcttcggaacgatgtgggtgaatcgcttggcgctgttttcccagtcgtcaagcagagccttcgcgaaggcggagccggtctcttcggcatgctgcttgacgagaccgtgcaccagcttgtcggcatcggtgtcaagcggctcgaacatcagcgcgccgttggtggcggccgccgggttgacctgcttcatgtcgaggtcgagcacgtacacgttgccgccggagaagcccgcgccgaggttacggccggtggagccgagaatcacgaccgtaccgccggtcatgtattcgcagccgtggtcgcccacgccttccaccacgaaggtggcgccgccgttacgtacggcgaaacgttcgcctgcgcggccggccacgaacatttggccggaagtcgcgccgaagccggtgacattgcctgcgatcacgttctcgtgcggatcgaaggtgatgccgtcctctggacggaccaccatgcggccgccggacaggcccttgcccgcgtagtcgttgacttcgccgtagacgcggatggtttcgccacgcggaatgaacgcgccgatggactggccgccggcaccatggaacgtcatgtcgatggtgtcgtccggcagaccttcctcgccgtagcgcttggtgatctcatagccgagcatggtgccgagcgtacggtacacgttgcggatcggcatttcgatacgcacgggctccttcttgtcaagggctggctgggcaagctcgatgagcttgttgtcgagcgccttgtcgagctcatggttctgatcgatcgtcttgtgcaggatggttcccggaaccggacccggctgcatgagcacgttgctcaggtcgatgccgtcggacttccaacgcttgatggcttcgtcctggtcgaggcattcgacatggccgacggcctcttccagcgtgcggaagccgagctgcgcgagcagttcgcggacttcctcggcgatgaacatgaagaagttgacgacatgttccggcttgcccttgaagcgtgctcggagctccggatcctgggtggcgatgccctgcgggcaggtgttcttctggcaggcacgcatcatgacgcagccttcgacgatcagcgcggcggtggcgaagccgaattcctcggcgccaagcagcgcggcaatcaccacgtcgcgaccggtcttgagctcaccgtcgcactgcacggtgatgcgggaacgcaggccgttcagaaccagcgtttgctgggtttcggacaggccgatctcccacggggtgccggcatgcttgatggcgttgagcggagccgcgccggtgccgccgtcatagccggaaatcagcaccacatcggcatggcacttggccacgccggcagcgatggtgccgacgccgaattcggagacgagcttgacgtggatgcgggccttcggattggccatcttcgcatcgttgatcagctgtttcaaatcctcaatggagtagatgtcgtggtgcggcggtggggagatgagctccacgcccggggtggcgtgacgtaccttggcgatccacggcggaaccttggctcccggcaggtggccaccttcgccaggcttcgcgccctgggcgagcttgatctgcaggtcggtggcatgcaccagatagtcgctggtcacaccgaagcgggccgaagcaatctgcttgatcttgctgtagcgcagcggatcgttgatacgatcctcggattcgccgccttcaccggagttggagcgtgcaccgatcgtgttcatggcgatggcgagcgtctcatgcgcctcctgggagatggagccgtagctcatggcgccggtggagaaacgcttgacgatttcgctggccggctcgacttcggaaatgtcgatcggcttgcgggtggacttgaacttcatcaggccacgcagcgtcatcagacggttggaggtgtcgttgatgtggttcgagtacttcttgaacaggttgtagtcgccgcgctgggtggactgctgcagcaggaagatggcttccggatcgttcagatggtcctcgccggtacgacgccacttgtagtcgccgccggtacgcaggttgcggtgcgggcgggcggtccattgggtcggataggccacgcgatggcggctggcgacttcctcggcgagctcgtcgaggccgacgccgcccacacgggacgtggtgccggtgaagtactcgtcgatgacgtccttgttgagaccgaccgcttcgaacagctgcgcgccacggtagctcatgatggtggagacacccatcttggccatgatcttgagcacgccggtggacagtgcgcgggtcaggttcttcacggcggtttccgcgtcgaccttgaggtagcccttgcgggagaggtcttcgacggattcgaatgccagatacgggttcaccgcggcagcgccataggcgatcagcagtgccacatggtggatttcgcgcacatcgccggcttcgaccaccatggagatctgcgtacgcgtgtggcggcgcagcagatggtgctgcactgcggaagtgagcagcaacgatggaatcggaccccacgcatagttggaatcgcggtcggacagcaccaggaagttggcgccgttctcaatcgcctcgtcgatctcctggaagatctcgtcaagacggtccttcagtgcctgtccgccgccggccacctggtaaaggcccttgacgatgaatggcttgtaatagccaccgagaatcttggcgcggtggaggcgcttgagctgtgccatctcgtcggagttgagcaccggcagcgggatgaggatcttcttggcgtgcagttcggaatcggccagcaggttcggctcgggaccgatggcggattcgaggctggtcacgatcttctcacgttcccagtcgagcggcgggttggtgacttgcgcgaacttctgggtgaagtaatcgaacagcatgcggctgtgcttggacagcgcggcgagcggcgtatcgttgcccatggagccgagcggctccttgccggtgttggccattggggcgagcagcagcttcagatcttcctcggtgtagccgaaggcgcgctgacgacgctgcacggactgaccggagtggttgacgtgctcgcgcttgggcagctgactcaattccacggagttgccttccacccacttgcggtaggggtgctggctggcaagagtcttcttgatttcctcgtcggggatgatgcgaccctcgtcggtgtcgacgaggaacatcttgcccggttccagacggcccttggtgacgatatgctcctcggcgacttccggcagcacaccggtttcggacgcgagtacgacataaccattgtcggtgacctgccaacgtcccgggcggaagccgttacggtcaagcagagcaccaacctgggtgccgtcggtgaagatgatgtgcgccgggccatcccatggttcgatcagcgtgttgttgtattcgtagaaagccttgacgtccggatcgagctggtcgttgttctcccatgccggcggcagcatcatggagatggcgtgcggcatggaacggccggcgaggtgcagcagttcgaggcattcgtcgaaagtgccggaatcggaatagccgggggtggcgatcggcagcagcggcttgaattcgccgagcagttcggaactcagtcggccttcacgtgcggacagccagttgcggttgccttggatggtgttgatctcgccgttgtgcgccagctggcggaacggctgtgccagcggccagcttgggaacgtgttggtggagaagcgggaatggacgatggcgattttcgccttcatgcgttcgtcggacaggtcaaggaagaagggcttgagctgcatggtggtgagcatgcccttgtaggtgatggtgcgggcggacagggacgcgaagtagatgcctacctcgtgttccacgcgcttacggatgcggaaggtcttgcggtcgagttcgatgccaccgagcttgccttccggatcggccacgatcagcgtcttgaacgccggcatgctggccagggcctgcaggccgagtccgtccggattggtgggtacgacgcgccatgcgagcacttcgaggccctcttcgcgcacgatcttggaaatggcctgctcctgctggccggaagtggcgatgtcgcgatccaagaaggcgatgcccgcggcgtaatgaccttcttcaggaagctccacaccggccgtggcacgcatgaattcgtcgggcatactcatgagaatgcctgcgccgtcgcccgtgttctcctcggcgcccacggcgccacgatggttcagattgaccagcacctcgatggcgtcatcgacgatcttgcgttccggacgcttgttgagggtggtgaccatacccacgccgcaagcatcatgctcggctccaggatcgtacataccttgggaatcatggatcgtcagatctaacggggcgtggaaagtcaccgaaaccaccttcaatgtttttgggcaagaaaagtcttgcggttctttaatgcgtggtttagaataccgcgccagtatgtcagcaacgttgcacgtgtccatataacgaatggctatttttgtcaatgcctcgcagaggatttagcccatgaacgcatacttcgcatgtcatgctcatgcgcacgcacttcacttatgctcattaacccggtcagtccagtgtttccaacagctccgtgatgatggtgtcgttgagcagtcggcctcgcaaagtgggtatggcgcggccatcaagcattgtgatcagcccgtcgtgttcaagctcaatccatttttgttcaggaatcaagtggctgaattgtctggtgtcgagtccttcacgaatgcgcaggcccaacatgatggtctcttcgatgtcctcggcggcagtgatgcgttcactgccggcccatggcacattgccctcattgatggcggtgccccacaatcgcggatgcgcgatatcccaggagcgcaatcctttgccgtcttcgcaatcgccataatgcgaatgcgcaccgggaccgagaccggcccaatcgacgttcctccaatagccaaggttgtgttgcgactcgtatccgggacgagcccaattgctaatctcataccattcgaggccggcttcggtgaacatcgtgtcggcgatttcgtatttgttcgcttcgtcgtcatcgtccggtctcgacaacgtgcccgccgcgatctgtcgtcccattttcgtattcggcgcgatggtgagcgcatatgcggaaatatggttgacacccaaatcgatggcggtgcggacggatgtgcgccaatcgtcaaggctctcccccggcgcgccgtagatcagatcgacgctggaacgcatgcctgctgcattggccgctgcgattccggcggcgacgttttccggcgtatgcgtacggtcgagcgttgcaagcacatgcggtaccgcggattgcatgccgaaggaaatacgattgaaaccgccgtctgcgagttctttcacatagtcggcattcaccgtgtcgggattcgcttcggtggtgatttccgcgtcatcggcgatgccccatgtggcgcgtaccgcatccagcatggcgaccaaatcgcttgccttgagtgtggtcggcgtaccgccgccgaagaagacggttgccaccttcggctcgttgataccgtgcgttgtctgccaatcgcggacaatcgccatttcgcggataaccatgttcgcgtagttgccgcgtgacgcgcccgcgcccatgtccacggccgtgtaggtgttgaagtcgcaatagccgcagcgacgtaagcaaaacggaacatgaatgtagatttcgaacgtcacgaaaggctcaaccttcggacttctgcgcggcgcgaatcttgtccttggtgtcgcggtcgttgcccgctccgccggtggacagggctgcgatgaacgcctcctgcggcacttccacatggccgagcatcttcatacgcttcttgccggccttctgcttttcgagcagcttacgcttacgggagatgtcgccgccgtaacacttggcgagcacgtccttacgcagggcgcggatggtttcgcgtgcgatgattcgagaaccgatggcagcctggatgggaatctcgaactgctggcgcggaatgagctcacgcagcttcttggtcatcatcacgccatagctgtacgccttgtcacggtgcacgatggcgctgaacgcatcgactttctcgccttgaataaggatgtcgaccttcaccagatcggcggactgttcgccatcctcgtggtagtcgagcgacgcataccccttggtacggctcttcagctggtcgaagaagtcgaagacgatttcggcgagtggaatacggtaatgcatttccacacggtcggcggaaatgtattccatggtgcccatctggccacggtggtcttggcacaggtccatcaccgcaccgatgaaatccttcggcgtgatgatgtcggcggcaaccatcggttcgacgatcttcttgatcttgccttcggggaattcgctcggattggtgacgcgatgcacggaattgtcttccgcggtgacctcgtacggcacgttcggcgcggtggagatcaggtcaaggtcgaattcgcggctcaaacgttcggtgacgatctccatgtgcagtaagcccaggaagccgcaacggaagccgaagcccaacgccacggaggtttccggttcgtagatgagggccgcgtcgttgagcttgagcttgtcaagcgcctcgcgcagttccggatattgcgcgttgtcgattgggaacaggccggcgtagaccattggttgcggatcacggtagccttcgagcggctcggtagccggatttatggcggaggtgatggtgtcgcccaccttggactggctgacgtccttcgctccggtgatcacatagccgacctctcctgcgccaagcgccttggtgggcatcatgtcggggctgatcacgccgatttcgatggggtcatgcgtcatgccgatacccatcatgtgcagtttctcgcgcgatttcagttcaccgtcgaccatacgaatgtaagtgacgatgccacgataggagtcgtatacggagtcgaaaatgagcgcgcgggcaggcgcgtccgggttgcccgccggcgcgggcacttcggcgacgatacggtcgagcagttcggcgacgccttctccggttttgccggagacgcgcaacacgtcggacgggtcacaaccaatcaggccggcgatttcctcggcatgcttgtcgggttcggcgctgggcaggtcgattttgttgagcacggggatgatggccagatcatggtcgatggccatatacaggttggacagcgtctgcgcttcaatgccctgcgtggcgtcgacaagcagcaccgcaccctcgcatgcggccaacgctcgggacacctcgtatgtgaagtccacatggccgggggtatcaatcatgccgagtgtgtattcggtgccgtcaaccgtccacggcacgcgcacggcctgcgatttgatggtgatgccgcgttcctgctcgatatccatgcggtcgaggaagcgatcgcgcatctcgcgctccggcacgatgccactcaactgcagaatacggtccgccaccgttgatttgccgtgatcgatatgcgcgatgatgcaaaagttgcggatcaacgactgatcggtgtacccgggctgattatgctgttggcccacgccatcctcctctggaaatattcgacgcaaacgattctaactggtagtgtcggcatgtccttccgcgacactcttatacgcattggcgatttatccgcgtgccatgttatcatcatcgtttgtatgtccttatagcaaacgtcgtttggagaaatagtggcaaacatcaagtcgcagaagaagcgcgttctcaccaacgagaaggcgcacaagcgtaacgtggccgtgaagtccagcctgaagactgccgttcgcgccacccgcgaagccatcgccgctggcgataaggccgccgccgaagccgcctacaaggtcgcagcccagaagctcgacaaggccgccggcgctggcgtgatccacaagaaccaggctgccaaccgcaagtccggtctcgctgtggccatcaacgctctctgagttttcgtaactcacagcttgtaagaagccccgcaggaaaacctgcggggcttcttcttttttacatttcgtactctgttgaaaatgctcacttacgcttgatatcgtcatcattccgatcgggatggatgaccggacgtttgagatatttggcttcgctcggcaggtaggtgttatgcctggccaaagcccccggcaattgaatgtcgaaaaacacggagataagccgcatggccaccatcagcaccacaatcagcacatcaagcaagacttcggcgggaaaactgacgattccctcgttcactcctttacatacgagtaccgtcaatacgcatccaacggctgaaggcaccgcgtaccaatgcttgtcgcggatcaccatgggcacctcgttgatgagcatgtcacggatgagtccgccgccaagtgccgtgaacatgcccaggaacactgccgtggtgccggacatgtggtacatcatggctttggatgtgccgttgacggcgtaaaggcccaatgccagcgcgtccaatgacagcatggaccatttgagcttgtcgacttcgggataaatgatggctacggccacagctgcgagcagtgcggtgatcaccagccctttgtcggagacgcctgcgggaggaagcgctccgagcagcacatcacgaatgatgccaccacccaatgcggtgagccatgtggtgacgagaatcgcaaaaatatcatagcctttgcgtacggcggcgagcccgccgaccatgccgcagcagaaggtcgccagatattcgatacctatgaagaagccgttgctttccagcgccacttccatggccactccccttccctcacatattttcttttccaaccagctgttaaaaatagcacaatatggggcaagagctgcaataaaagagccggagggcggcacgtacattgtcagaccatgtgaattggcctgaagcacgcgccaccctccggcggccattacagctatatgtcagctaataatcgctaacgggaaaatcagcagaccttccacatccagttgtgtgggtcttcgatctcgccaagctggatgccgagcagctggttgcgcagtgcgagggtgaactcgccggaaccgccgtcggcgacggtcacatcgaacttctcggacttgaagcgaccgatcggggtgatgatggcggcggtaccgcaggcgaacacctcggtgacttcgccggacttgatgtcctcaagcagctggtccagagcgatcatggtctcgaccacgtcgtggccgttgtcctggatgagctggatcagggagcggcgggtcacgcccggcaggatgttgccggtcagggacggggtttccacgtggccgtccttgtgcacgaccatcatgttcatgccgccaagctcctcaaggtaggtcttggtggcggcgtcgacgaagcacacctgctggcagccgtggtcgatgccggtgtactcaccaagcagggatgcggcgtagttgccaccgcacttggcgaaaccagtgccgccagggccggtgcggaaccacttgtcttcaacccagatgctgaccggcttcacaccgcccgggaagtacggtccggacggggaggcaatcacgcaataatccacttcctgcggagcgcgcacgccaaggaacggctcggaagcgaacatgaacggacgcatgtacagcgtgtattcgcgacgggacggaacccaattcacatcgcgcttgacgagggcggcgacagagccgatgaagtcgtcgatcggcagctccggcaggtacagacgcttggcggagttctggaaacgctcggcgttcgcatccggacggaacagccaagtggagccgtcggcgtgacgataggccttcagaccttcgaagcattcctgggcgtaatgcagaacagatgcgcccggatccatcttcagcggcgcgtacggctcgatgcggcggtccgaccagccttcacccttggtccaggtcatgtgggccatgttgtcggagaagacctgaccgaaagccggcttgtcgatgagttcggcgcgcttggcgtcggatgccgggttgtcgttcgggagcacggtgaacttctcggcgagcttgtcaagctccgccgaatcgtgatgattctgttcagtcattctttacttcttctagttgcatcagccacccaaaggcggccagcggttattggtctccggcgcttgtggcgccgggttctggtatgtactctctcacaccataaacgctttcgataaccggcgttcgcgatatgagataacgatcctcataaagcaggaaggggcccatacggaccccttcctcaccggctacctcatgcttgtggagcagccagtatagacaacgatacggctcactcagcgtcagcagccggagcggcctcaaccggtgcggcatcttccggcacctcgacggtgacgacggattcttccggatcctcgacatcgagtacgacgccttccggcagcacgacgtccttggcgaagaccttggaaccatcggtcaggccatcaacgttgaccacgatcttctccggcaggttggcgacatcggcgcggaccttgagctcctggatgtcgacgaatgcgacagcagcgcccttcggggtgccttcgacgaacaccggcacctcgacgtcgatcttctcgccggccttgacctcgtagaaatcgacgtgctcgacgatgcgcttcaccgggttgcgctggacgtccttgacgacggccatcttggtctcgtcaccatacttgatggtgaacagggcgttggtgtgacgcagagccagagtggtctccttcatcggcagctgcacgaaggtcggatcctcgccgccggcgtaaacggtggccgggatgaggttcgcgacgcgcatgcggcgggcagcacccttgccgaactcggtacgagcagcaccttcaagagtgatggtggtagccataatcaatatctccttgatacatcgttcttatgtttcggcgcaccgacgagccgcataaaaaacccaaggagtttcatatcatacgccaagtcgataacggaggcggaacctccctcgccaagacaacagttatctagtatacatggtgcgctgacatttccctgcaatcagaggagcaaggtgcataaaacgcggactatgcgcaaacccacgtacaatcgtagtcagacaagcaccaaccagtggtaaggaatcagaaaatggcaacgacgcatgaccattccgcgctcatccgcaacattcagctcgcgactggcgtcacgaccgtcgcagcgacgggattgttcgcggcgtcagcacatatgctgttccgctttgccatcgacacgcagtggaagcattccattttccatcaggcgctgatcgctccggatcgcgagggaaagatgaaccaaggcgaggccaaagaggccgagcaatggttttccgaaacgaaacagccggtatccatcaccagccgcgatgggcttaagctgcatggctggctcttcgatccggattgcatcgacccgacgccgcatatatatgccatctgcgtgcatggctataccggagcccctgaagaacaagccaaatgggcacaccgctatgcccgcatgggcttcaccgtcctcgcaccatcccaacgggcccaggatctgagcgaaggacgatatgtaggcatgggatggttggagcgcaatgatctgcttgattggatacggctgattgtggatagcgacgatcaagcacgcattctcctattcggaggatccatgggagccacgacggtgatgatgacgaccggcacgccggaactgccacgcaatgtcatcgcggcaatcgccgaaagcggatacacttccgcccgcatggaattcatagacagcgcgcgaggcatgttccacatgccaaagcttctcgcctcggcatgtgtggacgcggcgggtctgatctgcaagcgccgtgccggctatgatttcaccgaagcgtcctgcataccgtcattgcggcatacggtcattccgatgctgttcatccatggaggaaaggaccgcatggtcagcccacgtttcctcgacatgaactacaacgcctgctccagcatcgaccgcgaacgtctgctggttccggacgccgatcatatggaaagctccgccgtggatccgaaacgctactgggacaccgtatacggattcatccgtcgttcattcaagatctgacagccgaaccccaaaaaatataagcggtaatggaaacgcctccggcgaaagatggcgcccctcaccgcccgaagttctcaagacatgcccgatgcccgttccgtcagtgccgttctcccggattgcatatctgcatggcgacgccatcctccataatatggaatccatgcttctcatagaacgtggcattcttgctttcctcaggcataacctcgatatacaggtaatcgtggtaccgctgcttgaccatgccgacaagatgtccggcaatgccgcgcccttggtattcaggatcgaccagcacatagtgcatgtatgccaccatctccgtgtcatcaagcactcgcaccagacccaccagacgttcgccatcccatgcgctgaatacggtggatgaccccatcaacgccttatgcaaccgttcaggatattgaccggacacccagccgactgaaagaaacagtcgctgggtctgttccttggtgaatttcttttcatccgtatatgtgataaccatatggcaagcatagaattgccggtatgaaaccgtctccttctatctttgcatacgaaacacaagtgtctcggccactcccctcatgtatcgaagtgcgcggagcccacgtacataatctgaaagacgtcgacatcgacatcccgctcaacagcatggtcggcatagccggaatctcaggctcaggaaaaagctccctcgcgcttggcgtgctgtacgcggagggatcacgacgctatctggaagcgctatcgacctatacaagaagacgtatgacccaggcaagccgcgcaaccgtcgacgaggtgcgtcatattccggcggcattggcactgcatcagcgtccatcagtgcctggagtccgttccacgttcggcacaatgagcgaactgctcaacagtctgcgcctcctgttctcccggatcggatcgcacgtgtgcgaacactgcggagcacgcaaccaacccacgatgaacgttgccgccgagcttccgatgcattgcacgttctgcggcggactcatgcatccgccatcagcggaggatctcgcattcaacgccgcgggcgcgtgtccgacatgctcaggcaccggaatcatgagggaagtcgaccgttccgccttggtaccggatgagtcgaaaagcattgacgagggagccgtgctgccgtggggatcgttgatgtgggatttgatgaagcaagtatgcggggccatgggagtacgtaccaacgtaccgttcaaccaactcaccgaacaagaacgagatatcgtgttcgccggcccagccatcaagaagcacatcctatacaagccgaaaaaaggcgacgatttcgccgaactcgacttcacgtactacaacgccgtatacaccgtggagaacgccctcaccaaagccaaggacgaaaaagggcttaaacgtgttgcgaggttcctcaaagagcgtccctgcagcgattgcggagggaccagactttccgaacgcgcccgccagccacgtatcagagacatcaatctggctcaggcaaccgcgatgtctctggacgcactcgtttcctgggtagggtccgtgccggaatcgctggaaccacatatgcacaccatggcgagcgccatctgtgaatcgttcctcaatacgtcacggcgtttattggaactcggtctcgggtatctgtccttggaccgcgccggagccacgctgtccaccggcgagcgccaacgcgtgcagcttgcccgcgccgtgcgcaatcgcaccacaggcgtgttatatgtgctggatgagccgtcgattgggttgcatcccgcgaatgtcgacggactgctcggtgtcatgcgtgacctggtggctgatggcaattccgtggtagtggtcgatcatgacactcgggtgctggccgaaaccgattatctcatcgagatggggccaggtgccggcgcaaagggcggtcaggtgattgcgcagggaacggtgccgcaggtgattgatacccgcgaatcgcgcatcgcgccgttccttgcccagggtggcaacgttcatgaccgtgtgcgtgacaacattgacgcccatgaaatcttctccgcaggacgaattcatatggaaaccgaccgtctgcataccgtcggcccgttatcggtagatattccccgtggacggctgaccgccgtaacaggggtatccggttccggcaagacgacgatggtactggagatgttgatgcccgctttgcagtcgcggatcgacaggtcgccgcagccgacgcaggtgcggctcctcgaggcggacggtgtgtccaaggcacatcttatcgatgccacgcctatcggcgcgaacatacgttccaccgtcgctacatattgcggcgtccatgacgatcttcgacgcgcgttcgcaaaaacagatgctgcgcggaccatcggtctgaaagcgggggcattctcctataacactggcaagctgcgttgcgcgacgtgcgacggcacgggatcgatttcgctcgacgtgcagttcctgcctgacgtcgatatcgaatgcccggcatgccatggctcgcggtattccgatgcaatcgccgagctgaagctcccctgcaccgacggagtggcgtattcgatgccgcagttaatgacaatgaccgtcgacgatgccatgcctgtcttacgagatgtcaaaccgatccaaacgaagcttgccacgttgcatgaattgggtttgggctatcttgcgttgggcgagccaactcccgcgctgtcgggcggtgaggcccagcgtttgaaattggccagcgagatggggcggaaacagcatgatgcggtattcgtgttcgatgagccgacaatcggcttgcatccgcttgatgttcgcgtgctgctgcacgtgtttgatgaacttgtagcgaatggcgcgacggtggtcgtcatcgaacatgatttggacgtgattgccaatgcggactatgtggtggatatgggaccgggcggcggtgaagcaggcggacgcgtagtatgcgagggagcgccttctcggatcgccgcatgtccggaaagcgtcactggacgatacctacaatcgtcgcaatgctgatattgtcccatcttcgggcatctgcagtcagtctgatgatgggacaggcagttcccgccatgcttgaagatgatgcagcgcacgtacgatgttgcattgatcaagtaacgtcccttcagcggcgcacatggtgggataccacatgcgatggcggagcgtggcttgtttgccagtacctttgatgagttcgccttcatcagaggcatattgaaaatgcagatgactgagcagtcccccgtgtctgagcacggagcgttcaggcatgggctccatcgcgatgagtacggcgaagggatcggaggcaccggcatcgctagcgtggaacacatagcagggtttgccttccagccccttgtcgtgcacatgatcgagccgatattcatgtgttgtgatgggggtgcgtttttcgtccagccaagtcaggttaaagcctgcgacagcatcatcgtcgccaactgcggacggctgctcgatatgccatccaccaatgcggaatcgccactccttgcccgaggttttgcaggcttttgcccagaagcgtcgcgcatcgccgagcatcatgatcgcgaacagcggcttggatcgcatggctttcgtcgaatccttccaagcccggtcaaggttcgggtcatgattgttgatcaaatgttcgaagctaatccagtctcccagccaatcgttcacattgaagtccatgccagacgatcctcttcttctccctgttcgttatgcagttcgtcttccagcgctatgatgcggtcgcaccatagcgctgcaagctcataatcatgtgttacgaccaacaccgctttgccacggtccgcgagctttcgcagaagtccgccgacttgggtcatatgcaaccggtccagtccgctggtcggttcgtccaaaacaatgaatcgcttatcgctcatcaaagcgcaggctatagccagcctctgcttttgaccgccggataaactcatcgggtggcgctgcacggaatccaataggtcgaggtctcgtagcacagcatcgcatcggtcacgcacagcgtcatccatcccatcaagtcccagtaatgcctcttcccgaacactatcggagaagagctggtaattgacgtcctgcatgacgagaaatccggcacgagtcaaagcgccgcggctcgctttcgtcccattcaatagcaccatgccgttcaacggagcggcaagaccgcataacgtacgtgccaaagtgcttttgccaaccccgttcgaccccataaggccaagaatctcaccctcgtgaatgtcgaaatcgggaatatcacgtgcgaatacgggtgtcttgcggcctagaagtccccgctttgtatggcctacactcaggccgcgcacaccaatgacgacctgtcgcttgtcctcgtcgggcgcaatgcctccatgttggagtttacgatgcacggcaagcctgtatggtctgtcatcgagggcgcgcaatcctaatgccgcgacgcgctgttcggacatcgccagaaaatcggacgcctcatattcaccgagaatcgtaccgtgatcgaacactatgaaacggtccgctaaatccgcgcaccatgcaagacggtgttcggcaatgacgatggtcattccatcagctctcaatcgggagaccatgtcatgcagcctgcgaatcgccaccatatctaaattacttgtcggctcatccataacgatgagtccaggagccagcatggtcgatgccgcgacagcaagctgttgcttctggccacctgaaagcgtcatgatcctacgacctaatagatgcctgatgtgaaactgctccgcgacatcatgcacgcgttgccgaatccgcgcgggagacatgcccgtattctcgcaggggaatgccagctcatcggtggaatcagcattgaaatactgcgtcttcggattctggaatacgctgcccacctgtcccacatagctttccacaggagccaatccggcgcggattccgcacgtcatatggatgccctgcaaatcgccggaatagaaaccaggtatcagaccattgagcaaacgtgtgtacgtggttttgccacagccgctttgtccacataagatggcaatctcgccttgcggtatggcacagctgatgtcattcagcgcatcgacctcagcagcttcatcagcatgatatgcgaatgagcaccgttgcgtccatgcgactatccgattgatatcacttccgatactcaccatgctcctccaatgcccaatgccagaggaaccgtgcagatgaccatccatgcccaatcaatgccatgcatgcggatttcggtatgacatgtatgaggcccgcgaatgccgattcctttggtcagtgcggctacggacaaatcctgggcgacccccgtagcgttcatcaacaacggcatcaggatgtattccaaagactgagccggatgacggagcagggcgaatgtcccctgggcgatgccacgtaatgccatcgcgtcacgaatctgatggtaatcgtcatggattgtcgggaagaaccggatgcacaccacacatggaatcacaatcgtctccggaatgcgcatgcgccgcagggcacacacgaattgactggccgtagtcgtggtgaatgcgtatatgccggcaatcagacaaggcatcatcatccggatgccgacacaaagcaaaccaagcatatgcaaccagctgccgccatcgtcaagcgtcgatgcccaagtccccactagtagcaatacatagatgcaaccgaagcgtaccgcagccgcccatcgtcccgcgccgagcagtggcagaagaagcagcaatactgtaagcgactccacaaccacgtcgacatggaagaacagcaacaggttggccaatgccactaggtacagtttggttcttgggtccagggccatcagatgatgccggtcttcgcaaaatgcttcttcagcatacgctgcccaaaccagcctccgagcaacgcacataccagtaccactatcatggcaatgaaaaacgtgccggtattgacatgtgcgaacacaccatcgatataggacgagtccttgccacgggcctgcagactggccacataggcatccttcatgaaccacaacggcagaatcggaccggtcagcccatagcagaacacgacataactcgccaggatacctgtcttgctccgatagtccccggcgcgagcgatggcatcagcgatgaccggaaacacgatgctcgcagcaagggaaaggatgaaatgtccggatacgaacaagaacaatccgacgacgatgcccatcacgctaatcgcgccgaattttccgaccttggcaaccaggagcatatatacgcaaccacagatcaatgcggcgaccgcaggcagaagaatcatgccgaatcccatcaaagccacggaactgaacagcgtggccacggcgaccagcacgaaatacaaggcagtgaacacacctatcgtgatgagatcgggaatggtcagatgcctcgacttggtcgacatgccctgctgcgtcatggtcagtcctttcgattgtcatgggcggccagccaccaatgtatcgaggaaacacggaaaagacaatagtttttcctcgttttcatggaaaactatccaatccgcgtcgcggtaatccataaaccatccatacccagagacaatgaaacgacgccccgagtcaacgtcctcgctccagtctcagacgacaaggcaatatcccaatgccgcggccatcacaggaaccaccaccgacgtcagcacatatcccacgaacacggtgatccgcccaccgcgcaacaacgtcacggattcgttcatcatggtggagaatgtggagaatccaccaaggaagccggtcgccaacatcacatgcgcgggatccgacagaaaccggcgtgagtacagacctgcaatcacgcctgccaggaatccggcaatactgttgatcacaaaggtcgacaaaggaaatgccttatgccaagaagctttgataacggaatcacaaacataccttgcggcggcgccgagaccaccacacaggcacaccgatacggcgatgaccgcattattcatcagtccgcctccttgcccatggcatggcgatcaccatcgttatgctcagtaccggcaaaccgcagcccgacatgcgcgccaacgtatgccagcagacagcccacgatgaaggtcgtgcaacaatacgccgcacaatccatggctttgccgtcatgcagcatagtgaattcctcgagggcgagagtggacatggtggacaatcctccacacatgcccatgccacatccacggttcacatattccttcgcgcgtcccacggttctgcgggttcctcccagccatgccgaaagcgccgcgtatacgaagcaggcggccatattcgccgcgaatgtgccgatatggaatgcgccgcagtcgggaatgaccgaacaagcgtagcgtaatgcggttccgatgcatcccccaaggaacaccacgcatatgagatcgactcgaatgatatgttgtcgtgccatgtatcttctttccagcgaggtgccgaaccaatatgacagacatggaagaatggcgatgccacaaccgctgaaagccataaggtacagcacaccctatgtcgtaggaaccatcagcgggtttgcggttcgaagcctgtaacggcttcaggcgagtcccatcaccgcagtccagtatatccggcacgcgaggccgtccgtaccatcattcacgatgcggacaacttccccggactaccgcaacgtacgatccataaccgtcgccaatagcgcggcgacccccaaaaccgcaactgtgatgccaatgccgtggagccctccatcagtgaccgtctcaccgaagaacacgccactcaatgaggacgcaccgatagacccgatatagatggacgtgcgcagcagaccagacgacgtgccaatatgctcggatgccgctcggcgatatagcacggtctgactggtcgacatgctgagtcccaacaccagtcccgcgacagcggaggcggtcaacggcaatacgaccatgccagcggatgacgtgcaagccaacaacatgcccaccgccaccatcgccgaacagcacaccatcaacggcaggcgcactatcggcttcttcgcgatggataacgaagccactgtcgccaccacccccatcggaatgatgaacatgccggaaacaccggcgttcatatggcaggcatcctccaaccactggggcaaggcgtacatgaccacataagcgccaagcatggtgagcatcgcacgcagaaaattcaacgtcatcgcattatccgccgcgagtgaacgcacatcgacgaaaggcgttgccgcatgcaactcccacgcgacaaaagccaacaaagcgatgacagtgacgcaaccggacaccttgtcgaaagtaggcaaactcataagaacaatcagcagcgcgctgattgtgatggagaatagcaacagacccatgacatcgagatgcgcgatgaagaaggatacggtcatgcgatgttcatgcttcgcatcgggctcgatgcttgccaatcccagcacaatcgtgatgatgccgaccaacacgttgacgaagaaggtggagcgccatcccaaaaaggtgaccaacaggccgcccaacggtggaccgacagcgatgagcaccagtcccaccatagcgagaatggaaaggaccaacgaaggcggttccgccaatcccatgcgatcagcccgtctgcgaaccagcagcatggcagcaggatagccacaggatgtgcccgcaccaataagcacacgcgacgtcagcagcacgccgagattcggggcgaaaccacccagtagtcctccaatcatgaccaatgccgcaccggccatgaacaccgagcgaggaccaatgatctcagaaagcttacccgccgtcggctgcgcgatggcacatgtcaggtacagcgcagatatcagcagggtcgcccttccggcatcaatccgcaaatcatgtgaaatcggtgcgagcgccgtcgagataagcgtgctgttgacagggttgagaccgaccccaaatatcatcgccatgatgaaggtcttgggaaacgcgggagtttctcttgtcttatcagccgtcttcatcgcgtgtcgcctcccgtcggcagcgattccgtggcggcgatgcgttcgatcaatgtggtcgcagcggcgaggtccccgcgctcgccgtcatccaatgcatattcgatggcatgcgccagccaagttgtttggctagcggttacgtgggcgaggaacgcatgtccttcatcggtcaagccgaccagtcgacgacgacgatctttcgaatcggcatgctgtgtgacataccctgtggacctcagtagttcaagacgctgggtgatggcctgttgcgatacgtgttcgtacgcggccaaagtcgatactgacagttctccctcggtatccagccgcttcaacatggcaagctgcgaagcggtgatgccccgttccgcgatgccggcctcatgcttcatccgagcttgcagcctgctgaccgcaatcgccaattccatggcgacatccgatgtcgaatattcgtctttcgtatccatttcgattgcctccagctggccaccatagcacttacacaagctacttgtgcaatctgcttgcggatttcctcgcatgacgccactcgccgcaaggcttcaaaccgttatcgccctgaacaacaaaaagggccatcccacttttgcaggatggccctccatataagaacaacagacctcaggcaagtttgccgtaggcttcgacatccaccggctcgagccattcgttgctcatggatgccggatcgcccgcagggaccatgaaggctagatgcgagcatgattcgccgggggcggcgccatgccagtgcttcgtatccgcggggatgcagacggcctgcccggccttgagctcctttggctcctgtccctcgatctggcagtagccgcaaccgccgaccgcgatgagtacctgcgccgcgttgtgatggatgtgccagttgttgcggcaacccggctcgaaggtcacgttatggatggcaatctgcggagtctcgagcaccggagcaaggtagctctgtcccacgaagtactgcgcgaagccgtcgttcggttctcccatcgggaatgcgctcggattttccattgtcgacccgtcctttcatttatgctctgtaccgttccctattcaacgcccggcgaaaaagaatgtccaatgtgagtatggtatatcgttccatgcgtcgattgcatatcaaaccattcatgcgaggtattggttctgccaatcgaaacgggatatgctgaccttccgaacatcaacggcagaagagcttcagtatgactgacatgagctacgccccactgggatggtccggcatccaagtttccaaggtctgccttggcggtatgagtttcggcaagacctccccgtaattccatcagtggaccatcgatgccgacgccaccgaacagccgtcagtacaacatggcgctcaccccatactccccatggcgtccggccatctgacccatccgtcctgggattccgattccaaacgcggcaccaccgacggcaccatgcgcaacaagtacgatcaggcacgtgcgcaggatatgccgatcatcgaacgcgtgcacgggctcgcggaacggctcggcgtgccgatggcgcggatcgccctcgcctggcattgggccaaggacgtcacggcaccgatcgtcggctgctcgaagacggagcgcgtggatgatgtcatcgaagcacttggagtaaaactcagcgaatccgacatcgcctatcttgaggagccgtacacggcgcatgaactggtcggcccattggccaggccgggcgagcgcgcgctggccggcacccttgcgccgactctgaaggagaaagccaagtagcgccacacgtcgccggaaagtggctagcgcaccgggatgcagatctcggtcacgaactgggcgggatccgatgtcaacccttcatcgatcaacgcgatctcacgtgagaacccggtgatgtcgagaccctgctctgcggtgtaccatatcagctcgcgataccggtcgggggcatcgccatgactcccccggaaccggatgcgcacgcaatcggtctccggcaatgccacggtgtcgccctcatattcgtcctcgtcgtcaagcaataggaacaccaacccgtaatcggcatatccgccctgttccaacgattccttgtcaatgccgacgccgaccttgccgaggaagaccagcgaatccttctgatgctgctccagcttgcggatcgaatattccaggccgagatacgagtcgaccttcggtgaatccctgatccagacgatcctgcaggcgggttgccgcacaacacgtatcacgtcgaattcggactgctcagcgtcccgcagccgctccaagcgatggtcgatcttccgctggaccatttccagctcatgctgtttgcgctcgatcagggctttctgtgcaacaagcttgtcctcgatgacatgcacgtcgcgattgtgcaggaactcggctatctgcgtcaacggcatatccagcacacgcaggtaccggattgtgttcagcacctcgaactgcttggcaccgtaataccggtacccggtgcgcgggtcgatatattcgggttccagcaagccgcaacgctcataatgccgaagcgtgcccagcgacacattgaacatatctgcaaccttgcctatacggaacagtctgccgtcacccggcaaagcgtcgcgccctccacttcgctcactcgccgtcatgcacgcgccttctccgaaattacgccgtgacgcttgagccacgcgtagaagccaagacagatcagcacggaaagcagcgatccggcgggcgcggcgacgcccatggggaacaaggtgttcgggaacagcttggatgccagatacgccccgggcacacggaccagggtgatggccacgatattgtggatgaatccgatataggagcgcccgcatgcggcgaagaagccgctgaagcagaagtggatgcccgcgaagatgctgtcgacgatgtagctgcggatgtactgtgttcccagcaggattaccgtcgcatcggtggtgaacaggccgacgatggagcccgccgtcagttccaccacaatcgatatgacgatgccgtagacgacggtgatcgcggtggcgtatcgcagtgtcttcgtcgctcgctccatcctgccggcaccgatgttctgcgccgagacggcggataccgtggccagcatggacgacggtaccaggaacaacgcgctgatcaccttttcgacgacgccgacagctgccgcatcgttcaggccacggtagttggcgatgaccgtgatgatgatgaaggcgatctggatgcagccgtcctgaaccgccgtcggcactccgatgccgagaatgccgcggagcatggccctatcggggcgaagatcgccgaacttcagtctgatgcccgtacgccggcggcgaatcgccaccaatgtcacggtcacactgatggcctgcgccagtgtggtgcccaatgccgcgcccgagggaccaagacgcagccagcccataaacaggtagtcgaacacgatgttgcagaagcatgcaaccgcaatgaaatacatggggcttttcgaatcgcccatcccacggaacaccgagctgataatgttgtacgcgacgatgaacgggatgccgatatagcagatggtcagatactgcgcggttccctcgacggcttcgactggcacgccgatcagcgagatgatgttgtgcacgttcaacagcagaacgaccgtcagcgccaacgcgattcctgcgaacagcgtgatgacgttgccgatggccttggccgcacggtcgagcctgttcgcgccgaccgcacggccgatggtgacggtcgcgcccatggcaagacccacgatgaccacggtgagcatgtacagcacctggctgccgttcgccaccgcggtgatgccgtcgatgccgatgaactgtccggcgatgaacagatcggccatgccgtacagcgtctgcaggaaatacgacagcagatacggcaacgcgaaggtgacgatcgttctgaacacgcttcccgttgtcaggttctttcccatgggttgtctcttatcctcccgtttcggcctatgtcttccagcaggaaggctaaaccttacaatggttgtagagtcaatcccaaagcattgtcatgtccaatatgcggaaaaccgtctttcaccccatgaccggagcggtggcttcgtcttccccgtccggctcgtcggcgagacccatgagctctcccatcttgtccgcgtacacgcccgtctcatgcatgagcagggcccgcactgcccgaagcgattcgcgatcccgaggaagacggtacaaggcgatggtcgcggccatttcgccaagcttttcatagttgtccaacatgcgtttgcgatccttgtgcgaagcgagcatcgcatccatgcgatcctccggttcggcgaaaaagatatatccggcaagggtaagcagcagaccagccttcctcacattgcgtgcctggctgtcaagttctttgacaccattctcgaacatggttcgatcacgcagtctgaagccttcctggagaagacccgaagccgacggccccataagggagatggcaaggtcatgcagatagagcgggtctttccatatatcctccacttcatatacgccattgtcctcgatctcggccagtagttgggcgacgggcttagtgttctcatcccacagattccgatatgcctccacaatgtgttcggcgtcatacagatatctggcatcgaggcaagccggatattccaatgagctggtgacgctcagatccacagaacaggcatattccagatccgccttgatccgcatatcctgcaactgggcgcatacatgcctgtatcggaaatcgggatcacatcccaattcgaccactttcggatcatcgcggagcatacacatacccaatcccccataagcgagaaccatcagcgccgcatcagcggccctaggctcgccccctccccatcgcaacagagtgtatgcggccagacggtaggtctgtcgcaggtattccatcatgcattcgagccgtttcctccttccgcctccgctcttcttccccttggtctttttccttcggaacacctcacgtgtatcgaacagaccaagctggaacggcatcctgttgctcggccgatgcgtcgccaccgcgacggaagcatcattaatcatttcatacagccatgcgctcatgccgtatttacgaaccacattgcggcatccggtcaagaattcggcatcatagcctatttggaaccgatccaatatgatcatatccatgtcgaggttcaccggccatgacgtgccgccgaacaagtcatccgcaagctcgtgcaccacgtcatcgaacagggaaagcggaccttccatatcgtgttcgagacgtatccgatcaaggtccgcgaaacaacgccccgagctgtaccggtcgaagcgctcgatcagccgatccatcgtttgcaggaaagcctgttcgtccatattgaatggcgtggccacggcaactgtcatatgcaactccttcgtcgtagagatgcacctactgtcgcatatccgtccacctctccgtcacaatcctttgaaaaaagtgaataagtggacaatttccacctattcacacccccatacctgtctgtggacaacttgcgcaataacaaaaggcccttcctccaaaaagaggaagggcctgatcttcgcgtaggcgacgagccggtccgtcagttgatgagttccttgaccgctgcgatgacggcctgcagactcgccttggcgtcaccaaacagcatctgcgtgttgtcttcgaagtacagctcgttctggatgccggcataaccggtgccacggccacgcttcatgaccaccacgttctgcgccttgtcgacgtcgagaatcggcatgccggaaaccggggtgcccggcttgcgggcggccggattggtcacgtcgttggcgccgaccaccagagccacgttggcctgcgggaactgcggattgatgtcatccaggtcgacgagctcctcatacgggacgttggcctcggcgagtagcacgttcatatggccaggcatacggcctgccaccggatggatggcgtaggagacttcgacaccatggtccttgagcagggtgccaaggtcagcgagctcacgctgggcctgggcctgggccagaccgaagcccggcacgaagatgaccttctctgcgtagacgagctggacggccagatcgtcggcggaggtttccttcatggtgccctccagcccctctccggcgcccgccgcagaattggagccgccgaagccaccagccaagacggacagcagcggacggttcatagccttggacatggcgatggacagggtcacgcccgccgcaccgacgagcgcgccggccacgatcagggcgatgttgttgatggccagaccggacatggccactgcggtgccggtgcaggcgttcaacacggagatgacgaccggcatatcagcgccgccgatcgggatgacgaacacgaggccgtagcacagggcgaacacggtggtcaggatcgaccagagcagacgctggttcggctgcacgcacaacatcacgaaggacacgatggtgagcacgacgaacaggatgttccagaaacccttgcccggcaggctcagcttcttgacccacttgatgccctgcagcttgccggctgcgatcagcgagccggagaaggtgacggagccgatcatgatgcccagacccgcggtgatgagcaccacgatggatggggtttcggcggaggtcaggatgtcgttcaatgccacgagcgcggcggcgccaccgcccacggtgttgaacacggagaccagctgcggcatgtcggtcatcttgaccttcttggcggagaccacgcccgccacggcgccgatgacgatgccgacaatcagcacgatgactgcgacgccatgcttgaaaccgttggaggcctcacctgcgaacagcacgatgaaggccatggccacggcgaacaccatgccgatggcggagaccatgttgcccttgcgggcggtcttcggggagttcatcaggtgcaggccgatgacgaacatcactgcggccagcagatagacgaaccattcgatgacgccgagcggcgtgctcagcatttcggccagggtacccatttacttggcctcctcttccttcttcttgcccttgtcggacttgaacatctccagcatgcggtcggtgacgacgtagccgccgacgacgttcatcgtgcccagcacggcggccaggaagatgaacacccaggcgagcggactggtggcgtgcgcggcgacgatgacgacgcccgcgatgacgatgccgtggatggagttggcgcccgacatcagcggggtgtgcagggtggcgggcaccttgccgatgacctcgacgccgatgagcagcgcgaggacgaacagtgtgatcgcaacgacgatatccattgctttactcctcttccttcttggcttcctcgccgcggccggccacgaccatggcgttgtcgagctcttcgttcaggtcgatggcgagcttgccgtcacgcacgaaatgcgccagcacgtcggccacgttgcggctcagcaggttggatgcggtggtggacacgccgctggccagatacggggcgccgatgatggtcacgccgttgtcggtgacctgggtgccgacggaggagccttcgacgttgccgccaaggtcgcttgccgcgcaatcgacgatgacggcgccacgatgcagaccggccacaccggccttggtcagaaggaccggaggcttgcgtcccggcactttggcggtggtgatgacgatgtcgaagccggcggccttctgatcgaccgctgcctgttgctgggcctgctcttcggcgctcagcgcgcgtgcgtagccgccttcgccctggcccttggagaagtcaagaccaaggtcgaggaacttggcgcccaaggattcgacttcgcccttggatgccggacgcacgtcgtacgcggtgacgacggcgccgagacgcttggcggtgccgatggcctgcaggccggcgataccggcgcccagaataagcaccttggccgggcggatggtgccagcggcggtggtcatcatcggcaggaaggaaccgtacgcgttggctgccacgatggcggccttgtagcccatcacggagttctgcgacgtcatttcgtccatggactgcgcggagctcagctgacgcggcagcttttccatggcgacgccgaccagaccggccttctcgatcgcggcgacgtaatcggcatcggtgaacgatcccaacatgccaatgatccatgtgccctgcttgacgcgggcgagcagctcattgcttggacgatccacaaaacccagcgcgtcggcgcgtgcgatcacatcgtcggcggagacgacctgcgcgcccgccttcgtataatcttcatcaacgtagtgcgatgcgacgcccgcaccggactcaatcagacatgtaacacctgatttacgcaacctcgttacgatatccggtgtcagagcaacacgggactcgtgttcggaagtctcgttgagaactccgaagaccacggtggcttcagctttttcagccataggtgccctttcttcctcgttaaagaaatctaatgaacagatacagcgcccaagtgtaacgtacacggcaacatcgcggccgcaatcgttcatctttcgaatcacgggctgtatccggcatgcgccgcccgtttccctgatggcctgtcaccttacgctaccgtaaggtgacgtgtcgcgcgcgacgggctatcattccttctttagataccgtttatatacgtaggagagtcacgtgtccatcatcacctcgttgaacaagcaggccactaatctcgcaaggaaggcgttgcgcttgggcaacgatttcgtgcacccggtcagcgacgattccggcaatacaccggattacaacgacccgaacagcatcctctcccccgatggccatatcgagctgccgcacaccgctgaatggggaccgggatacccgtccaccacgttccttgaccctgaaaccggactgttgaccacgaagacagagggcaatccgccgctagacgaaggcacctccatctacgatatctacgccgaccgcgccgctcgtatgggcgacgaaccagtgtacacgttcaagcaagatggcgattggcacaccaagaccgcaaatgagacgctcgccgacatccgcgccgtcgcgaagggcttgctgcattatggtttgaagaagggcgatggcgtggctttcatgtgccgcacctcctacgattgggatgtgttcgacgcggccgtcatggcctgcggcggcgtgctcgccacgatttacgataccgattccgccgagcagatccgcaatatcgtcaacaattccgatgcgcgtctgctggtcgtggaaaccactgatatgaaggcgaaggcggacggggccgaaaccgaatgcccgactttggagcacatcgtctgcttcgagaccggtggtcttgacgagatcaaggcgtatggctccggtgtgagcgatgaggcgctcgatgcgcgaatcgattccgtgcagaagaccgatctgtgctccattgtgtacacgtccggttcgaccgccgcgccgaagggcgtggagatgacgcatgagcattattgcgccaccgcgttcaatctgcccgattatatgccggaactgctgcatgacaagaagaacaccgtcctgctgttcctgcctcaggcgcattccttcgcccgtgccatcaactacatctgcgtagcaagcaatctgcatatttatatcgcgcagggcatcaagacattgaccgccgatttgcaggtggccaagccgaccatcatgatcgttgttccgcgtgtgctggagaaggtgtacaacgctgcttcccagaaggccggtcatggcgccaagggcgttgctttcgccgcagccgtggtcgccgcgcagaattatatgaaggaagtcagcaccaaggggaagaccggaacgcttaccaaggcacgtcgcgcggcgttcgatccggtggtctatgcctcgctgcgtgaggtgctcggcggacgcgccaagtggatcgtcgcgggcggtgcgccgcttgatccggagttgttggcgttcttccgtggtgccggcgtgccggtctacgaaggctacggattgaccgaaaccaccgcgccgtgcgcgttcaacgtgcttggcgtgccgtatcatcagggttccgtcggcatcgcgttccctggtttcgagctgcgtatcgccgaggatggggagattcaggtcaagggcgcttcggtgttcccgaagtaccataagaacggcgaggccaccgaggattcctttaccgaggatggctggtacaagaccggcgacttgggccgcattgacgacgatggcttcctgtacatcatcggacgcaagaaggatctcatcatcaccgccggcggcaagaacgtctcccctggcccgatcgaggatgtcatcaagcgttgcgaattcgtctctcaggcgttggtgcttggcgacaagcgtccgttcatctccgcgctgatcacgcttgacgaggaagcgttgcgtccatggctggaaagcaagggtctcaaccgagatatgtcgatggaggaggcctccagcaacgcggccgtccgcgccgaagtccagaagtgggtcgatcaggccaatgagggcgtgtcccgtgccgaatccgtgcgtaagttcatcatcctgccggaggagttcacacaggagaacggtttgatgaccgcttccatgaaggtcatccgtccgaaggtgatcaagcgttacgccaccctgctgaacacgcaaatgtacaccaagaagaagtgaccatccagcaccaacaagcttagagcataagaaagcctgccgcataaacagcggcaggctttattgttcccacccggaaaaaatcagaagcccagcttctcaagctgcttggctgagccgtcaaacgggcagcccagtgggctgaccgtaggcgaagtgagcagcttcgccgcgaagcggatcctaagcggcttagaagcccagcttctcaagctgcttaggatccgactgccatcccttggccaccttgacatgcaggtcgagcttggccttctgcccgacgatgcggttgaccgcggtgcgcagcttcttcttgacgcgtaccagatgctccgcgttatgtccgatgatgatcggcttctgcgaatcacgttccacgtagatcgacacaatcacctgcgccttgcccgcgtaggattcgccgctgtcgttgtcttccggatattcgatggaatccaccaccacggcgagcgaatgcggcagctcgtcatccaattcctccaggaacgcgcctcgaatcagttcggcgatggtgtcttccggacgttcttcggtgatttgctcggccggatacatctgcggtccttcgggcatgttctccaccagcacgttgcgtacttcggcgagattgtcgtgctcgagggcgctcaccggcacaatgtcggtgaagtcggcgaactcgttgatttcgatgagcttgtcgatcaaagcgcttcggtccaattcgtcgattttggtgacgatggcgatcagcggcaccttccatttgaatgtgccgtcgtcgcgtttgacggcgaaatcagaacgcagcctgctcagaatgcgtttgtcgccggggccgatttcctggtcggcgggcagcaggaaggcgatcgcgtcgacatcggatagcgattcgtcgacgacatcgttcagccgctgtccgagcagcgtacgcggacggtggataccgggggtatcgaccagcacgatctgcgcgttgtctgtggtcagaatgccgcggatggccttacgtgtagtctccggacgggatgaggcgatggcgatctgcgtgccgataagcgcgttgatcagcgtcgatttgccgacgttcggacgtccgaccaccgcgacgaagccggaacgatatggaacgggggcttcggcgtcggaatgctgggaagccggttcggtcacatctgcgtcagtcatgcttgtccttggaatccttgtcgtcatgggatgcctcttcggcaccgttcgtatggtcttcgtgttgttcagtttcgtccacgccctcgacgtgggccggttccaccacgatggtggacactttcttgcggcgtcccgcggagtcgaccgcggtcaggcgcaggcccctggtgacggccgtcgaaccgacgatcggcacgcggccaagcagcttggtgagcagaccgtataccgtgtcgacgtcgtcctcgtcgatgtcgatttcgaagatctcctccaagtcggcgatgggcgtgcgtgccggcatgctccatttgttctcgccgatttgttccggatcggcatgctgggtacggtcgtgctcgtcctccagttcgccgacgatctgttcgatggtgtcttcgatggtgaccaggccggcgatgccgccgtattcatccacgacgatagccacatgctggcgggtgcgctgcatctggtggaacaggtcgtcgaccggcttggattcgggcaccagcatcgggtcacggacgatggattcgacatcgcgggatatcgccgcgggattgaacgccgtggcgcgcacggcatccttcaggtatgccacgccgaccagatcatccacatcatcgccgatgaccggtatacgggagaatccggaacgggagcacaatttcagcatgttctccagcgtctccccgcgttcgatgcaaatcatatcagtgcgcggcaccatgatctcacgcgtcaacgtttcggacaacgtcaatacgttgcgcagcatttcggaaacctcagggtcgaaatcattcgcctcgaccagacgatctatggtggcgcgcccttgttcgagttggattttttcaagctcctcatcgtccgacagatcattcgaatgacgtttcgcatccttctgtccgccgattttagcgaatggcgtcaaagccaccgcgaccgacgccgcatcggcatgcttcagcatcagatcgaccggtttggaggcgcccgcgctacgtggacggaccagcagcgaaatcaccgcgaccaccagcgcgaacacgaagccgacaagcagtcccgcccataacggcgcatcgcacaacgacgcgatcgcggcgaccaacacaccgtcaagcacattgcaggtgatgcggaagaacgcgcatgaaccggcggtcgcgtagcggtcggcgatcagccgctgcaccttgtggatgcgtttgatcttcttgtcgcgtatgaattgcgacgcctccgtatccgtctgaatctcaagaatgaggttgttcagacttgccctcgtgacacgtcccaccgcgccttccgtcgcggccatcgacagcgacagccagaccagcagcaatgcgatgacgacgagaatcgcaatcatcgtgatagtcgttgtttccatggttcgtcaacccccactttcgaaaccgtcggatgatgcatcatgccgtcatttggccgttttgccgccggccccgtgttcgcggtcccattcggcgagcgcatccggcgtgccggcgggaagcgtcgcccgcgcgccggctccctgtcgaagcgcgaagaacgtcaatagcagctggcgttgcaagccgaacatctgccgttcctgttcgggtgtgacatggtcgtatccgagcaggtggaggatgccgtggatggtcagcagcatcatttcctccatggtgctgtggccggccgcgagcgcctgctgggcggccacccacgggcatagcacgatgtcgcccagcacgccttccatttcggttccgccgtctccggggcgcagttcgtccattgggaagctcatgacgtcggtggggccttcgaggttcatccaacgcatgtgcagttgggcgatgggatccgggtccacgaacatgatggtcaggtcggattgtgtgctgaccctcatctggctcatgacccatacgccgaggtcggaaaagattttgccgtcgatctgccaggcggtttcgttcgtcacttcaacgctcatttatgcgttttccttgttcttgtcgtcgaatggttgcgatgatgcggcacgcgcgcttctgctgtggtctcccgctatggccgtgtgcctgtcgtaggcggcgacgattttgcccacgagcgcgtggcggaccacgtcttcgggcttcaggtgggcgaaggcgatgtcgtcgatgccgtcgaggatgcgttcgatggtggccagacctgatttcggcacggtcagatccacttgggtcacgtcgccggtgatgaccattttggtgttgaatcccagtcgggtcaggaacatcttcatctgctgttcggtggtgttctgggcctcgtcgaggatcacgaacgcgtcgttgagcgtgcggccgcgcatgtaggcgagcggcgccacttcgatggtgccgtcgtccatgtatcgcttgagctggtccgctccgagcatgtcggacagcgcgtcgtacagcggtcgcaggtacgggtcgaccttttcgttgagcgtgcccggcaggaagccgaggttctcccctgcttcgacggcgggacgggtcagtatgatgcgccggacctgcctgtcttggaaagcacgtaccgctttggctacggcaagataggttttgccggtgcctgccggtccgatggcgaaggtgatggtgtgcgattcgatggcgttgacgtaggctatctgtccggcggttttggcacggaccggtttgccgagcgcgaaggtgatgacgcccggcacgtgaggacgccgcctgtctgcggtttcctcacgatgggacgcgtgcgactgttgcctgccggccatgcgcaattcctccaccacgcggccgtggccgggatgtgtggcgcggaccggatttttaagcacgttctggtcgagcatgcgacggacggtatcggcgtccatcggcgcggtataggcggcttggatgatatcggcaaccacctgttcggcttgggcggcttgggattcggatttgctggaatgcgacatgatggcgatgcggttgccccgtacgatgatggtcagatcggggaacgcacgttcgacttcccgaagcacctcgtccacagggccaagcacggtcaccggatcaagctgttggggtatcgcgatggtgcgtgtagtggtgggcacagaacctcttccgatgtcggtattggcggtatgtggactattcgtcgagcttttcgccggtaagcacgtgggcgtgcacgtggaacacggtctgtccggcgtcgattccggtgttgaagatcagacggaaggcgccatggaactcctggtcggcgattttctgcgccacttcggccatgtgggcgagctgtgccggatcctctttggcgagttcggcgacgttcgcgtagtgcttgcgcggcacgatcagtacgtgcaccttggctttcggattgatgtccttgaaggcgtaggtggcatcgtcctcgtacaccttctcgctgggaatctcacctgcgataatcttgcagaacaggcaatccttgtcgctcataacgctccttatcggtattggaaaaaccttcgctaccatgctacaccagcaggaaacggggcgattccggcaatttcacgcaatggagccgggatcagacgaaacgtcccaatgctcgcgcgagcaatgacagcgcgaccggaccggcggtggacgcacgtaggatgttgcttcccagcacgcacacttcggcgccggctttcgtgaacgcctcgacttcggcgtcgctgatgccgccttccggaccgacgagcacatatatggtgcgcggacgtccgtccttcagacacgtatcggacagtttggcgataccggtttccagttgttcccaggtcttcgtggcatcttgatgcagcacgatcaccatgtcgccatgcacgcatgcgcgcttgcagatggcgaccacctgcttgctggtcacgcaatcgtccagctggggcgtccacgatctgcgcgactgttcggtggcggattccagcacctgcctccactttttgtcagtacgtcctgccttccatttggcgatggaacggtcggcctgccagggaatcacctgatcgacgccgatctgcgtggccatatcgatcgcctgctcgtcatggccggttttggcgagagcctgcaccagcgcgagcctggtgaccggctgcggctccttgccgaatcgcagcacttccgcgattccctgctgcgcgtcgcgcagtacggcgtggatgcgcaatcccctgccgtcggaaagctgcagttcgtcgccgtccttcaatcgcatggcctggatggcgtgcctgcgtacggatgagggaagcgtcagcctccatccggcgttgagctcgtcgctgttcaccggtacgtcgtcatggtccgtatcaagcagaaaaagggcatcagtcatagcttccgagcctatcaggaaccccacataacccatatcggacctatcgcgacacgccaggatttgcatcatggatttcaactgctatagttttcattcgttgccgctgagcaacgcacctgtccgggtggcggaatggtagacgcgctagcttgaggtgctagtgcctattttatacaggcgtgcgggttcaagtcccgctccggacaccggaataaaccccttggagacaaggggttttcttgtatctgacgaaagattggcggaatacgggcaatgcggttcattcatcttgactccatcgacgacgagcgtgtggcggcttatgtgaatctcacggaaatccagctgcgcaacaggctggagcccagcaagggattgttcatcgccgaatcgcccaaagtgatagaccgtgccctggccgctggacgcgagccgatttccctgctggtcgaggagtcgtggatcgacggcatgagcggcatgttcgatgtcatcgagaaacgttggggcgatggcattcccgtgtatgtcgcttcgcctgagcagctcaaacgtctaaccggctaccggctgcatcgcggagcccttgccgcgatgaaacgctggtccctgcccagcgtcgaagaggtctgccgtggcgctcgccgggtcgcggtcatggagaatatcgtcgaccacacgaatgtgggcgctctcatgcgttcggctgcggcgctcgacgtggatgcggtgctcgtcactccgtcctgtggcgacccgttgtaccggcgcgcggcacgcgtgtccatgggcacggtgttccaagtgccgtggacgcgcatcggaggggacgacaagcattattggccgttcaccggcatgcgggaactgcatggtctggggttcaccaccgtagcgatggcgcttgaggatgattccatttctttggccgaattggtccgccgtctcaacaacaccgagactgaaagcgaccatattgacaagctcgcgttgattttcggtaccgaaggagatggactgtcgcaccacaccatctcccgcgccgaccttacggtgaagattcccatgagccacggcgtggacagtctcaatgtcgccgcatcaagcgcggtcgccttctatgcgacgcgtcgagtggaccatcatgcgtgagacgcgcatgaacgcatggtgaaacgttgctgaaacgaactggaaattttcaagactcgcgctgcaaactccttgcgatttgctgaatttatgcaatcatagtgtgcgtaagcggtttcgtgatgaagcggaccgaccgtgcgtacggtgtcgcaagacgctctcagagaggagttcccatggcgaagaacccaaagattctttccatcgtgctggcaggcggtgagggcacccgtctgatgccattgaccagggacagggccaagcctgccgtcccattcggcggcgtgttccgtctgattgattttccgctgagcaatctggtgaattccggctacatgcagacggtcgtgcttacccagtacaagtcccattcgcttgaccgccatatctccactgtatggcgtttctcgccgctgttgggcaactacgtctcccctgtgccggcgcagcagcgtctcggcaagcattggtatctcggctcggccgacgccatctaccagaccatcaacatcattgaggacgtgcagcccgacatcgtggtgattgtcggcgccgaccatgtctatcgcatggatttccagcagatggtgcagcagcacatcgaatccggcgcggaattcaccgttgccggcatccgtcagcccatcagccagtccaaccagttcggtgtgatcgaggtcgatcccgatcatccgaatatgatcaagagcttccaggagaagccgcagaccaccacgggactgccggacgacccgaattccatcctggcctccatgggcaactatgtggccaacaccgatgccttgttcgcggcgctttcgttggatgagaaggccgaggatacgaagcatgatatgggcggcgacatcgcgccgtatttcgcggcacgcaacgaggccggcgtctacgatttcaattccaacgagattccgggagccacaccgaccgaccacgcctactggcgtgacgtgggcacgctgaagcagttctacgatgcgcatatggatctgatctcctatgtgccggagttcaacctgtacaacaccgaatggcctatctacacgctgtccggcaacctgccgccggcgaagttcgtgcatgccggccgcgaccgcctgggccatgccaccgattcgatcgtctcccccggcgtcatcgtttccggcggcgaggtgcaccattccgtcctgtcgccgaacgtgcgcatccattcgtggtctcaggtcgtcgattcgattctgttcgacggtgtggtcgtcaaccgtcgcgcgcgggtctacaaggcgattctcgacaagaacgtcgtgttgacggagaattcaaccgttggcatcgataccgagcatgatttggcgcgtggcttcaccgtcacgccggaaggcatcaccgtggtgccgaagggtaccgtagtcgacgactgacatacgtcgtaatacgaaaggcgcgcttccccgttcgggagacgcgcctttcgtatgttgttccgcttttcttacgtttggcggccgcggttcactgcacggcaaccgcagcaaacgtcagtatttcggcagattgtcgaaattgaagccgagcgcggcgagctggtcacggccttccggcgtgatcttgtccatcgtccaacgaggttgccaggtccagtcgatgcggaattcttcgacgagaccggcgagggtgctggcgcattcgtcttcgatcaggtcggtcagcgggcaggccggcgtggtgagcgtcatcgtgatgatggctcggcccagttcgtcgatttcgatgccgtaaaccagaccaaggtcgatgacgtcgatgccgagttccgggtcgatgacctggtgcagggcttctttcacgtcagctgccgtggcacgtccgatatcgtcgacggctttcagcggaatgtcgtcatcctgcggttgggagcatccgcacgcgtcggcatgattaccgcagccgcaagtgtcctgcccgtcttttttagattccttgttcaccggcttgccgtccttgaaccctttggccaggttcggattgagcatgacgcgacgggccgcgtcctcatcgttgcccaaggccttggtcacggaatcgaagatcgacgcctgcggttcgggtaccagggtgtcgctcattgtctctccaaactgttgatggacgttgcttgtatctgttgagcaagaatagcgcgtcgcttggggtttgtcactagtgtttttccaaacgccgagttgaaggctcaggctttcgcggccagagccttggccacggcgtccttcatgccctcccagccgagcagcgcgcatttgatgcgcatcggatactgggagaccccttggaagacgatgccgtcctccaaggattcctcggcctgttcgtcattcagtcctttgccgcgtgactccataagcttatggaaggtttcggcgagtttcatggcctcgtccacggttttgccttcgacgagatcgaccatgacggacaggctggcttgggagatggagcatccgtggccatcccatacgagccgttcgatggtgtatggcccggcatcggagacttcggcatggatggtggcctcgtcaccacaggtcgggttgaattggtgcgattctcccggcgtgcagtattcgtggctggcctgcaccgtggtttcggcggcatgcgaggcgttttccgaagcgaggtcaggtgcgaaatgctccttgccgtgcgggttcttcgcggcttcgaggatgacttcctggtacatctgctcaaggtcgcttccggacatctcaaaatcactcatatttcgttactcaactccaaagaacggacgaactttgccgagcgcctcgatgagggcctgtgcgtcttcgaccgaattgtagatgccgctggacgcgcggttggaggcatacacgccgaagtggcggtgcaccggctgcgcgcagtggtgtccgacgcggatggcgatgccctgcgcgtcgatgaactggccgacgtcgtgcgggtgcacgccttcgacttcgaacgcgacggtaccgatgcgctccttgttggagcggggtccgaggattcggatgccgtcgatatcgcccattttgagcagttcgtcggtgatggtgcgttcgtgcgcctcgagcttttccatgccgatgttcatcagccattcggcggcgacaccggcggcgacgacctgtgccaccggctgcgtgcccgcttcgaatcgtgcgggaggctccatgtactgggcttcctggtccatccaggcaagctccaccatggatccgccgaaattggccggaggcaatgcctcaagcatttcacgcttgccatagaggaatccgacgccggtcgggccatacattttgtgggcgctccatgcggcgaagtcgacgtccaaagcgtggaaatccactttgaggtgcggcacggactggcatgcgtcaagcacgaacacggcacccacctcgtgggcgcggcggataatcggcgcgatgtcggtaatcgctcctgtggtattgcccacatgcgtgacggcaacgatcttcgtgcggtcggtgattacttcgtccgcggtgtcggaacgcacacggccttcctcgtccaagtcgaaccatttgagcgtggcgccggtgcgcagcgcaagttcctggaacggcagcagcacggaatggtgttccgccttggtgacgacgatctcatcgcccggtttcaacgcgaaacgcttggcggtctctcccccgcgtccaagcgacgcgttgccgaatgcggtggccaacaggttcagtcctgcggtggcgccggcggtgacgacgatctcctcttcgccttccgccgaattggcgccaaccagcttggccactttggcgcgcgcatcctcgaacgccatggtgctacgcgcggcaagctcatgcgcgcctcggtgcactccggcgttgatggtgcggtagaagtccgattccgcgtcgatcacgcactgcggcttctgcgatgtcgcggcggaatcgaggtataccagcggatggccgtggatttcctggtcgagaatcggaaattggctgcggatcgctgcgaaatcggtcatgccaatgcgctttccgaatcggagccttccggcaggtatgcgtcgtagccggtctcctcaagctcgtcggcgagttccggaccgccggtcttgatgaagtggccgtcggtgaacacgtgcacgatgtccggcttgatgtaacgcaggatgcgggtgtagtgggtgaccatgaggatgccgaactggttggcttccttggcacggttcacaccttcggaaacgatgcgcagcgcgtcgacgtcgaggccggagtcggtttcgtcgaggatggcgaacttcggcttgagcagttcgagctgcagcacttccgcgcgcttcttctcaccgccggagaagccttcgttcacggaacgggtggcgaacttcgggtccatcttgagccgcttcatggcttcggacagttccttcgtccatgtacggatggccggcgccttgccgtccacttcggttttggcggtgcgcaggaagttggtcatggacacgcccggcacttcgaccgggtactgcatggccaggaagatgcccgccttggctcgctcgtccggggtcatcttgaggatgtcctcgccgtcgagcagcacctggccggagtcgacgatgtacttcgggtggccggccagcgtgtatgccagggtggatttgccggaaccgttggggcccatgatggcatgggtttcaccggagttgacggtcaggttcacgcctttgagaatcggcttgatgccgtccttggtttcgacgtgcgcgtacagatctttgatttcaagggttgacatggtttctcctgacgattatttctcttccaatacctgtgcgatcgcgtcgctttcgccgcgggccaggcgcttgtcgatgacgttcataagatgctcggaaatcgccggaatgccgatttcctcgacgagctcgccgaagaagccacgcaccacgagcttgcgtgcctcgttttccgagatgccgcgcgattcgaggtagaacagctcttcgtcgtcgaatcgtccgacggatgaggcgtggccggcaccgatgatgttgccgttttcgatttccagattcggctcggaatcggcgatggcacctggggtgagcaccagattgcggttgagctcgtaggagtcggtgcccggcgcggtaggctcgatcagcgcgttgccgacccatgtggagtgcgctcccttgccgtcgagcgcgcccttgtagaccacgcggctcttgcattcgggatggttatgcaccaccatcgtgcggtgttcgatatgctcgcccgggtccacgaagtagatgccgagcatgttgaggtcgccctgttcgccgccgaagtcctggtccatgcgaatgcgcacgacatcaccaccgagggtgaccacggaatggcgcaggaacgcctcctcgcccacgtggatgcgctggttgccgacgtgtttggagtccttgttccattcctggatgaaggtggtggaaatgtgggagtccttgcctgtggtgatttccacgccttcggcgagacgtgcgtcgccgtcatgttcgacgaccacgtcggcatgggcgcggtcggctgcgatgatcgacaggtggaacgcgtcgaggtccctgccggtgccatgcattttgacgagcaccggctggtcgatctcaccgtcgatggtcagtattccagcgcgtttgccggaattccattcgactgcggacacacggtcgttcggcttggagacgatgcctgtgccggtgtcccccaccgtgccttcggcatacgtgacgccttcggcaagcggcgacccgtcgatcatggaaacggtgacctgcgtttcattggatggttcgaacacatcgaagaactcctcgatgcgctctatcggcgtgtagcgccagtcctcctgtttgcggtccggcttggcgaacgcttcgatgtcgaatgagcgtggagcgcggtccgcggacgacggcatggccgccgggttcgcgtacggatcggacggatccgcgacggggatattgatttcctgagtttgtgccatggtgatcagcccaccgacccttccatctgcaattccaccaaacggttcaattcgagcgcgtattccatcggcagctcgcgactgatcggttcgacgaagccgcgcacgatcatgcccatggcctcgtcttcggacaggccgcggctcatcagatagaacagctggtcttcagagaccttggaaacggtggcctcatgcgccatggagacgttgtcctcacgcacatccacatgcgggtacgtgtcggaacggctgaattcgtcgacgagcaaagcgtcgcagaccgtcgaattggaggacccttccgcgcccttgacgattttgacgaggccacggtatgcggaacgtccgccgccacgggaaatcgacttcgccacgatggtggagctggtatgcggggcgaggtgaatcatcttcgcgcccgtgtcctgatattggcccttgcctgcgaaacccaacgacatggtgctggccttcgcgtacggctcggcgaggatgcatgccggatacttcatggtggctttcgagccgatgttgccgtcgacccattccatggtgccgccctcacgcacgtaggcgcgctgcgtcaccagattgtacacgttgttcgaccagttctgcacagtggtgtaacgcacacgggcatgcggttcgacaaagatctccacaacaccggaatgcagcgagtcggtggagtagatcggcgcggtgcagccttccacgtaatgcacgtaggagccttcatcagcgatgatcagcgtgcgctcgaactggcccatattcggcgtgttgatgcggaagtaggcctgcagcgggatgtccacgtgcacacccttcggcacgtatacgaacgagccgcccgaccatgcggcggtgttcaatgccgagaatttgttgtcgttgctcggaatgcatttgccgaaatacttcttgacgagttccgggtacttttgcacggcggtgtcggtgtcgacgaagatgacgccctgctcctcaaggtccttctggattgaattgtagatgacctcggactcgtactgcgcggcgacgccggagacgagtctgcttttctccgcttccggaatgccgagcttgtcgtacgtggagcggatctcgtcgggcagttcctcccaggtggtggcctgcttgtcgatcggcttgacgtagtacttgaaatcgtcggcgtcgaagtccttcaaatcgacgccccactgcggcattggacggtcgatgaaatcgcgatacccttccaatcgcttttccagcatccattccggctcgtgtttgtcggcggagatggcacgcacgacgttctcgtcgatgcctttcttcgccgcctcgccggcgaagtccgtatcgtgccagccgtagttgtagtcaccgaattgctcgataatctcgtcatcctgcttgatcttgtcttcgttcacgcgcgtgcgatcagccacatactggctcatctccacgtcggccgcggcgttggacgcttggttctctgccaccgtacgctgcctccattcactcattgatacctatgacaacctaacagaacacacagcgaaacactagaccttattcgaaattcgacagtattcgcccgtgatttgccttacaaaaaagcggaagaccatgcagattcggtcttccgctttgcgatgaatcgagcttatgcgctcaaatcgtctcagcgcgcctgctggtggtccagagcggccttgaccagacccgcgaacagcggatgcggcttggttggacgggacttgaattccggatgggcctgggtggccacgtagaacggatgcacctcgcgcggcagttcgacgaattcggtgagttcgccgtcagggctctggccggagatgaccagaccaccttcgcgcagacgatccttgtaggccacgttcacctcgtaacggtggcggtggcgttcggtgacatgcgtggtgccgtacagttcggcgacaatggagccttcctccagttccgccgggtaggagcccagacgcatggtgtgacccatgtcgcccttgccggcgacgatgtccttctgctcttccatggtggcgatgaccgggttggcgcaatccggatcgaattcggaggagttcgcgtcggtgatgccgaggacatcgcgtgcgtattcgatgaccatggactgcagaccgaggcacaggccgagggccggcagcttgtgctcgcgggcgtaacgcagggcgccgatcttgccgtcgatgccacggatgccgaagccgcccggaatcacgatgccgtcgacctggtcgagggccgccgcggcgccttcttcggtggcgcacttgtcggcggccacccacttgacgttgaccttggcccagttggcgaagccgccggccttgatggcctcggtgacggacaggtaggcgtccggcaggtcaatgtacttgccgacgatggccacgttgacctcgtgcttcggatggtgcacgcgttcgagcaggtcctcccactcgtcccagtcgacgtcatggaacggcaggccgagttcacgcaccacgtaggcgtcgaggccttcgtcgaacagggtcttcggcacgtcgtagatgctcggagcgtccacgcagttgacgacgccttcggagtccacgtcgcacatcagggagatcttgtccttgatggactggttgagcggccggtcggaacgcagcacgagcgcgtccggggagatgccgagctggcgcagcatcatgacggaatgctgggtcggcttggtcttgagctcatgcgcggcggcgatgtacggcaccagggagacgtgcacgaacatgcagttttcggcgcccaggtcgcggcgtacttcacgagcggcctccaggaacggctgggattcaatgtcgccgacggtgccgccgatttcggtgatgatcacgtcgacgtcatcggacgcctgcgcgcgcatacgggacttgatttcgttggtgatgtgagggatgacctgcacgcactggccgaggtattcgccggcgcgttccttgcgcagcacctcctgatagatctggccggtggtgacgttggccttctggctcaggtacacgtcgaggaaacgctcgtagtggccgatgtcgagatcggtttccgcgccatcttcggtgacatagacctcaccgtgctggaaaggattcatcgtgcccggatccacgttgatgtacggatcgagcttctgctgcaaaaccttgatgccgcggctacggagcaggcgtccaagggaggaggcggtcaggcctttgccaagggaggacactacgccgccggtgacgaaaatatgcttggtgacgtgttcttgagaattgccatgttgtcttctaaccatggaacttcagtctatcagcggcgcaagacgcggcgtgttccatcgtgatacgaaaaggcgggaccgcattgctccgcggtcccgcctttcggaaattcaggaaatacagtcagacgattgcgattttatcggtcgccggcctccttcctgcggaggacgatcaacacgcccgccgcaacggcgagcaccatgacggccaaggcgattccggcgacgttggagcctgttgccgggctctgcgccgcgtttttctccgcgtcttcctttgtattgtcggccttgccgttgatcttgccattggcattgccattgttcttatcggcggccggggtgacggcctgcttctggacgtgcaccgtgcgggtgaaggtcgtggtcttgccacgggagttggtcacggagtagaccagcttgtagtcaccgaccttattggcgtccacggtgccctcgaccttgatcttgtcggtcagatcgccgtcgatgtcgtcggtggcggagacgcccgccatcggatcgaacttggaaccgacggtgatggtcgtcgactcgttcacaccgctaatcacgggaacgacgtcgtcggcggaggcgaccttgagcacggtggcggacagtgcgccagcggtgtatgcggagcccttgcggacggtgacgctcttgacatcatcgtcgccgtacacggtgccgtttgcggcgagcacctcgtacttgccggcctcgacgccatcgatggcggcggcatcgttgttggcgttgaagatcaccacgtaggtgccgctggagtccttcgcctgataggccacgacaccgttggcggacttgagcatggtcacgctggcgttgatgtcgttgtagctggtctggcggagggcagcgatcctgttgcgcagcttgatcaggcccctgacgtagtcgacggagccggagtactgcgtggtgcgatcccagtcgatggcgttcacctcgtcaccggcgttatagctgttgtcgttgccgcccttggtgcgcaggaactcctggcccagctggatggccgggatgccttcggacaggtagaccacggaatcggcgagcttggcgcgcgcctcggtggtggcctcgtcatccgtgggcacggacttcctgagcttgtcgtacagggtcatgttgtcgtggatctcggcgtagttcaccacctgaccggcatccgcgtagtggtcctgcgcattgccgttccagcaggtggtgatggcgtcggcgtcgtactggcagccgagcacgttgtgggcgatgaggctttcctgatcggccttgccggagacgaaaccggtgtcggtgtcggagaacacggaacccttgaggccgtcgcggatcgagtcgttgaagaacgcgatgccgttgttggtgccgtccgaagcgacctggtaggcgtttggctggatggtcatctcgctcttgtccatcgtggagttcatgtcccagccttcgccgagcacgatgatggacggatcgatcttgtcgagggcagcacgaacctcctgcatcgtcttggtgtcgatcagacccatgaggtcgaatcggaagccgtcgatgttgtagttcttcgcccagtaggtcaccgagtcgacgatgtacttgcgcatcatcgcacgttcggaggcggtgtcgttgccgcaaccggagtcgttgacgagcgaaccgttgtcgtcatagcggaagtagtagcccgggaccgtcttgttgaacgaatggttcgcggcattgtggacgtggttgtacaccacatccatgatgacgcggatgttgttcttgtgcaggcccttgaccatctgcttcatttcggtgacgcgggagctcgggttgctcggatcggaggagtacgagccttccggcacgttgtagttctccgggtcgtagccccagttctgcgcgccatcggcgttgtagctcaggtcgccggtctcgttgacggaaccgtagtcgtacatcggcatgatctgcacgtgggtgacgcccagcgacttgagatagtcgaggccggaggtcgcgcccttggcggtcttcgtgccggattcgaccacgcccaggtacttgccctgcttgtcggcggagatgccggaggccgggttgatggagaagtcgcggatgttcatctcggcgatggaggcgtcggtggtcttgccgaaggccggcatgcgcttgcccgccttgcccatggccttcttggagagcactacggagcgctcgccgttggcgacggccgcggtggcgtacggatcggcggaggtgttcaccgtgccgtcggcgaaggtgagcctgtaggagtacgcggtgccggaggcaagcttcttcaccgtggcgctccacacgcccttgctttcgcttgtcatgtcgatggtctgatcgatctcggcattcgggtcggcggacttgtaggtgatgagctcgaccttggcggcggtcggcgcccacaccttgaagccggtctgcttcttggtgaaggtcgcgcccagatcctcgccgctgtaggcgtacttcttgtcgaaggcgtcggtgcggaccaccgaaccggcgatggcgttctgggagccgaagcccttgatctcgacggtgtacttgccgcgaacgtccagatccttgtcggcggtgatgatcaccttggtgccgtcggccttgagactcttgacatcgacggctttgccgtcggcgtccgtgacggtgaccttgcctttcaggtcatccgtggagaccttcttggaaagcttggcggacagctggttggtgccggagatctcggcggacttcatggtcgcgccgagggacgggcgggaggtatacaccgtggcgtcgccgccgagcagccacacttcggcagaggcgttgccgtcggcgtcgaacacgagcgcgttggacgggatcctgtgatcggcgtcgtccgggtccttggccttccacgcgtccttaccgtaacggcgcagcatgccgatatcggaagcgccgtcgttgttgtagtaggtgtagttggtgaaggagtactccgcgatctcgccccaatcgtcatgggtggtgaaggtggcggcaccgccgttccaattggatgcccaggtccagatatcccactgcggcacagtggtgctggtgtcctcggcgttgtagtacaggccgtcgtctcggttgtagtgcaccttcaccttgacggtgttggccttgcaggcgtaatcggccggtgccgaatcaagcgtctcgacagtggtcgcctcgccctggtccgggtacttggtgccgtcgatccacacctcggcggtgccgtcggcgctcacggtggcgctacggtcagcgccatacttgttccaatcgctggtggtgacgaggaagccgaacttgtcgtacttgccgtcgaaattgagcacggcgaccttgccccagcagtcagtgccggtgaaggcgtggtgcttggcgtccatgttgccgccgttcacatcggtgccccacacgtacacgccgcggttgtccgaggcgctggagggcttgtagtgcacgacgagacgggtcttggcgccgatggattcggggttgccgacggttgcggcctgatcgctcacgcccacatgggtgatgccgacgttggcatggtagttgccgccgcccttcgggttctcccaaccatcggtgtccttgtcgtggaacacgaagtcgatcgccttgcccttggtgttgatggtggcggtgtagtaaccctgcgcgtcgagggtcatgtcggcttccggctgctcccaatcgttgccgaggccgtaatggaccttcggggtcttccactcagagttggcgggcttgtagtagatggtgacgcttctgtcgtcgggcagggcgtcatcctcctcctggctcacgtcgggatcggacggatcggtggcggcggaggctgcggggtgcgaggccttggtagcaccggcatacagggcgatggcggagtgcgccggcaccgtggtctcgaccttgccacccttgacggtcacggtcttggagcagtccatggtggcgtacacgttgcagtattcgccgtcggcgagggatgtcgtgtaggaggcgtccttgtccttcttgccgttgttgatggcgatgaagcccttggctccgcgggagaaggcgatgttgtcgccgccgtcatcctgccaatcggcgaccttggtgccgttgacatagttgcggaaggcgatcatgccgcgggtggaggtccagcgctgctcgcagttccaatcggaatcgttggtggagcatgccttgtccatatccacgtcgggcacggaggtcgcggtcgctccgggtgcaccattgtcgttgacgtcccacttgtagtcggagagcaggcgcggggtgccgtagtcgtaggccagcatgaacgcgttggccagctggtacttggcgccgtccttgtaggtcagcgcaccctcgttgcgggcggtgtcccagttggtgacgaacacgttggcgtcatcggaggagagatccttgctcaggcgatcgctcagccccttgaggttggcgatcttgtccttgaaggtctggttcatctcggatttgaagccgaattcggtcacggtgccgttctgcacgtagttgctcggctggatgcccgcggcctcggaggcgttgccgatgacctcctgaatccagtagatgtcgttggcgttcttgccgattttcttggcgaacttctccttgatggccttcatgctgtcagtgtggatgtgcttgacggcatccatgcggaagccgcgcacgccggcgttccacagcgaggctaggtagtcggactggatgtcctgcaccttctcgctttcggagttgaaatcccacatggagctcaggcggcattcctgaacttccttctgattggtgtagtcggagatgttcttggtgcagctgtggaagtcggcggcggtgatgccgtccgggtactgcttggtggcgaagcccgggtagctgccggtggagccgttgtattcgctgccggccacgcccttctggtctccggcggccacgtcggcgccggtggtctggttgagcaccacgtcggcgatgatgcccacgcctgccgcggagcactgctgaaccatgttcttgaattcggcttccgtgcccagcttggagtcgagcttgtagctcacaggctggtagctggtccaccactgcgtgccttggatggattcctgcggaggcgagacctccacataggccacaccttccggaccataggtgttggtgcattccttggcgatcgtgttccacgtctgctggaacgcaatcacctggacatctttctgttgattggcctgcgttttggattgcgcctgggccacgatcggtgccgcgaccaacgaagcgcacgccatggccgcggtgacgcccatcgccaccacacggcctaatggacggtttgtttgaacgaccatcgttctccgttctcatctgtgaggccggttcaagcgcccatggcaggcgccgcgaccggcaacgtatgcgccatggacatccgcatccacgcggatgattcagaatccactcgacgatgaatatgcatacgtttacactctgaatcagagttaattgtatgtcaatggctgcgcgtggcaatgaaacagcgtgaccctctgctgcacatgcacttcatatatgccgaagtgcaacctgttgctgcaatcaaaatttttttctgcaagtcaagcagaaaacattcagaaatagctgcaaaaaacagcaaacgattgcaatcattgtctcacggtatacggtgtcgcggcgatatggaaggccactgcactaccggcaggaaccgtcagtgtggcatccccgtcgaaacgcacatgcacgctgccggaacagtcggcggaagcgtagacatcgcaatactcccctgccggcaaagccgtgtggtacgtcacagtacgtgtgcgcacggaattgttgatggcgatgaaggcacgtccccctcgaccgaaggcgatcatgttgtcgccgtcatcctgccaatcggagagcggcgcgtcgcctgcgacattatgccagccgaccataccgtgcacgtcaggccagcgttcggtgcagctccagccggagtctttggagcagtcaatatcgggcacgctggtcgcagtggcgcctgaagctcccgagtcggtgtcatggaattcgtatccggagaacacgttgggggcgccatacgggtaggccagcatgaacgcgttcgctagccggtaggcgtcgccgtccttgtaggtgagcgtcatgttgttgcgttcggtatcccaattcgtcacgaatacgctggccttgccactgtcggtgatgttctgcggaatgtctttgatcgacaggcttccgcctgccagcgagttggagaacagggacttaagccgatatgcgtactggaattcgttcacctggccggttttgagatagttcctcggttggatttcggcggcttccgcattgtcgccaatcacttcctgcgtccaccagatgtcgttcatggaacgtccggatttcttcgcaacgagtttcttgatggccagcacgtcttccggaggcatgtgtttgacggcatccacgcggaatccggcgacgccgtagtcgagaagcttcacaaaatagtcagacagcacgtcgcgcacgtgcgggcttgatgtatcaaggtcctgcaaacccgatacctggcagttccacacgctttcggcgtcgcggtacgtccagatagaacagggggcatggaagtccgatggcgtgtatccggcttcagggaaatagcctttattgtcgtaggggcttccggcggtgccggtcccttgtgttttgtcgacgccggtggtgtggttgatgaccgtatccgcgatcacgccgacgcccgcggccttgcattgccggaccatgttcttaaattcagcttcggtgccttctttggagtcaagtttgtagcttaccggctgatagctcgtccaccactgcgtgccttggatgctttcctgcggcggcgagacctgtacgtagccgacgccttcgggtcccagcacttcgccgcattcgcgggcgacggatttccaattggcttggaacatggtcacgatcacgtcgctgcggtatcgcgcaggattgaaacgttccccgccgccttcacgtgtcggcacgtgaagcgtggcgactgagacaccgaccgataccgcgacgcatacgaccgccgtaatgacacgtgtgattcttcttgcgattgcgcccatagtcatcgacctcttcgtcacttcgccatgctcccggtttgcatacgtttgcaatatcactgtataccaatccggggagaccgggatatgcgtcatcctcattggcacgaaaaagccggatgccttaaagacaggcatccggctgaatccatgacggaatgtcgatgtcagcgttcttccaacaagtgcgcaaccgcttcgattgccagcttgtagccatagaatcccatgccggtgatggtgccggtggccaccggagagatcacggaacgcttgcggaactcgtcgcgtgcggacgggttggagatatgcacctccataagcggcagtccctcgtcgatcaccatgtgcgcggcgtccgccaaaccataggagtaatgcgtgaaagccgccggattcatcacgatcggcgttttctcgtccgcggcctgatgcatccaatgaatcatctcggcctcgtcgtcgctttgacgcacttccacgtcaagccccagttcatgaccccattcggtgcacagtttgcgcagggtctcaagatcctgcttgccgtacacgtcgggctggcgcactccgagacggccgaggttcggtccgttgacaaccactactttggtcatattgcttccttttgtgttcgttcttgcgattgcgtcctaccgctggatgcgtcggaacgcctcctcgacggcgtccgccggcggatcctcgaggtggatgggatggccgagcgagccgagtatgacgaaacgcagtttgttgccgcgggccttcttgtctcggtgcatgagcgccagcacatcatcccagctgccattgttccatgatgtcggcaggccgagcgagccgagcagcgaacgatggtagtcgaccagatcctggtcgatgtagccgagcagatgggacagttcggccgcatagacgcaaccgacggcgacggcgttgccgtgcctccagcggaagtgttcgagtttttcgatggcatggccaagcgtatgtccgtagttgaggaattcacgcaatccggcttctttgaggtcggcggacacatggtacgccttcaccgtcacggtacgttcgatgagttcggcgaccacatccttcagatcggagtcaaggaacgtcgaaccgtcgaacgagcgcagctcgtcggcatggtcttcaagcatgcgcagaatctccggatccatgatgaaaccggatttcgccacttcgcccagaccttcgatgaagatgtcgttcggcaacgaggcaagtgctcccatgtcggcgagcacgccggccggcgtatagaacgagccgacgaggttcttgccttgtggagtgttgatgccggttttgccgccggtggaggcgtcgaccatggccagcagcgaggtcgggcagttgacgtagcggatgccacgcatccatgtggcggccacgaaaccggccagatcggtggctgcaccaccgccgagaccgacaatcgcatcagaacgggtgaagccttcctcccccagacgctgccagatgccgttggccacttcgatggtcttgccggcttcagcatcgggaatgacgatgtcgtgcacgtcataaccggactggcgcaacagcgtgcgcgcgcggtcggaatgccgttgcaccgcctgggtgtgaatcaatgccactttggcaggcttgtcccccagcacctgcgcaagctggctcatcacaccttcgcctatgcacacatcgtatggttcgatggtggatccggtgacgtggacgatacgttgatcgatcatttccatcagctttctcgcggccacttgcggggtttgtccgtgggtgcgcacctgcacattggccacgcgtctgaacaccgggtcgcgttccttgtacaacttcttccaacgctcgttggcgtcgccgttgagcatcggacggccgccgccgcggttggcgcgttccatggcttccttcggatcggccatcaaatacacgaccttgccgccgtcggcgatgtattcggcgagcccctgctggatggacggggtcattggagcgcccccgcccaaggagaagatgccgtcgaaatcctccagcatgtcaagcacaacgtcgctttccagcttacggaactccggttcgccgtacctttcgaaatattcgggaatcttcattcccgcatcatgttcgatctcgttgtcggcgtcggcgaacggcagttgcatcatctgcgccgcttccttgccgacgcgggtcttgcccgcgcccatcatgccgatgatgacggcgacgggtctacgcattccagccatcgaatcggtcacctcatgtgctccggccaggacgccacataggattcggcgttgcgcttggtttcggccacgctgtcgccgccgaacttctccagcacgtattgagcgatggtgaggcgcaccatcgcctcggccacgacggccgccgcgggaacggcggtgttgtcggaacgctggttgatggcctgggccgcctcgccggtggtgacgtcgacggtgcgaagcgcctttggaatggatggaatcggcttcatcgcggcacgcaccacaatcggctggccgttggacatgccgccttcgattccgcccgcacgattgctcagacgtgtgatgcggccatcgtcgccaaccaccatttcgtcgtgcgcctgggagccgggacgcatcgcctcaaggaaaccgtccccgatctccacgcccttgatggcctggacgcccatgacggcactggccaatgccgcgtccagcctgcggtccgattcaacgtacgtgccgattccagccggaacgccgtataccacgacctcgatcacgccgcctaaggtatcggcgttctccttggcctcgtcgatgcgtgcgatcatctgctgttcggccgtcttatccaatgtgcgcaccggcgaagcgtccaatgcttcgaggtcctcaggcttcggcagcaccgcattctgcgggtcggtgatgccagcaccaccgattgacagcacatgggagacggtacgtatgcccaacgtctgttcaaggaactgcttggcgacctcacctaaggccacacgcgacgcggtctcacgtgcgctggaacgttccagcactggacgggcgtcgtcgaaaccgtacttgcgcatgccagtcagatcggcatgccccggacggggacgggatagcggcgcgttgcggccttcgcgcggaatgtcatggtcaagcggatcggcgctcatcacctcggtccatttcggccattcggtattggcgatctcgatggcgacgggagagccgatggtctcgccgaaacgcacaccggtgagcatgcggaccttgtcctgttcgaatttcatgcgcgcaccacggccatatccgagacgtcggcgtgccaatgcgccgacgatatcctcagtagtgacgtggatgcccgcaggcagcccctcgatcatggcgacaagcgcttcgccgtgcgattcacctgctgtctgccagcgcaacatgccaacactccttttctgccaaatacgattcgtggactatcttaacggtatgtggtacatgatttgcctgccgagtctgctctgtggaatggccgtcagcgttgaggatatccgggcacgacgcattccacgcatgtggatcgccgtagggtgtttggcgcaggtcattgtggacatcacgtatgcgttgtccgttaattcactgtttctggcattgcaggctctgttgttcgccgcgttatccgccgtgctgcaatgtgcgcttgcgctcatcaagccaggggctttgggattcggcgacgtcaccacgacgttgcttatcggcttggccgtaggcatgttcggcctgtttccagtggtgttctggtggtttgcgattagtgtgctggggctgctgtggcttgcgatttggacacggttcgacccgcagaagcatacgcgattcgccggtaagacgccgttcgccccgaccattgtcgtggccggggcgataagcatcgcgatgcacgcgttgtgttaatgcgtaataccgtcagttggcattcgcgttgttgcttttgtattcgtcgcgaatcttccagaattcgtcttcggtttccacgaacttcgtctcgccggtcttgaggttggtggtgacgaagtacagccatttgccttccggaggattcatcgcggcttggatagcggaatcgccgggattgctgatcggcgtcggaggaagtcctttgttcacgcgagtattgtacgggttgcttccatcctcaagctgctcgtctgtcagcttgctgcctgtggtgttgaacccgtaggcaacggtgctgtccatgcccaacggcatgtcctggtcgattctgttcaggatgaccctcgccaccttaccgtaatcgtcaggattgcatgcctcggattcggcgatggacgcgatgttcatgatacgttcgcgttcgcttccatctggcacgcccaatgtgtccagtttgttgacgcgtgccgtgaccatttccttgaggatgtccttggcggacttgtcctggacgctgtaggatccgggctcaagccatccttcgaatttgccacccgcttcatctggcagaatgcccgcgccgccaccgtcgatgaccgcttggaattcggacacgtccttgcctgacatcttggccgcgttggcgatgacatcggacacccgttcgccggccttgacttcggcgaaaccgccggccttgctttggtcggacaggatcttgacgacatcggccgctttcatatgcgtcttcaacgcgtacgaacccgggtaaagcgtcgcgccggcggccgcgactgcggaggtgaacgccgattcggatttgacgatgtccgccttgaccagatttcgtgcgatttcggctgcgccttgtccggtttccacggtgaacgtcgtgtctttgtctcccgaaccggtgtaatcctcaatctggatttgcgagccgttggcgttcatctgcctgagatgtttaaccatgcgcacaccgaaaaagccgccgacgacgacaagaatgacaacgacggcagccgcgatgattgtgacatagcgacgacgacgttgttgctcacgtcgtttacgcatgtcgcgtcgcgatttcggcggttgcggcggcaacgcggcatcgaatgacgagcccgctgacgtatcatcgacccactgcgcgttatcggagaaaaaatcgttcagattatcggtcaaaggtctctctccccttactctctgcttcggtcgagcgccgtctgcaaaatcaccaccgcagattgctggtcgaccatcggacggtgcttgcgtccgccgatgcgcgcatcgaacaactgatgatgtgcggtcactgtcgtcagacgctcatccaccaattcaatggtgggaacccgcgtcaccgaatatgattcatcctccacggccgcatgcagtcgtttttcaagattgacggaccagcgtctcgcttttttggcgcttttcccctcttcgccgttcagcagcaacggcaggccaatcaccacatggtccaccgactcgtccccaatgacgtcgatgacttcatccaacgcgcggaaagaatccccatacacttgaatattgcctatgggatgtgcgagggtgagctcgggatcggacaacgcaagtccgacccgagcatcacccagatcgataccaagccaaaccatgcttggagaatcagcccttcagagcctgaccggccaatgcctcaagtgcctcgtcgatcttggtggcgtccgcgccgccaccctgtgcgaagtccggcttgccgccgccaccaccgccaagaaccttggaagcgccacggaccagatcaccagccttgatgccttgcttgcgtgccgcttcgttggttgccacggcgaccatgggcttgccgtcctcgttcatgccggcaagagccaccacgaccggagcatcttcgccgagctggccgcgcacgtcgagcacggtcttgcgcagcgcgtcgaaggagccgaaatgtccaacgttcttcttggcgaccttgaccggagccgaggaagctttggcctcagccaccagcgtcggcacagaggccgcaagctgggactcgtacattgcggcaagacgacggtcggattccttgagcttggcaagcagcatgttcacacgctcggcgagttcgtcgggacgggcgttgaccatgtcggaaagctgggaaaccagcgcgtgctcgcgggcgttgaactcatacgcgccctggccgacgaccgcgtccacgcggcgcacgccggaaccgatagacgcctcggacatgatgttgatggcgccgatcttgccgacgtggtcgatatgggtgccaccgcagagctcgcggctccagccgtcctcgccgatggacaccacacgcacgatgtcgccgtacttctcgccgaacagatgcatggcgccaagagcgatggcgtcatcgaacttcatttcctgagtggtgacggcaaggttctcacgaagcttctcgttgacgcgggcttcgacggcgttcatggcgtccttgctgggggcgctggaccattggaaatcgaagcgcagacggttcggagcgtcttcggagccacgctgggtggcctgcggaccaagttcctcacgcagcgccttgtgcaccatgtgggtggcggtgtgggaacgtgcaatggctccacggcgctcgagatcgatgttcgcgttgacttcggcgcccacaaccagcgtgccttcggtcagacggcactggtggacgataaggtccttgatcggcttctgcacgtcgtcgacctcaagcaccgcgccatcgtcggacagaatctcgccctgatcggcgagctggccgccggcctgcgcgtagaacggcgtgcggtcgaggatgacctcgatgttggccgggccggtgacggcgggaacggaacccttgccctcctgcatgatgcccagaaccttggcacgtgcggacatgtcggtgtagccaaggaagtcgatcggctggagcagggtcttcttgaagtcgtcatagacggacaaatccacgttgtggcgcttcttcagcgcgtccgcacgggcacggctcttctgttcggccatcagctcgcggaacttggcttcatccaccttcacgccctggtcggcggccatttcgagcgtgatttcaaccgggaagccgtaagtgtcatgcagcttgaaggcatcctcgccggacacgagatccgaaccgccctgcttggccttcgtcacggccatgtcgaagatctcggtgccggattcgagcgtgcggcggaacgcgtcctcctcaccgtaggcggcttcggacacgtcgtggaaggtgtcgttaagctccggatagctcggttccatcgcggccttggaggtcggcagcaaggtcggcatgaccggctctgtcacgccgagctcgcgcatggccttgacggttcgacgcagcaggcggcgcagcacatagccacggccgttgttggacggacggacgccgtcggacatgatcatcagcgcggaacgcacgtggtcggccacgatacggaaacgcacgtccatggcctcgtcatcgccgtaggtgcggccggaaagcttctgcgcggcttcgatgaccgggaagacctcgtcggtctcatagatgttctgcttgccctgcatcagataggcgagacgttccagaccggcgccggtatcgatgttcttgttctcaagctcgccgacgatatgcaggtcggtcttggacttgacgttgtcgacctcgtagttttcgaacacgagatcccaaatctcaatgtaacggttctcgtcggcgatcgggccgccttcgacaccgtactttggaccacggtctacatagatttcggagcacggaccgccagggccagggccaccggtggtccagaagttatcttccatacccatgatctggatatgttcaggatcgacgccttcgttcttccacatcgagcgggcttcctcgtcgtcggtgaaagtggtcatccacagtttctccggatcgaagccgtagccgcccttatcctgcggggtggtcagcagctcatacgcatagtggatggcctcctccttgaagtaatcaccgaaggagaagttgccaagcatctggaagaacgtgccgtgacgggtggtcttgccgacctcgtcgatgtccagagtacgcacgcacttctggttggaagccatgcggtgcttcggcggggtctgctcacccatgaggtacgggatgaacggaaccatgccagcgatggtgaacagagtggtcggattcggagaaatcaacgatgccgaaggaacgacaagatgatcgtgctgttcgaaatagtcaagaaagcgcttcgcgatttcagaagtgcgcatgtggatttgagctcctttgttgttggaggcctgatgccttccaaacgtgtgattggttgcttgagcgtatctgtcgggcggaaaacgactactcgttccgcgccgcatatttgctgttaagttcagcctcgcgggctcgacgcgtggcattgaactcattgaccagaccttcaagcgtgcgcatggtcacatggtcctggtcgggaccaagcaggaattggcgggcggtgtccggtgtgttggctttaacgtatgcctgcgcttttgtgacagcgacgacaccgatgcccacgccgatggagacccagaaaagacgcttgaacatcactcccccttattgcctgccgcgtgattgacgtctctcttagccaagaaagactgcacagtggacttcaacgcataggtggcggacgcaaccttgatgacgggcttgcccaagaacgatccatatagatcagtcagcgcgccgacattattggccgtagtggacgccgcggcggagatcttgttgacatcctccagggacttgttcacctgctgcaccgtggtcacgctctcgtcaagcgccggaatcgcatggtctccggtgtctttgacggtctgcgcgatctggtcgaacaatttgccgagacggatcagcgggtagatcatgaaaccggcaagcaccgcgaatgcaattgccgcaatcagaccggcgatctctccaacacccatcttgtacctcttttcagctccacggttgcccgcgaacacaatacccgcataagactagtaaaaagccacgactgtggcaaatacgttcactggttgtacgagaccacactcaccgcgcggtccatgggttcgttcgtgtcaaaatcaaggcaggtcaccgaaccgttggccggacgttcgctcaaatcgtatccttccggggcgaatcggtgcataaggctcaacaatgtattgccgtgggagatctgcagcacgtggtcgccgtccttaagccgagggttgtccgcaatcaaagcgaagccgtcctccacacgatgccaatactcgttatcggattcggcgtcatggaacggatcggcttctttgagaaagtcgcgggtggcggcaagcccgtatttgcggacgatgtcgttgtagttcttcgcaccatggggaccaccggcagcggtccatgcgacggacatgtcctgtccctcgaaataaccgtagaactgctcacggaaatgcatgtcgctgaccagtgacggacgaacgtgtcctgcggcttcgttcgcatcgaggatccgttgtgccgtcacctgggcgcgtgtggtgtcggagcagtatgccgcggcgaactcaatgtcccggagtttggcggcggccttgtccgcatcggcaagtcccgcatcggtcaacggggaattcgaccatccctggagtctgttatatcggttgaagaacgtctgtccgtgacggaccagatgaagatgaagcaacatggtttccatggtacctgtggaatcagccaaacgacatgccgccggaaacgccataaaaaacgagaagcctcgcaaccgtaacggctgcgaggctttcgctgtatgtccttaaactgtatgttcttacagtatggtgatccagatcagcgggcgtagaattcgaccacgtactggatgttgacctgcaccgggatctcctcggcttcaggcttgcgggtcagggtggccttcagggaaggcaggttgacgtccaggtagcccggaaccgccggcagcacatcgcggtgcacaccttcggcagcggcctggaacggaaccatggtctggctcttggccttgacctggatggtctggcccggcttgacgcggtaggacggacgatcgacgatgttgccatcgacgaggatgtggcgatggaccacgaactggcgagcctgggcggtggtgcgggcgaagcctgcacgcaggaccagagcgtcgagacgggtctcaagatcggtcagcatggcgttgccggtctggccggcggtgtgggtgcccttctcgtaagcggcgcggagctgcttctcggagatgccgtactgggcgcgaagacgctgcttctcgcgcagacgcactgcgtaatcggattcagtgcggcgacgggtgcggccgtgctcgccaggagcatacggacgcttttcgaagatgcgctgagccttaggggtcagagcgatgccgagggcgcgggaaagacgcacctgacggcgggaacgctgaacgttcgtcattggtttaatcctttgtttgttctgtcgttgtctgaacggaacgtatgccgaagtccgacatacgctgagccagcctctccagtgcttcttcgcgcaatgcgcgaacggcttgacccgcaatgcagaacaccacggatggccgccgacccactgatgggctaagactccagacggcatacgtccttccgggcgcacaccaatcgctaatcatacacatgggggacggacgagatgctccgattcacctacatcggcatgtcttaaaaacgtcaggcccgagtaagcactcccctatccatacgataggtatggtccacataagcaagcgcgtccggatcatgggtaaccataagtaccgaggtaccgtcatccgctacttgccgcagcagccgcatgacgattgcggtgctttcggcatccagatctcctgtcggttcatcggcgatcagcagtttcggcttgttcatcaacgctcgggcgatggagacgcggcgcatctcgccaccagagagctccttcggatagcatgtcgcaagctcgcctacaagcagttgatccaacagatgttgcgcgcgttgcgtcaaatggtcgggctgagatgaagaagccgtctgcgtcgaagctggttggatgacgtcgggaaggccatcgaccacgacggaagacgccgtctgttcctgtgattgtgcgtcattcgtccgttcatcgatttcggtttcataccgagacgggttgcgatgcagcactgcgggaaggaccacattgtcgattgcggtgaggttcggcaatagtgtctggatctgcgtgacgaagccgatggtgcggttgcgcaaaatcgacatctgtttgtcgtttaacgtggtcacctcgttaccggccagcagaatcgaaccggatgtaggtttcagcaatcccgtgacgagattgagcaaagtgcttttgccgtttccggatctgccgacgatcgccatgaattcgcctggatcgagcgtgagattcacatcatccaccgcggggaaaggtttacctcggcgtacgaattcacgggtaaggccacgaacctccaatatgggctgttccggcatcactcccccttcctcagcgtcaggtatgcctgtggggcggaaagacgcaccgctgtggcgagggatgcgaccaggcccgtaagcacggcgaacaggagagcgacgactatcagtaccgccactttaccgacgccaatctgcagatacggcaattgaagttccttagcgatcagaccactgaacggaaacacgaccaacgaggtacaggtcacaccgatcacacctccaatagctccgatggtcgccgattccttgacgataatgcccaccagggtcgcacgatcggcgccgagaatacggtacgcggcgaattcacgcttgcgttcgttcatagccgacgaaaacaccgccaacatcacgaccaatcccatagtccagaacaccgtgatgaacaccgccacatagcggatgatcaccttgagattcgttttcgtcgtagccgtgatgccgcccggatacacatatcccaaacttttgatccccgtggcttttgcgatattcgaggcgacctgttgtgcggaatatccgtccttgactttgacgagcacggcggacaccgctttgccggcgtattcttcaggaatcgcggcatgtccgacctgcgcggaataggaaacgacatccggcaccgtgtccatgttcacgaatatggaattgtccagtgacgttccggtatcggccagttgcgcggccacggggaattcatgaccgtacagtttgaccgtattgttgtccgacacgttgatgctggcgcctgctatgatttggccgcgacggagtgtgccgtcgaattgcgaagccacccaaggagtgatgacgaagtcggtgtcggggttgaagccgatgatctgcaccttttcgtcgcagcaggctgccgcaagcgaggagatgtacgtctgcaccgtgctttcgcccacaccgtccgcttcggcgatttggcttccaatgtcattggtgaagtagaacgtgctcgaagagtttcccgtaagcaacgcctcagcctggtttttcgtgttctgcggcgtgaccatcagatcggcgcccatacgttcccgcatgctgttcaacccattgttcaggttcatggaaagcagtgcgcctccatagaacgccacagtgagcatgacgaccacaatgacaagcgccgaagtgcggaatggtttgcgacgcagattggccagcggtagtttcgcaagggtgatatgcggcacgtcagccacgctttgccggcttgagatcgagatatacggcgactgctgcgagcaccgccagcagcacgcccaatacgataagcgtcggcatcgtcaccatatggcaatgcatcatggagcctctgcatacgcctaccagcatggtcggcaccagaacgacaagcacgcccagcacggcattggcgatatccaatccggccctgacccggcttggcgcgaaaaatccgattattgccagcaatgcgatgacgacacccagtcccagagcgacccgagcggtgtagcggcatgccatgggcatgtctttgacggcacacacatgcgcgaaggtctgcggggcgatgacaatcagcgcgcccagaacaatctgagatatcgcggcgaacagttttcttggcatggttcttcctctcgaaaagcaaacatcgccgattatcgcaacaaatgctccgaaagaaaagacttgttttttcactcaatccgtgttatgagcccacaacggcgccgccacgtgtggcgcctattggaaaagccgtcagagcttttcaataggcgccacacgaagcagcaatcgtttgacgccatccgtgccgaaatcaacggtgatcaccgaattcgcgcccttgtcctgcgtttcgatgacctttcccaaaccgtaatggtcatgggtgattctgtcgcctatctggaaatccgagatgctcaatccgttgttgccgtccaacgaacttgccggagccgatttcgtcagatcctttggcttggcgcggcgcgtggtgaccttaccggatttgccggagggcttgccggaaccgtatgacgaccgggatgagccatacgaaccgtatgaggacgagccagagtgcaatccgccagagaaacggcggcttcccgagccgtaggaggaccgtccggaaccatacgagctgtgcgatccatgagacgacccataagtggaatgcgatccgcgagaaccagaaccatacgatgaggaaccgtatgtcgacgatccgtacatcgattcgccgaaggaagtggatccgaaatcgtcatcatcgtcccacccgccgaactcgtcgtcatctccccagctggcgcgcatgcgctccacaccggcctcacgacgtttccaatcgatgagttcatccggaatctcatccaagaactggctgggcatcatgtcattggcctgcccccattgggcacgcaccgccgcacgggtcacatacagccgacgcttcgcacgggtgatgcccacgtatgccagacgacgctcctcggacagctcgctggtgtcctccatggcacgctggtgcgggaacgtaccctgttccatacccgtaagaaacacatacggatattccaaacctttggccgtatgcaaggtcatcatcgtgaccttgccggaatcctcaccctctcccggcaactgatccgagtcggcgaccaatgccgtggtctccagaaaaccggccaacgtggcatccggcgtgttctgttcgaattcggcggccacggactgcaactgggaaagattgtccacacgcgaagcatcctgcggatcctcggaacgttgcaattcctccagaagaccgcttttatccaatacttcggccaccacttcggatggtttcgaatcatgttccttggcgaaatcggccagctcgtgcatcagatcacggaatgcgcccaacggtttggtggtacggcctgtcatgccttcaatctggtccatatgttcaatggattcgaagaacgtgaggccatgcgcgtccgcgtagccggccaccaatccctccgcgcgtgcgccgagtcctcgtttaggcacattgaggatacgccgcacgttcacattatccgcgggattcacgatggcctgcaaatacgcgatggcgtccttgacttccctacgttcatagaatttggtgccgccgaccagctgatacggcagattggcgttgatcatggcctcttccagcgaacgtgactgcgcgttggctcggtacatgatggcgatgtcacggtaagcgacgtcttcctcggtgtggattcgtgcgatttcgttcgctatccatccggcttcctgctgtgcgttgtcggcggcatagccgacgattttgtcgccttgaccaagcgccgtccacagtttcttcggcttgcggttttcgtttttcgcgatcaccgcgttcgccgcgtcgaggatggtctgcgtcgaacggtagttctgttcgagcatgatggttttggcgttcgggaaatcctgttcgaagtcttggatgttacggatgtccgcacctcggaacgcgtagatggattggtcggaatcacccaccacggtaatccagctcggtcccacacggcccgctcccctcgcctgcgggtcgggctgttcgtccgaatcgatgccggacaattcacgtacgagcacatattgggcatggttggtgtcttgatactcgtccacgaagatgtaacggaacctgtgccgatagtattcgctcacctgcgggcaggtttggagcaattccacggtgcgcatgatcaaatcgtcgaagtcgactgcgttggcgagcgccagacgatgctggtattcggcgtagacgacggcgaccagttcgtcgacgtcgccggcgctcacctggtatccgcgctgtcccgggatgtaatcgcagttcgcttttttcagctggtctttccaggaaaccaacgcgttcttgcagtcggatatcttgcccagcagcatgcgtggcgtataccgcttcgtatcgatgttcaggtcggctgcgatcagtttgaccagtcgctcgctgtccgcggtgtcgtaaatcgagaagcccgatttaaggccgatttccttgccgtcgcggcgtaggatgcgtacgcaggcggagtggaaggtggagatccacatatgttcggcttccggcccgaccaaagtcacgagacgttcacgcatttccgcggccgccttgttggtgaaggtgatggcgaggatgctgcttgcccagaagccatgcgccagcagccatgcgatgcgacgtgtcagcacacgggtcttgcctgagcctgcgccggcgccgatgagcaatgcctggccgtagtatttcaccgcttcttcctgttgggggttgagtccctctatcaggctccgcggatcgcacatcacaggtcccatgctctgttccaccgattcctcttttcttcgcgcacgctcatattcaaacatttgttcgcagcattcatgtttatcacatgagcaggtcaggggtccgactcgcacggtcaattgaggcgcgtatgctgaactcctatatacggctcgccgtatgccatcatctgatgccgctttcgcggccgacaagattaaggggtttcatgaaggaacttgaagagcgcattgcgcaacaaggtaccgtcaagcccggcaatgtgctgaaagtggacgcgttcctcaaccatcagtgcgatgtcgagctgttcgaccatatgggcgccgcctgggccgagcatttcaagggcaagaccatcgataagattctgaccattgaggcttccggcattggcatcgcctgtgtcgtggcccgtcatttcggcaatgtcccggtggtgttcgccaagaaggcgcagtccatcaatcttgacggcgaccagtacacgaccaccgtgtattccttcaccaagcagaaggagttccctgtcatcgtgtccaagcgctatctcaatgaaggcgaccacgtgctgctgatcgacgatttccttgccaacggcaaggcgttaaaaggcctgatcgagctgtgccatgaggccggagccactgtggaaggcatcggcatcgcagtggaaaagggcttccaaggcggtggcgaccagctgcgtgaggaagggtacgacgtcgattccctggcaatcgtcgaatcgatggatccggaaaacggcaccatcgaattccgctcctgattttttcagtacgctcagacgattataagagaggatgtaacagttgagcgaagagaagaacacagagaaaaccgaaaaaaagacaaaggcaaaagacactaaaaaaggcgtgtcttttgaggcgttgagcagtcttgacgcaccggtgtcgttctggaagggcattccgttcggcctgcagcacgtcatggccatgttcgtggcgaatctcgcgcctatcttcctggtggccacggccgccaagatggatgccgcgcagtccgccgccatcattcaggccggcctgctggtcgcaggtctcggcacctgcctgcagctgtacggtgtgtggctgattggttcccgtctgccgatggtcaccggcatttccttcacctacgtcgcggccgccatgtcgatcgcgcagcatcagggttatggcgcagtcgccggcgccgtggtgcttggcggcctgttggaggtcgtgcttggtttgacggccaagtattggcgtcgtttcgtcccgccgatcgtttccgcgattgtcgtcacctcgattggtttttcgctcctgtccgtcggcgccacgagcttcggcggcggttccggcgcgaaggatttcggcagctggcagaatctgacgcttggcctgatttcgctggtggcttgccttgcgttccagctgctcatgaagggcaccgccaagcagctttccgtgctgttcggccttgtcgtgggctatgtggtcgcgattttcatgggaaaggtcgatttctccggtttcgccaatctgcaggtcgtgtcggtgccgcatttcatgccgttcaagcttgagtttgatccgggcgcgattatctccttcgctctgctgtatgtcgtttcctcggttgaggtgttgggcgacacagcggcgcttaccaaggtcggtctcgaccgtcaacccaccgacaaggaaaccgccggagctattgccggcgacggtttgatctcctccgtgtccggtttgttcggctgcctgccattgacttcgttcgcgcagaacatcggtctggtggcgatgaccaaggtggtcaaccgcaaggtgattctttccggcggtctgattttggtgctcgccagcttcgttccggccgttgcagaggtcttcaactccctgccgcaggctgtgcttggcggctgcaccatcatgatgttcggcaatatcatcctgtccggattccagatgatttccgaggccggttacacgcagcgcaacatcaccatcgccgcgttgagcctgaccattggcatcggtttcacccaggtcggcgacattttcgccaacttcccggcgctgttccagtccatcttcgcttccaactgcatcgcggtgtcgttcgtggtggctgtgattctcaacgccgttctgcctagcgaggagcactttctgtccgctcctcagcatcaggaggcctgatttccctaatatcggcatcgtccgcatatgaatgatccccattccgatttccacggaatggggatcattcatatgcgacggcatgtggcggacctcgtatggaagtcgtcaacgcatcaatcagtgcccttgcttgatccaagcggcgattgaatccttgaccgcctgcgcgtagatcgtattggacattcccggatggatgccatctccggcaagttcgtcagcatgctgggaaatggtcccgtcccaatcgaccagtacgacgttgttggaatgcgccgcggcgaattgcttcaacacggcattggtgccgggaacccatgaaacgggagcgtgcgcgttaatgagcaccagcacatgatcggggccgacatcattcagcagatcgtcaagctgattattggtcaccacggagttggtggcaagtcccaccaagacccaggggcgcagatttccttgcgctttcaattgatcgacaagaccctgtcccttcgccatcgaccgtgagacttcggcatccacaatgatgttggggaacgtgtcttgcaatcctttgctggacgccagcatcaccgaatctccgatggcggccatttgcgaaccatccggcatcttatgtcgtggcttccttggcatcggtgttctgcgtcgttccaaagcggcatgattgcgttgctgcaacagcctggaactgatacccaaggattgcgccacactggtttgttccggtgccgtcgccacagcgtatccgcagaagctccatgagcatgccagcaccacgaccgtggatatcagacggccgcaatgctcggcttcgtctccactgatcggacgaatcaacgcgatgaatcccgcacgagcgactggcttctcgaacagtcgccaagatgcgaacgcgaacagcacggtgaggatgaaggtgaaggacagcagcctgtcggcatgccatgcgccccactggggcaacagggatctcagcagcagccataatggccaatgccacagataaatgccatacgaataatggcccaaagcggcaagcggcttgaacacaagcagatcctgcatccaggatccgaatggtatggttcctgcgatcagcaccacagcaagcacggaggcgacgaagataccgccatggaacgccgctgggccttgagtgatatgccgcatcatccacagcaatgccagcaatgagccaaaggcaactatcgggccgaattgaatccatatcttatggaatcgttccattatccgcgattcattggctcgcccatgctcatgtctgagaatcggcagtatccaagccagcgcggcaccgagccataggcccatggcgtgcgtgtcggtgccgaaatacacacgtgtggggtcagcgccagagtggtatagcagtcccatggatgccgcgcttgctccggcaagggctgtcagtatgcataccggagcccatctgatgatgatttttcgcagcagcaaaaccacgaatggagcgatcagataaaactgcatgagcaacgacatgaaccataggtgacggaatatgtcagggttcatctgggagaaatagctggctccgctgctgatggcataccagttgtagcatcccagaagcacggtcatgatctggttccggatgccgacaagcatgtcgcggttcaccagccatgccaacgtcgccgagatcgggataagagcaaacagcgcgggataaatccggcggaaccgtttgaggaagtactcccccagttccaagcctttacctgaatcgatacgattgagcagcgatgagaaaatcaggaaaccggagatggtgaagaacacatccacaccgaaaaacccgccttgaagcgaaagctcatcgcagtgatacagcacaatcgcaataagggctatgcctttaagcccgtccaaaccgacgaaacgtcgtttagcagccacgaataaccaaccgttctctcttacatcattgcacggtacagtgcaacctgtcgtatcgtactaccaagcaatcccttgcgaatcgcggaaaagggggcccaacgcactgcgccgccgtgcctgattgaccgatgatatcgattatcaggcacggcggcgcagattcataccgtttgccgtcacgttcctctaccagccgaaacgtgacacgtcactcacttggagaagacgttgccgtaggagtccttgccttcttctgcgatggcggcggacttgcgggcgatggccagctcctcgttggtcgggatgacgcagatggtgactgcggaatccggggtggagatgatgcgcggttccttggaacgggtcgcgttcttctcctcatccagcttgacgccgaacggagcgagcttgtcgcagaccatcttgcgcacgacgtcatcgttctcgccaacgcctgcggtgaaggtgatcacgtcgacgccacccatctgagcggtgtagttgccgatgtagccgacgatgcggtgcacgtagatgtcgagagccagcttggcgtcctcgttgccctcttcgaccagacgatgcacttcacgcaggtcgccgaagccggtcagacccatcatgccggaacgcttgttgaacagggtgtccagttcgtccacgctcatgtgggcgttgcgaatcaggtggaagacgacggccggatcgatgtcgccggtacggccacccatcacgaggccttccagcggggtcagacccatggaggtctcaaccggcttgccggagatttcggcggaggcggaagcaccgttgccgatgtgcagcacgatctgcttgaggccttcggccggcttgccgatgacggacggcacgacggaggagatgaactcgtgggaggtgccatgggcgccgtaacggcggatgtggtactgctgggcgacttccttgttcagcgcgtaggtgctggaagccttcggcagctggaagaagaaggaggaatcgaacacgaagatctgcggaacatccggcagcagggagcgcatgacctcagcgcccttggcctccggaccgttgtgcagcggggcgagcacggcgaggtccttgacctggccgatggtcttgtcgttgaccagagccggcttcgggaaaatggaaccaccctgcaccacgcgatggccgacggccacgatgcctgcgtcggcgagcttcgggccgaactcgtcgaagaagccgagcacgcgcttcagaccctgctcatggtcgtgaatcggctcttcgagctcatgcttctcgccgttgtactcgtgcttgtaatgaccgtcaaccggctcgccgatcttctcgaccagaccggaagcgataccttcgccggtttcaagatcaaccagctgatacttgatagagctggaaccggaattgatgacaaggacggttttcgccattgtgggcatcctccatgtgttaatcgatgtgccgcttacgcgactttccaaaaccttagattactcgttgcttgctacaaaatgcccgattactgggcttcgatggcggtcagggcgatggtgttgatgatgtcctggaccgtggcgccacggctcagatcgttcaccgggcggttgagaccctgcagcaccggcccgacggcggccgctcccgaggaacgctgtaccgccttgtatgcgatgttgcccgcgcacagatccgggaatacgaacacattgacatggcccgccaccggatcgcccttggctttggtcgcggccacggtcggagaccatgccgcgtcgaactggatcgatccgaccaccgcaaggtcgggagccttgtctttgacgatggtggtggcttcctcgacgaggtcgacgtcgggtccttttccggagcccagcgtggaataggacagcatgcccaccttcggttcaaggccgaacgccttggccgtttcggcggattggatcgcgatttcggcgagctgctcggcattggggttaaggttgatggcacagtcggcgaacacggcgacatggtccttgaaacacatcaggaacgctccggataccaacgatgttcctggcttggtcttgatgacctgcagggccggacgcacggtattggccgtggagttgacggaaccggacacgaggccgtccgccatgcccatcaccacaagcatggtgccgaaatagctgtcatcggccagctgtttgcgcgcctgctcttcggtcatgcctttcttggcgcgcagctcgcacagcttcgccaccatgggttccaacaccgtttcatcatccttggcttggaatttcgccttgccaagcgatttcaatcccaattcctgaccacgggcgagaatggcgttttcgtctccgacgatgatcagatcgacgatgtcgcgttccagcagataatcggcggctttgatgatgcgatcctcgttgccctccggcagcacgatggtcttcttgtccgccttcgccttgcccagcagaccgtattggaaagcatagggtgtggtcggggcgtcgaatggcgattcgagtaccgcggtcagttccgcggcgtcgacgttcgtcgcgaacgcttcgtctgccttgctgatggcgtcatcgtcattgaaatcgacggcaggtagcgtccacaccggcaccgggtagtcgacgaagcatgctttgagcggatccggctgcgtgtcgtcacacccagtaatgaacacgccgacgactttgctcccggcgtcttcgatgaccttggtggatgcctcaaccgtgcttttgacttgttccggtgtgcgttcgatagtgcatacggccagcaggaccggcgattggaggtctgccgcgaagtcagcgttgaaagagaacatcgcgggatcattgactgctgacctgtcggtgccgacaatcaccatggcatccggtcgggctgtttctacggcttgggtgtaggccgcaacgatatccgcccgcgaaccttccttatcgttacgagcgcgcttggggcacacgccgacggactgttcccggctcaaaccggcattggaagcttcgatcagcacgtccgtgaaggtgtcttttctgcagaccgccggacggaacactccggtcttgccggctgcggcaagtgccttggtgactccaagggcgacaacattacggccgttagccgcttcgggactgatgatggtgacgctggtaaaactcacggtgtctcctatgtacttcacattattcgggtgcgataccacatcgttcgcacaatgagcaattgtaatgtgcaaacggtaactgacacgcgctagcggttttgctgttttaagccaagcatatcgcaccgtaatacgaaaaagccccaagggaacaatcccttggggcttttatcaagcaatcaggccaaataagcctaggctcactcgttatcgccagcggttgcggcggtagcggagacagcaccctgcttgttggtgttgacaccggagtagacccagtcggtgtaatccgggtgatcgtagccgttgtcgacagcgaactggaaggcttcctgacggaaggcctcgagctcgttgatcttgtcggcgtacttgtcagcgtcgatcatgcgcagagcttcagcctggagctcgtagcgatcgatgttgttcacgcgaaccatgtcgtacggggtggtggtggagccctgctcctcgtagccgtgaacgttgaagttgtcgtggttcgggcgatcgtagatcagaccacgcacgtcgcgggcataggagtggtaagcgaacaggaccggcttgtcctcggtgaacagctcagcgaactcctcatcggagagggcctcgttgttctccttggcggactgcagcttgaccaggtcaaccacgttgacgaccttgaacttgatgcccatggcgtccagcttgtcggcagcggccatgatttcctgagtcggaacatcaccggtggcggcgagcacgatctgagcctcatcgttggacttcacgttggaagcccacttccactcggcagcacccttctcgagctcggcgcgagcttcgtccagggtcagccaggtggcggccggctgcttgccggcgatgatggcgttgatcttgttggtggacttgtagcacttctcagccacagcgagcagcatgttggaatccaccgggaagtagatgccgatcacgtgatcgttgttgaagcacttgttcagcaggacggaggtgacacccggatcctggtgggagaagccgttgtgatcctgacgccacacgtgggaggagacgagcaggttcatggaggagatcggcttgcgccacggaatctcgcggacggtagcctcgagccacttggcgtgctggttcagcatggagtcgatcacgtgcacgaaggactcataggagctccagatgccgtgacggccggtcagcaggtagccctcgaggaagccttccatctggtgctcggaaagctgctcggtgacctggccggtgacagccatgtgctcgtcgacctgagcggacaggtagccggcgtcccactgcttgttggtgacgtcgtaagcggcctgcagacggttggaagcggtctcatccggtccgaagatacggaaggagtccgggttgttcttgatgatgtcgcgggtgtagacgcccagacgacgggtggcctcgagctggccccagccgtggccgtactcggcgacttccttgacctcgtagtcttccagcttcggcagcttcagctcttcgcggatgcggccaccgttggcgttcgggttctcaccgatgcgcagttcgccggtcggcatgaaggcggtgacttccggcttcacggcgccgttctcgtcgaacagctcttccggcttgtaggactcgagccagttcttgaggacctcgaagtgggcctcggtatcgcgggcggaagccagcggcacctggtgggaacgccaggagccctcggtcttcttgccgtcgatgaacttcgggcaggtccagcccttcggggtacggaagatgatcatcgggtagaacggacgagtcatgtcgtcggtctgagcggcggccttgatgtcgcagatctcgtcgaagacggtctcgaacagctcggcgaaacgacggtggatcgacaggtgatcctcgttgtcgaagccagcgacgaactcgtacggctcatagcccatgccgtggaagaactcgtggagctcttcgtcggagatgcgggacaggatggtcgggttggcgatcttgtagccgttgaggtgcaggatcggcagcacgataccgtcggtgcgcgggttgatgagcttgttggactgccagccggtggccagcgggccggtctcagcttcgccgtcgccgacgatggccgggacgaacaggctcgggttgttcatcacagcgccgtaggcgtgggacagggcgtaacccagctcgccgccttcgtggatggagcccggggtctccggagcgtagtgggacgggatgccgcccgggtaggagaactggcggaagaacttctgcagaccagcctcatccttggtgatgttcgggaagtactcggtgtaggtgccgtccaggtaggactgagcggtaccagccgggccgccgtggcccgggcccatgatgatcacagtgttctgctggtgatcagcaatgagacggttgatgtggccgatgaggaagttcaggcccggggtggtgccccagtgaccgaccagacggtgcttgacgtcttcgcgggtgaaaggctccttcatcagcgggttgctacgcagatagatctggccgatggagaggtagttggctgcgcgccagtacttatccacgccttcgatagcttcctcggaaaccggagcgttcagcttcttccaaggggtgccaataacaggactcgtcatgtgtactcctgtactcctgcactgtgatgtgcgattgtttatttccttaggtcatgagccatgcctaaaaccttgcggttacgcggtatgcctcatttccagtcacttgcacatattacgagcgcggttcgactttttgctgtttttttgcgactgtgtgttcaattgttatttttctgtacgcaaatgtgtgcttttatcgggatttttgtgcgtacttcacactctatcaaaaagattgaaaaacggctcaaaatcaacgtttttagtcggttaacatatgtttcccacgttcgtttccctagatacacacgcggcgtgttgagtaggtgggagtaagcaattgtgagattcgttcattctccgttcacgtgtttccaatgtctccttgcaacgtcacaatagagcagttagtattgtccgtttcttgatacctcatattaaagggagagtgttatggctgcaggtcctgtgctcgttgtcgatttcggagcccagtacgcccagctgatcgcacgtcgcgtgcgtgaggccaatgtttattcggagctcgtgccgcattccatgccggtcgatgagatgctggccaaggatccgcaggccatcatcctgtccggtggccccgcttccgtgttcgaaccgggcgctccgcgcgtcgacaagaagctgttcgacgcgggcgttccggtgctcggcatctgctacggcttccaagccatggcatacgcgttgggcgcggatgtcgacaaggccgccctgggcgaatacggcaaaacggaaaccaccattgacaaggcggagggtctgctcgacggctctcccgcagagcaaagcacgtggatgagccatggcgtggccgtcaagaccgcgccggaaggcttcgaagtgctcgcccacaccgaaggcgcaccggtcgccgccatgcaggacgagtcccgcaaactgtacggcgtgcagtggcatccggaagtcaagcacactccgatgggccagaagctcatcgagaacttcctgcacaaatgcgccggccttggtgacaactggaacgcatccaacatcatcgacgaccaggtgacgaagatccgcgagaaggtcggcgacgcacaggtgatctgtggcctgtccggcggtgtcgattccgccgtcgccgccgcgctggtgcacaaggccatcggcgatcagctgacctgcgtattcgtggaccacggcctgctgcgcaagggcgaggccgagcaggtcaagcatgatttcgtcaaggccaccggcatcaagctcatcgccgtggacgcctccgaagacttcctcaccgcgttgaagggcgtgagcgagccggagaagaagcgcaagatcatcggagagaagttcatccgcacttttgagaaggcgcagcgtcaggtcatcgaagaggccggtgcctccggcaaggaagtcaaattcctcgtgcagggcacgctgtatccggacgtcgtagagtccggctgcggcgatggcgcggccaacatcaaatcgcaccacaatgtgggcggcctgccgaaggacatcaaattccagctcatcgagccgctgcgcaccctgttcaaggatgaggtgcgcgccattggcaccgaactcggtctgccggatgagattgtctggcgtcagccattcccgggtccgggtctcggcatccgcatcatcggcgaaatcaccaaggaacgtcttgacttgctgcgcgaagctgatgccatcgcacgtgaggagctttccaaggccggcctcgaccgcgacatctggcagtgcccggtcgtgctgcttgccgacgtgcattccgtgggcgtgcagggtgacgaacgcacctacggctcgccgatcgtgttgcgtccggtgtcgtccgaagacgccatgaccgccgactggtcgcgtatcccgtacgacgtgctcgccaccatctcgacgcgtattaccaacgaatgccgtcagatcaaccgcgtggtgcttgactgcacttccaagccgccggcaaccatcgaatgggagtgagcccgcaggcttgacgcatagcggaaggggctttccacaaactattcttgtggaaagccccttccgctatgttacggaaacaagtccgctctcgtcagacggaccgaacgtcccccgacgtcacttttgcatatccgtcaaacaagcatgtcattccacagatccacgaaattcggtagggttttcgccgtcgtggcgacgttcttcacttggatgcctttgatgcgtaggccaagcatcgccgcgaatgtggccatacgatgatcggcataagtctccatcacggatggtctaagacgattcgccgacacaggggttatctccaatccatcgggcagttcgtgggcagctcccccaacgcgcgtaatctcgttggccaaagcctccagacggttcgtctcatgccctcgtaaatgaccgatgccgatcatgcgggtaggcttgtccgcaaaaaccagaatcgctgcaagcgacggcgcgatctcacctgccgccgtcaagtcgaaatcacctaggccgctgacatgaccgttgccggtcacttcgcagtaccggacgtcgtcaatcaccgggaagctgatctcggctcccatacgttccaaatatcccggaagcatgcctccgggttgcgtagtggattccggccaatgaggtacgcgcacggttcctccggcgatgagcgctgcgccaaggaacggggcggcattcgacaggtcaggttcgaccgtcacagtttcgggcaactgcacggctcccggctgcacggtccacacgcgagcgtgttcgtctgcgttgacacgcacgccggaaccatgcagatcggccacggtcatgcgaatatgcggcaaactcggcgtcttctcccccgtgtgatgcagttccaaaccgcctggcactcgagagccgatgagcaatagtcctgaaatgaactgcgaggatcccgaagaatcaatgctgaccacgctcggctcagcgcactggctcaccgtttgaggtggagtgattgtaaatggcagtcgaccttcctcgccgtggtattcgatacatgcccccaactgttcaagaccgtccaacaccggcttcatcggacgcgcgtacgcctgctcgtcaccgtcgaaagccacaggaccgtccgcgaacatggcaagaccgggcacaaagcgcatcaccgttcccgcaagaccgcagaacaccttcgtaccaccgtggaaccggccgtcggacggcggcaccactgtaaccgtggtgtcaacctgctcgtcgatttcgcagcgcactcccaacgcgcgcaacgcgtccatcatcaactcggtgtcacgtgaacgcaatagaccgaccaatcgcacgggtcgatgtccgagcgccgcgagaatgagataacggttcgacagtgatttgctgcccggtaccaccacagtggcgttcaacggtttgccggcatacggtgccggccacaggttctcatgaagtgcttccatatggttcatggtaaccaaaccatgtggaaaacgccgcgcccgtctcgcataggtcgtcttcctggcatgttccacaaatacattcctttttcataagacaacgcaatgtaatacgatgctgtcatggagcatttcatttcacgttggttggttttgaccattgcggccggggtcatggtcacactgcttcccggcatgcacgccgttggcgaaccacccattctcggcatcggcgcgttcgcgttgttccttgcgttgatcaacgcgtcgatcaaaccgatcgtgcacaccatcgcattgccattttcgattctctcgttcggactaatcgcgttaatcatcaactggctgttcatggagcttgcgtcttggctggccataagcctgttcgacgtgggagtaaccatcgatggattctggtggtccgtaatcggatcgctgattatggccatcgtctccggcattgtcggcaccgtcattcaggactgatgcgatcgcgtatataactaaatgtcctccgcaatctatccgattgcggaggacattactttcgttgtcgggctgacaggatttgaacctgcgacattctgttatatctggtggtttttaggtttggtttgacagaatgtttggagattgagaaacgttggtatttcaacgcttttgccatcctgtaaattgtgactggttatgactgtatggaacgcaacgtgacggtctttgtatgcggtttgtatgcggaataaagaaaaagcccctcccccagcaattgaactgcgccccggaagttggacgtggtttattaatggtacctgattaggctgtatcgacaccgcgttgaccgcgtacgagcagcaggtcgaaccactcctcaaaaagtgacgcgatatacattgcgcaatatatgattcccgttcacgctgcgacggcgcacgaccattggccgccaccgccgcagcgtttccgggacaacaaaaatccctatggcattaccccaggccatagggattttcattatatgctgattctgcctacgaatcagccgagtgggtcgaggcctacgagatgggttgtcattgccatcgcaagtctgccgtcagcaacgcacgctatgcgcgccacacatccttgccggcggccttcgcggccgccacatcggcgtcaagctgctcttcggtaccttcgacatcgcccttgatgaattcctccaccaagcggcgagcctcgccatcctcgtgctgcacagccggggacttcatgaagtaggagctcggagccagcaccggaccggccagatggcggtcgagcgcaatcttggccgcgcgcacggcgtcgatcacaataccggcggaattcggggaatcccacacctcgagcttgtattcaaggttcagcggcacatcgccgaacgtggtgccctcaagacgcacgaaggcgaacttgcggtcgtcaagccaagccacgtaatcggaaggtccgatatgcacgttgtgcggatccatctcgtgcggcaccacggaagtgacggcgcgggtcttggagatcttcttggattccaggcgggaacgctgcagcatgttcatgaagtccatgttgccgcccacattgagctggtaggtgcggtccaagcgcacgccacggtcttcgaacagacgggcgagcacacggtgggtgatcgtggcgccgacctgggacttgatgtcgtcgccgacgatcggcacacccgcgtcacggaacttctgcgcccattcgggatcggaggcgatgaacaccggcaagcagttcacaaacgcgcatcccgcatccatggcggcctgagcgtaagccttgtccgccttttcggaaccgaccggcagataggagaccagcacatccaccttcttgtcacgcagcacctgggccacgtccaccggttcggcgtccgactcttcgatcatctggcggtagtattcgcccaagccgtcgttagtcgggccacgcagcacctccacgcccagattcggcacgtccgcgaacttgatggtgttgttctgggaggctccgatcgcctcggacaggtccttgcccaccttcagcgcatccacgtcgaacgcggtgacgaattcgatgtcacgcacgcggtagccaccgaaattgttatgcatcagaccgggaatcttatcctcgtccttggtgtccttgtaatactcaacgccctgcaccagcgacgaggcgcaattgcccacgccggcgatagccactcgaatgctcatctgaaaacgactcctctgttatgcatttcgcaggtataccaatccccaagcatacccacaaccgcattgtaaactgaaaaatcactgaaaaacggccatattacggcagtcgtcaacagattgtcgatttgtaaaaaagctgcgcaaaaacatgtttttccagtcggacagcaccatctacacccttgtttttcaggtcgttcggctacggtggaaaccatggtttcacgaacacgaagtgtcagctcacgctcaaaaagcgcccgcagcggcagcgcaacgtccacgacgccacgggtgggcaccacctacggggtccatggagaagtgctgagcaagccgccccaggggccgaagcacacttcgcatcgcgcacccaaaaagaccagaaaacacaagcatctcgtgctcaaatgggtgctcggcatcttcgcggcgctcatcgcggcaggtatcggcctgttcgcctacatgtacatcaccacggaaatcccgcagccggaaaagttcgcgctggctgaaaagacgaccgtgtattacaacgacggcaccacgccgatcggcagctatgcggagcagaatcgcgaaatcatcagctgcgcagacctgcccgactacgtcggcaacgcgattgtggcttcggaagaccgctccttctataccaataagggcatcgatccgatcggcatcgcacgcgcgttctacaacaacctgaccaccggtagcaggcagggcggttccaccatcacccagcagtatgcggaacgctattatctgggcgaaaccacctcgtacgtgggcaaactgcgtgaggcgttcctggcggtcaaaatcgcccaagcacaggacaagagccaggtgttgtgcaactacatgaacaccatctatctcggccgtggcgcatacggcatccaggcagcggccaaagcgtacttcggcaaggacgcgaaggatctgacgctctccgaagcggccatgcttgccggcatcattcccgcgccgagcgtatggacccccgacgtgaatcccaagcaagctgaaaaacgttacaagcgcgtgctgaacatcatggacgaagacggctacatcacgccggacgagaagaaagccgcgaaattcccgcaaaccatcgaaatccaacagaacaaccagatgtccggaccgaacggatacctgctgacgatggtgcagaacgaactcgtcaacaccaaggcgttcagcaagcaggacctggaaaccggcggctacaaaatcgtcaccaccattgacaaatcgaagcaggacctgatgttctccaccatcagtccctcccaaaacggcatgcaaggcatcgtgcccgacggcatgcagttcggcgcgctgtcggtgaaccccaaggacggttccatcatctcgctgtacgcaggagatgactacctgaccaagcagctcaacaacgtcacccaggcaacgtacgaagtcggctccaccatgaagccgttcgcattgctggccgccgtcaacgaaggcgtcagcctcaacacgtacttcaacggcaactcgtaccggacgttcccgggcatcaccgaaacggtgagcaactacggcggcgagaatctgggatacgtgaacctgtacacggcgacggaacaatcctcgaacaccgtgtacatggatctgcaaaccaagctcggcgcgcagaaaatcgccgaaaccgcacggcaggccggcgttgacgattcgtctttggatggttccaacccgttcaccgtgctcggcaacaacggcctgaccctcaaggacatgacgcagggatacgccacactggccaaccaaggcaacaagccgacgctgcatatcgttgcccaagtgcagacggcgaacggcaccgacctgtacaacgcgccgacctcggcggagcagacgttcgaagcgaacaacgcgaatctcgtgacgaaggcgcttaccggcgtggtccagcgaggcaccgccaccgaggcgcgtgccactgggcacaccattgccggcaagtcaggcaccgcaaacgattccaacgcagcgagcttcatcggctacacgccgtccatgctgacttctgtggcgatgtggtatccggacgacaacggcaacccgcaggagattcccgcattcggcagctggaccggcggcagcgattaccccgtgcatctcttcaccgaatacatgaagcaggcactggccgatacgccgaacgaaacgttccccgacgccaccgataacggcaaggtcggcggaccggacggtacgtggggcaccggcgcgcagaagacctggactagaaagcagcagaccaccgtgactccgcgcaccgaggagaacacccaacagaccacgccgaatcagaccgaggaaacgcagaataccggtcagggcggtggcgacggcggtaatagtggcggtatccccgctaacggcgacggtaaccacaccaacggtggcaatggcggaggaaccagtagcgataattccggtaataacggcgccaatggcgatacatcgcagcaatagcagtcgctgactgcgattgccgtcgcggtcagcgaacacgcaaagggggcttcccggttattccgggaagcccccttggttttgccgcgtgcacacgcgggcgcacggtcgtcaacgtcgttcgtcagaatgcatgcacatgctgggcgagacggtcgtattcggcgcgtgtcagcgaggcgacgccaccatgtttcgtatgcgcggtgaggaagtaatcgtccgcctgcaacggaacccagccctgatcgagatcgcggctgaccatcggacggtatccgatcgacggaatcacgtccacgaacaagtaccattcgtcgtccggtccaccgttgttgtggtggttggcgaacaccgcaggaccttccacgccgccggggttgccgtccggcacgtagcctgcgccaatccggtcctgcaccttggtccagaccgtccccggctcccaccagcgcttcgcgtcggtgcggtccatccagatgccggtgccatgcgcgttgtccttggtgatgcggtacgtgcgtacactgccgtccggcaacggacgttggatcatcgtggtgtcgatggcgtcgccgtggttgtcaatgaatacgccgccatattcgaatgtgtcctgcgtgaaatcggtggtggcgccccacagcacggtgcagtagacgttcttgtcgtcgtgagccttgtccgcatcattgaacacggtgctggaccaatacatgacgaatgcgccgcgcccaccgtgatggccttgcggataatagtccggcacccagaggcattcgcatgcccaggccataccaagctccagatgggagccgtccggcttgcgggacacgtcgagcatgcgcggctcgctccaatggagcagatcgtcggattcccagatgatgagattcgtgctggcgtggtggctccactcgtaccagccgccgccgtcgcctccgaacacacgcagatcggtggcgatgatataccacgtgccggtgtcgggattgcggatgatatgcggatcgcgcacgcctgtggtaccgagatgcgaagccagcacaggctttccatcgttgagcggcacccaacggtgcggattgtcaccgtcggatatatccatgtaaatcttctcggcgtagccgtccggatcctcgatgaagtggacgagcaggtaaccgtagtcgtcggttgtgtcggtcatggtcccaccttgtggttgtgaatgaatgaattggataagtgaattgcgtgttcgataacgtaccgcgtcaatatgcgcggatacgaagaaagccgccgccacgagagcgacagctttcttcgggaaggaggattagccctgatgcgtgcgggcacatgtgcggatcacatcctgctgcgccgcgatggccttgttgcgggccagatagatgaccaaggtgatggaatacagtgcaagaccgatgaggtccatcgtgcccagggagaagaccaccacgattgccagccagatgatcacccaccggctggtggtgccgggagcgagacaccgcatggacatgatgaagctgacgatgccgataatcagcaccagcagcgcgtagatgcccaccaccgtcgaggcgttgtccaccgcggaatagtccgttttcagcaaaccgttatgttccagcagatcgtaggcttggcctttgaaccagctggtgaacatgaacagtgtgatggacgccatgatcacgttgtaggcggcggcgatggtcatcagcactcgttccgccttgcgagccaatggtgccggcggctgcatggtgttgccttgcggattcatatcggtcctttccgtggtgtggcctcatccgatgtgcgatgcgcagctcgggaaagataaaatcacaggcccgtccgtttggggacggacctgtgcattatctcactcggccggtatcagcccttgaggccggaggtgatgttcagggactgcaggaagtacttctgcgcgaacaggaacagcagcagggtcgggatgatggccatgcaggtggccgccatcagggagcccatctggttgtactggcccatctggttgctcagcagctgcagaccagcggtgaccggcatcttgttgatgtcgttgaacaccaaggtcggccacaggaagtcgttccaagcgccggtgaagctgaacaggaagatgacgatcagaatcgggcggatggccggcagcatgatgcgggtgaagatctggaaatcagtggcgccgtcgatttcggccgcctcgtccagttccttcgggatgcccttcatgaagttgcgcaccaggaagatgttcgccacgttgcccaggccagggatgatgcaggcccagtaggtgttgacccagccgagggaggcgatgatgcggtactgcgggatcatgttgaccacggcagggaacatcgagatgagcagcaggacgaagaacagcgtatcgcggtacttgaagttcagacgggaatagccgaagcctgcgagcgcgacgatgcacacggacagcactgcgaacacggtcgagataatcagcgagttgcccagccagttcaggaccgggtagctggcggatgcctcgatcagcgtcatgtagttgtcaagcacccacttcgcgggcaggaagttgaacgcgttggaggtgaattcggccaccgacttgaacgaagtcgtcacggtgtagatcaccggaagcagccagacgactgccagcacgacgagcaccacatagacggcgatcagcgacggggagacctttttggttttgttttcaggaattgccgcgcttgcgacattgactgtggttgcagcggacatcttcagtcctccttattcatgaagatcagctggatcgcggcgatggccatcaggatgatgcccagcagcaatgccattgcggaagccatgccggcggccgcagggccggcggggaacgcgaggttcctgatatccatcagcagcacctgggtctggtagttcggtccgccgttggtcagcatgaccggctggccccacacgttgaaggcgcccgtggtggtcatgatggtggtgtagaacaacggcagcttgatttccggcagggtgatggagaagaagatcctgaccggaccggctccgtcgaccttcgcggcttcgtagaggctctcgtccacgccggagagcgcggaacggtagatgacgaggttgccgccgataccggcccacagcacgagtacgaagatggtgatccatgcgtacgggttcttgccgagccagttgatgtcggtgtggaaggtggtgttcagcagaccgaactgggagttgaagaccatacgccagaccagtgcaccggcggcgatggagatcaaacctgggatgtagaagatcgcctggaacagaccagcgcccttgagtcccttcttgctgagcgccacggcaagcagcagcggcacgatgatggtcagcggcacgctgaccagcacgaagagcagagtgtggccgagatcacgccagaagatcgagtagaaataggtgctggggtcgaagatcttcgcgaagttctgcaggccgacgaacttcggcgcaccgaccatgttccagcgggtgaacgccagtccaatgccgaagataatcgggatgatgccgaagacggcgaagatgatgaagtgcggagcgatgtacggcagcgcgtgccagatggagttcttgcgcttcatggatgattttgcggatccgatcgtagatgtcttgctcatcacgattcctcctgaatctcgatttggccctgggccatgaggtcgagggtcttcagaccttcttcaagaccaacattgccgtagacgatgtcgttgtatgtgccccaaccagcggtcgcatagcctccgtagaggtagttggaggtcttgatgtagtcgcgttccttcttgctgttggtgaaggacgcctggatcagcttctggtactccgggttgttcagatcgcggtatgccggcgagatggaaccgacctcagaccaatccatccagtgctcgtacacgtacttgacgaagtcggcggcggctgcggatttcgccgcggagcggtgcggatccttcaactgcatccagttgcactggtagaagaagttcaccggattgtcggcgccgtactgcagggtgttggcttccgcgatcttgtcggcgcccaaggtgttggacatattgccctgcgcccacgtgccaagctgcgcgaacacggccttgccggaaccgaacgcctgctcgccgtcgacgtccatcggggcgatcacaccggcgtcgtacgcttccttgagcttctccatgggcttgcgccacacgtccttggtcaggtcgtccatatcgttctcaagcgtgccgcccgcgccgtacagcagggacatgaaggcccacggcagattgccgtaagtcagcgcgtaggtgcccttgggcagcttgcccttgaggtccttgatctcgtcgatggtgacgaacccgtcgtcgaggatgtactgcaggttgtacttcttgaccaggtccttgttgtagtagatggccatctggtacagatacagcggaatgccgtaggccttgccattgacggtgacgcccttccaagtggcgggcaggaagctgctctccttgaggtccggggcgaccttctgccaatcgtccatggtgtcgagcagaccttgggactgcagaacggcggtctggaactggtcgccgatgatgatgtcggggatgttcttgccggtctgcatcacggaatagatcttcgtggtcagatcgccgccgttcatcggctggaaaacgaccttgtaatcgctctgggcgttgtattccttgacgatgcgctgcattgcaggaccgtcatcgcccaccagattgttccagaagtaaatggtcttgctttcacccgaagaggcaccacagcctccggcggcaagcacaagtccaagtgacgcacacacggctacggcagccttggcaaagcgccgcaacccggtaagatgcctggatgtagacattgtttccttccttttcctcaacggaccatcgctggaccgctcctcgttgcaatccgaatgggaagaatccttttcgattgagcctccctgctcatttgcaacgttgtaattttgattatacagctattttcatcgttgtacaaacggtaacacgccgacgacaacagccagctttatggatggggttatagacggggtgacccctccggccacgcccctcagtggcctacggccggagttcccgcaagcgggccaccatcagcgggcaacacgtccgtagtggtcggggtccacagattatcaggttccggcacgccgaaatccggaccgtcggcggtccacttgaccacaccgacgcgcgcgtggcgattcgggtcgaacagcggatcgcccttaatttccgtgtagttgcggcagtggtaaatcatcaggtcctcggtgccgtcctcggacttggtgaatgaattgtggcccggaccatactgaccgttctcggcgcaggtcttaaacaccggcaccgggctcttagtccaggaggccttgtccagcagatcgctgccgcgctcggcggtcaacagccccacggcgtacggaactccggtgccggaggcggaatacgtgatgtagatcttgttctcatggaacaggaaggccggtccttcgttgaccaggaaatcgatgcattcccagtcgtattccggcttggtcagcatgacgggctcgctgcccagcgtccacggattggccatcttggcgatatacagattggagttgccttcgatggcgggatccttctgcgcccataccaagtactgcacgccatcgatcacctcggtggtggcgtcaagtgcgaaggagtcgatcggggtgatgatctggcccttctccacccagttgtcggaagttggatcgtcgtcggtgttctccagcacgaacatgcggtgcgtcggcaggccggatgcttcgaaatccgttgcggcgcctgcgaagtagatataccatgcgccattgatgcggtgtagttcgggggcccagatgtagatgcttgccgggccggattcgtgcttgcgccacaccaccgtctccggagccttctgcagatcgttgatgctcgacgcgtgccggatggcgatgcagttgtattccggatcggaggcggtgaaataatactcgccgtcaaccttgagcacccaggggtctgcgcgctgaagcacgatcggattgttgtaaacaaccatgtttagtccttctcaatccgttgttccagtatttacaacgttgaatatatcattcttacatcgttgtaacaacttgggcgcgtcattgccggaagatgcttggatgcggtgccgccgccgggcatgggcgtccatcgtttgcgccattcatgccaatgtcggtgccgccgtcggtcatgggtgctcgacacactcaaggccgttcggccaagcttacggccgagcgcccatgcccggcggcggcaccttgggggaagagccgactcaatgggtacgcacgctgggagaaacttgccggaaggcaagcgaaagctcagaggacgagggaatcgatggggagtttggtggattggcgcacgaccagcgacgatgcgaccttgcggaagaccttctcccccggtttgtcggcattcgggtcacggccgtcgatacgctccttgagcaccttaagcgacagacgggctaccgcctcaagtcccggcgcgatcgacgtcagcgccggcgacaggtactgtgaatcgtcggaattgtcgaaaccaaccacggagatgtcgtcgggaatgtgcaagccgtgcatctgaatcgcgtgcatcacgccggaagccagcatgtcgttcagcgcgacgacgccatcgacttcgacgccggaatccaacaacgcgttcatggccctcacgccgtcactacgatgccacatgcccgattcgacgaccagccgatcgtcgaattcgacgccggcctcctccagtgcctcaagatacccttggtagcgcagcgcggcggaaccgactttctcccccgggtgcacaccgaccacggccacgcggcggcaaccggtcgtcagcagatactgcgtggcccgcttcgcgccttccacgttctcggtggcgatgtgatccacctggtcggtgaagatgcgttcgccaaccagcacaagcggataatcgaccttcagctgctcgacgtcatcctgcccaagctccaatgggctgtagatcaggccgtcgatcatcgtctgctgggacccgtgcagcgcttccaactcgccatcgcgcgaatattgcgtcggctccacgatcacgcgcagaccgactttcttcgcttcttcgatgaccagcgatgacagctgcgcgaaatacggcatctgcagatcgggaatggccaagccgatgatgccggtctgccctcggcgcaggttgcgtgccgacacgttcaccgtgtatcccagttccgcgatggctttgttgaccttgtcgcgcgtgacctgcgagacgaattcgtagtcgttgaccacgttggagacggttttgatcgacacaccggccgccttggccacctcacgcatggtcacgacatgctcgccgtttccccccgttcgcttcggcatatataccccttttgtcattcagcggactcagtcggcatcgaagaaaccaacctccatcgttacaccagcatagtcggggtcgagttcctccgccgtttgcatatccaggatgggcatgccctccttggaccagtgcacgcggcgcacctgggcgtcgcggccaccatagcggccgtgctcgtattcggcgttgtggaacacgtagatgaggttgccgtcctcgtcatgcgaccacatgccgtggccggtgccgagctgccaacgcccgttgtacatgccggacttctgcagcggataatcgagcttcgtccatacgctggcgtcggtgagatcggccccctgtccagccggggcggtgaccaggccggtcgtgtagtcgatgccgaccagcgagcccgagtagatcaggaaaatcgttccgtcatgcacgatggcgttcggtccttcggcgatcatgttgtcccatgcgaattccggcacgacgatctgcttcggcttgctggtgagcctcgccggacgagccgggtcaaagctggcgatccagatgctgccgacctgctgccatgcgtagtaccagcggcccgaatcgcacaacacggtcatgtcaagcgaaatgcgctggatcggattgagcgtctcgccatccgggtcgaggataggctcgggcaccgtccagttctccggctcgcgcggatcaaaatccgtgccgtcggaatgctgcttgagctgcatgatgtggcagctgccggtccacatgtccggtttgccggcacgatcgttgggggtgccgtcgggattgacgcgcggcccatcgaagcagggcatgaacaggaccgacagcttgccgccgatcacatgcagttccggcgcccagaagcagccggtcatcggacgatcttcgctattgagatcgccgcatgcgagcagatcgatctccctggcccgtccacccgcggcgtcggaaagcgcttcgatagagtcggcgatgcgcagcggcatatgggttctaccgtcgttcggatccacgcaattgccgtcggtgtcatcggtggcgatgaacatgaacatcggcttgccattgaaatcccacgcgaacaccgatggatcggcgcgctccaccgcgaacggcaccggatagacgctctggcggatcacaccttcgacggtacgggtctggccggccttgaacgttccctcggaggcctcctggccgatggcctcaagctgggccatgttccaatccaccgcgcgcgtggcctgcgaaccgtcgctgtatgacagttccgcacgggttgcggccaaggccagaaccgcattccgggcatcctcaccatgcaggcccgcatcgattcgctgggcgggcacggacgttccggcattgcggatgcggccgaagcgctcgatcaggcgctcggcctccggctcactgatggcgatgctgttgccgacgacggcgttcggaatgccgcaatccccggtctgacgcaacggctgcgacgacgccgattccacgacatcaagcggcctgcccgaaccggcggcggctacgatatcggccgtccgcgcggtgcgtgccttgccatcgtcaccggtccaggagacgacgtagcacgcgtccgcggcgtcgaaagagacggacgggcgattgaccccaccggtggtgcgcaacagcaccagcccccgctggtcgaacgccgtcagatcatcgctgatggcgagcaggaatgccgaccgttcggaaccatccggctcaccgccgcgggcggtacgggtcgcggcgatggcgaatcgtccgtccgcgagacggaacaggaacggattcttcagcgatttcagcgtgatatccataccgggcatgaccacgccatgggcgacggcgtcggtggcggggcgaggcgcgtcgaaccggtcggcggcgaagcgcgccgcggccgtgcacgcacggcgggattccgcggtcgcggcggcgatcggcacaccggccgcgaagaagatgccatagttttcgttcagcggccgccactcggcgtcatcgccggaacgtagcgccaaatgcatgctgtaggcgatgtcctcgttgttcgcctcttcgcgtccggtggcttcgcgtgtatagcacagcagggaataattggccgacatggaagatccttcagtaagcagatacaggttttacaacgatgtactataccgtgttttacatcgttgtacaacttggtgtggcggcattgcgacacccttcatccgcggagaggaagcatcatggaacgcgcttgtcgcacttgtgagcgggcgcatcgcatggcacatgacaacgacgaggggcttcccggttacccaggaagcccctcgaatcatatccggcgcgtttgctcaacgcgtccgtgcaatcagtgcaatcagcgctcggaacggttgatggccgagatgatggccttcagcgagctggtgacgatggaggtatcgatgccgacgccccacacgatgctcgtgttgtcttcctcgccgatctggcattccacataggaagcggccatggcatcggtgccgacggacatggtgtgctccacgtaatccatcaccgaagcctcgatgccaaagttgctcacggcgttgaggaaggcggcgatcggaccgttgccgatgccggagacctcacgctccaccggctcgtcgacaccaacgtttacgccgcggtcgagaatcctggccttgagcacggtgtcggaaccatcctcgccggaggagacggacaccttcagcagtttcagacggccccactgctcgagggtctcgtccttgctgtcgccgaccacgacaccagccgcggtggcgccggattcctcgaccggcaggtactcgtccttgaacagacgccagatgtcctcgtccttgacttccttcttggtctcgtcggcgtagttctgcacgaccttctcgaactcgacctgcagacgcttcggcagatcaaggttgtggttggtcttgagcaggtaggccatgccgcccttgccggactgggagttcacgcggatgatggcctcgtaggaacggccgatgtccttcgggtcgatcggcaggtacggcacgagccacacgaagctgtccagatcggcaccggcacggtcggcggccacctgacgggcctcaagacccttcttgatggcgtcctggtgggagccggagaacgcggtgaacacgaagttgcccgcatacggatggcgttcggagatcttgatctggttgcagtattcgacggtcttgcggatttccggaacgttggagtagtcgatctgcggatcgatgccctgggtcaggaagttcagaccaagggtgaccaggtcgacgttgccggtacgctcgccgttgcccagcaggcagccttccacgcggtcggcgccggccagcacggccagctcggtggcggccacgcccatgccctcgtcgttgtgcgggtgcagggacagcaccacggcgtcacgcggtacgaggtggttggacacatactcgacctcgtcggcgaagacgttcggcgtggtcatttccacggttgccggcaggttgatgatcatcggatgttccggcgtcggcttgatgacgtcgatcaccgcgttgcacacctcgactgcgtactccggctcggtgccggtgaaggattccggagaatactcgtagtacaggtcgatgcccttggcttcgccctcgagctccttgcacagggtggccgcgtcggtagcgagcttcttgatgccggccttgtccttgcggaacacgacctcgcgctgcagcacggacacggaattgtagaagtgcacgacggcgcgcttggcgcccttcaggcactcgtaagtcttgcgaatcaggtgctcacgggcctgggtgagcacgacgatggtgacgtcatccggaatgagctcgcgctcgatcagcatgcggatgaagtcgtaatcggtttcggaagccgacgggaagccgacctcgatctccttgaagcccatcgacacgagcaggttccagaaacgcagcttgcgctcggaatccatcgggttgacgagagcctggttgccgtcgcgcagatcgacggagcaccaacgcggcgcacgctgcagtcgcttgcccggccacgtacgctccgggaaatcaaacggcacctgcttatcgtatgcgacgtacttgttgtacggcatcttgctgggcttttgcggagctccaatgtaacgcgccggaggcagcagcgggtcgttgttccctccgttggacgccgcggcgactgccgcgagatcaaacactgacgattgatcctgacccatcactcctccttatctgtaaagtcggatcggccttctgccaatccacattgttacgtgcatgttacctacctgcactgccgcccatactagcgacaaccaatcccatattttgccggtattccgcgatatgacggcatggtttgcgattttcgcgcccttatttcaccccatatccagatttgccgcagtacagtgggcatcatgagcttgcgattcaacagcgacggtacgttccgggtgctgcaaatggctgatattcaggatggtccggacgtgcgcgaagacacgattcggctgatcgaagccgctatcaggaaggcacatcccgacctcatcgtgctcaccggcgatcagatccgcggctacgatccggcatatatcgatacgtttctacgccgccgtggcgaacagcccggtacgcacgtgcgcgcggtcaccgaaatcgaagcgaaaatccgcggcatcaaacgtcatccgatcgccaaaacactgaccaaatcgcagccctccgacgaacggtggatgatcgacggcatcggcaccgattcgccgaaactggtgaaaagcgcaggtcgcaacggttctgccagcaagctggaatcgtgggcggaagccatcaatcgcgtcaccgcggcgtcgctgctcgacgagacacggcagaaagtgcgcgacacgttcgccgcgtttttggggccggcgttggaatcgcgcatccccttcgccgcgacgtacggcaaccatgatttccaatgcggcatcctcgccgacgaacaggacgatctttaccgcgagtttgccggctgtatgaatcccgtcgccggctcgtcgccgttggcgctcgaaccgggcacgttcgcgttgccgatcgaagcgtccgacggttcggggcgtatcacaatgagcgtgatgatggtcaattcgggcgattacgccgacacggcagacgcggacgacggcaacggacggcagtcggtcaccgaatacgcgaaatacgcggcgaattcgcgcggctgggatttggccgactccgacggctacggcaccccctcgccggaagccgtcgaatggctgaagcgcgtacaacgcgagttgggcaggcgcaatggcgacgggcaggcggtgccggcgattgccttccagcacattccgccgcaggaattctacgattgcctgcgcgaagtgcccgcctacacgccgaacgccgtggagggcgcgcgcgaattcgcaggacattgctatgtgctcgaccgcgatgtgtgccgacccggttcgcggctgggcgaggcgattggctgcgccgacgtgaacgtgggcgaagtggacgcgttgcgtgaggcgggcggctatttcgcactgttctgcgggcacgaccacaagaattcgttcgtcgggcatgtgcacgacatcgatttggggtacgcgccgacctgtggttttgaatgctacggcccgaaatcgcggttccgtggcatccggctgtttgaattccgcgaagacaatccgatggcgtacgtgacgcgcatgctgacgtggggcgatctggtcggccgttattccagcaacgaattacgcgtgttcttcgaggaccattgcgtgacggacctgatcggcgtgcgcaacgagctgcgcaggccgcaggtcagcgccacactgctgggtgcgggcgcggtggcctgcggcgcgatcggatacgcggtacgggggctgttgcgcaaatcgcagtaatgcgatgctcgtggcaatcgcaatgatcgacagcgactcgacggcagcaccgccgacaacgcgaccttatcgaatatcactcaagatatttcgattggaagaaggcgtcttgctgtgattcgctaccgagattcgtgtcctcggcattcacgataatcggcgtttccagctttgcgggcatgctgtcataccacgcatggctccagccgacgatcgcttcgctgagctgcgaactgtcgtatcccgccggatataccgtgaatgcaccgcagggggcaatgccgtaggggtcggcaaccgtatatttactaccgtttttgatatacgtgtctcctatattgccatcgattttcagcgccgatttgtcgcattgcatcgtatagctgccgtccgcgttcttcttggcatccttgaaacggcctttgaaattcgaaatggtgaccgatccgttcggatagtcatctcccgtaatgcccatgtcggaatcatgatatgttccgctgaacgtgccatcggacgccaccgtcatagtggtgccccaaccgccggaaccggaagcgaaaccgtactttccggcgatggacttcatcaaagaccgagtggcggcatccgattgggaatcagatttcttggtgtctgcgttcttgcttgcatttttgccgttagatttctgactcttggcggacacgcccttgatgttggcgtcttcgagggaatcccagtcgggctggacgtcctccaccagatagtaggcggtttcgccgctgggggcgggcttcattttgacggtgtcatccttggagccgttgtagccgttgtaaggcatgaatggattgaaccagtcccttgtataggttgattccttctcgccgttcttgtactggttcacgtcacgatacatcaagaacggacggtccgtatcgacaggtttttgcttttgggcagccgcgagcgcagacgcgtcaaaatagccagttttctctactgattccacatcagagccgactgggaacaccgcgaacaaatccatcatatggaatttaccgctgccgtccggctcataatcggacgcatccgaagagtcggaatcaatgtcatggacctttccggcaacacaattccgcatatcgccttccccacccaaggcggaatcgccacaccaatacgtttcgaacgctttgtgtgggaacaattcaaatgctccagagtttccagtcaacagatagtcggctttcttgctgctgcaatacggctgttgcaccgcatcgcaggaaatcaaagactcaccggtcatgctgtacttcgtgttcgcagcaccatctttcactttcaggaaaacgatgtctccgctggaataactgtcatcctgtcctagcgtgatgcagtcgccggccttattgcaccactggccagaagcaacgtcactcgtgcccatcagcaacccatctccaccggttccgctgtggtcaatgaacgtctgcttggcacccttggcatccacgccctgatacagggtgatggtctggccttcgttcagctggctgcccggcccaggttcggagccggagaccttgccgatgtactgtttcgatgagagacgtttctccactttcacgtcgtagcctttggattcaaggcttgatttcacgtcggaaatttcctggccgacgatgtccgacggcaggccgtcgtcgcttttcgtggccacgccgatgtagatgcctttcttaccatccttcacgccttggccttgcgcggggtacgtgctgatcacgcttccctcggtggttttgctggtgtccgacacgatcacctgcttgtaatgcaccggcacgcccatctgcgagaacgttgtcaccacgctttcagctttcttgccgaccgtaccttccggcacgccagggccggccgattcgcgcaccgtcaccacactgcccgcccttacgcggccaccggactgaattccctgatagccaaggaacttgccgcttttcacgccggagaattccttgacgcgcttgactttgaggcccttgccttcaagctgcctgaccacgaccttcgcatccggagtcttcgacgagtccttgggagacgccaccgccacgtccggcaacgacttgccaccccacaactccatgttgtatgtcacgatgccggccaccacagcggcgaccagcagcaccgcggccaccgctatgccgatgatgagcttgcgattcggggacgcggcacgcgcagtcccgtcgctttccggctcaagagtttccggcgccgacggaacggattgcgatgcagccgaagtcgcgggctgcgctacgggcagcgtgccgccgcccggcaacgggaccggcggaatcgcgtctgccggctgcgaagcgagctgttctgcagggcgttcctcgtgctgtgccgcagactgttcctcgggttgctccgcagactgcggtgcgagctgcgatgcaggggtttccaccgctgtggaatcgacggaaaaatcatccgaaatccgtgcttgtccggcatcaggctgcaccggaacggagaccaacggattgccgcagttcgtgcagaacttcgactccggagcgttcttcgaaccgcattgcgtacagaacatggcttctcccctgcttcagtttcttctctgaaatcgattatagggagccggcgcggtaggccgaaagactaccggaacaggctcacgcctcgacgggccatgcagtaggcgttacccagccacgtatgacgggaattcggccacaccgcgcccaatcgcggagcattctggctcatccagatactcggtacgcggccgtcagcggaacgcgagcccagcaggttgaaaccgttcttttccagcagccattccggatgctgtgtggcgatcgcaagcccctcttccaaagtcaacggcaatcgctcgtcggaatcgatcagcttgcgtgccacgtccggctcgcggttgatatagcaggtgccggtgtgcggttcgatcaccagatagaacgggccttccggcggttcgaaaccgtcctgcggcaggaagctggcgatatcgcgcggcggcatggtggtgaaccccgccatgcggttgatggaggttcgggcgatcagcgattcaggagacaccagctcgcgcgtaggtaccagaaggatctgcgtgcccaatccagcttcatcgccgcaatcctccaacgcacggataagcggacgcgcaagcgagcggaacgcggctgccgacatatcggccacatccgggtagcccaacgccacgatacgatccagctgcttctgcgcttcttctgatgccttcgacatgtctaccagtgtacgcgagcgcgtttaccgaccagcatacggatagctcggcggacatgacggcatgttttcgtaagattgaacaacgcgtgtggccgcccacgacgtcgttttgggccggctggtcgacctcaagcgtaagcaaaatcaaacttgcaaaacttggaaaaccgttccagcataagcgaaaggttgttatgtccgaaaagattaaggttggcattctcggagctacgggcatggtcggacagcgcttcgtgacgctgctcgaaaaccatccgtggttcgaactggtcacccttgccgcgtccgcgcacagcgccggcaagacctacgaggaggccatcggcagccgctggaagatggaaaccccgatgccggagttcgtcaagcacatggtcgtcaagaacgtggccgacgtcgaggacgtggtcaaggacgtcgacttcgtgttctccgcggtgaacatgccgaaggacgagatccgcgccatcgaagaggaatacgcgaagaccgagaccccggtcgtgtccaacaacagcgcccaccgctggactccggacgtgccgatggtggtgccggagatcaatccggagcactatgaggtcatcgaacatcagaagaagcgcctgggcaccacgcacggtttcattgccgtcaagccgaactgctccatccaggcctatactccggctttggccgcgtggaaggaattcgagccgcacgaggtcatcgtgagcacgtaccaggccatttccggcgcgggcaagacgttcaaggattggccggaaatggtgggcaacatcattccgttcatctccggcgaggaagcgaagtccgagaaggagccgctgaaggtcttcggccatgtggacgaggccaagggcgagattgtgccgttcgacggtccgctgcgcatcacctcgcagtgcatccgcgtgcccgtgctcaacggccacaccgccaccgtgttcatcaacttcggtaagaacccgaccaaggacgagctgatcgaccgtctggtcaactacaccagcaaggccgccgagcttggcctgccgcacgctccgaagcatttcatccagtacctgaccgaggatgaccgtccgcaggtgctcaaggatgtggattacgagggtggtatgggtgtttccatcggccgtctgcgtgaggattccattttcgattggaagttcgtgggattggcgcacaataccctgcgtggcgccgccggtggcgcgctggaaagcgcagaaatgcttaaggcgttgggttacatcaccaagaagtgatgcgacgtttatgcggcttgggtagctaaaccgtaagccgcataaacgagccatagccaagcaaaaggccgactcttcggagccggccttttgcttgtttggggactgcttggcacggtatgcaacgtacggcgtgaatcgtaaaaagcaaacgaaaagggcacggtcgcaaaaccatgccctttaaaaataccgggaaactgaagccagcactatcagcggccggtgccgccgtacaccacggcttccacctggtcggcgtccagaccgtaggcggtgtgcagcgccttgacggcgtcgttgagctgctcgagcggtacaagcgcggcgatgcggatttcggacgtggagatcatcagcacgttcacgcccttgtcgctcagcgcgttgaagaacttcgcggccagaccggaatgggtcttcatgcccacgccgactacggccaccttgccgacgttcgggtcgacgtcgaaggactggaagcccagctcgccctgcttctcctgcagcacttcctggaccttggccgcagcggtgcccggcacggtgaaggagatgtcggcggtgccggtggaggcggaggcctgcacgatcatgtccacgttcacgccggcctcggccagcatggtgaacaccttcgccgccatgcccggctcgttcggcacgcggcgcacggtggccagcgactcggtgctgtcgtgcgcgacgccggagatgatcggcacttccggccccaggtcggggaacaggtcgcccatggactggttgttgttttcgctcatgttcttacctttgtttgtaaagtcttattttcgttttcgcgttgtcttgcaattatttgcgattgcctgcgattacgctgcccggctgccgttcagatgttcggcagggtgcgcggatcgacgccttccggcacgatcagcgtgccgcgacggtgggagaaggagctgcgcacgtgcaacggcatgccgaatcgctgcgcgtattccacgcaacgcaatgccagcaccttggaaccgcaggacgacatttccagcatcgattcgtagtcgatgacgggaatgcgacgggcggtcggcacgatacgcggatcggcggtgaacacgccatcgacgtcggtgtagatttcgcagatgtcggcatccagcgccacggcgagcgcgacggcggaagtatcggaaccgccacggccgagcgtggtggcgtcgccgccttcgttcacgccttggaaaccggccacgatcgccacggaacccttatccaatgcacgacgcacgcgatcgggcttcacggccttgatatgcgcggtgccgaactgcgcgtcggtcatgaaaccagcctgggaaccggtgaacgagtatgcatgagaaccggccgcatgaatcgccatagcgagcaaactcatcgaaatacgctcgcctgcggtcatcagcatgtccatctcgcgcgccggcgggttggaatcgatgctgagcgcctgatcgatcaggtcgtcggtggtgtctcccatggcggagaccacgacggccacgtcattgccggcgttcttcgtttcgatgatgcgtcgggccacgcgcttaatcgattctgggtcggctacggaagagccgccgaacttctgcacgatgagagccacaacttatccaatcttcttcaacgtatcacctgcctgattcggcaagtgaagcctattataggaaacatccattttgtcaagtccaaccgcgcccaacatgcggaacacgttgctggacagcggttgagtatgagctgggcgcgggaccgacggctcgcggaggccatgccagcggagctcatacggcgcgacggccggcgagcgcgcggccgagggtgatctcgtcggcgtattcgaggtcgccgcccacgggtaggccgctggcgagccttgtcaccttgatgtcggtctggctcaacagctgcgagaggaagctggtggtggcctcgccctccacgttcgggttgagcgcgaggatcacctccttgacttcgctgtctttgagccgttcgatgagtttggcgatgttgaggtcgcttggctgcacgttggccatcgggttgatgacgccgcccagcacatggtacatgccccggtattcgcgggtgcgttcgatgctcatcacgtccttcggctcttcgaccacgcagatcacgctgtggtcgcggcgtgggtcggcgcataccgggcatgggctggtttcgcacacgttgccgcagatatcgcagaaccgtactttttccttgacttccgtgatggcgtcgatcagtgtctgcgattcctcgtcgggcgcgttgagcagatagaaggcgatgcgttgcgcgcctttcggcccgatgccgggcaggttggcgaacgcgtcgatgagtcgttggatggcgccgtcataggccaaagccatggttcatacctttcgttgactggttgccgcagccacgttccggacaactgacgtctgatggccagcgcccggtactcgccgtacgataagcgacatgcgacgtgcggtggccggtgtcagtcgtcaagtgttttcttcacctgcatgttgcgcggattatgcggatcgtccgagctgaattcctcgactttcttcacttcgaacaccctgttcaggtcgttcatgtccaaagcgttcgatgcgccgatcgattcgtcgctcatggagtattcgtcgtcttccggggcgacttcaggctccggcggtcccgcctgcaccggcatgggggctccccatgggtcatccgcgaatcctgccggcgatgatgccggctgctgggcctgttgcgattgcatttcgcgggcgctttgccgtgcgctatgtcgttcgctgtgctgttccggctggttttgccgcggctgctccggcccattcggttggccttgctcctggccgtccgtctgcggcgtgggcagtggtgtggcccatgggtcgacgtcatcgctcacatccggcacgtccacatgttttacgtggtgttccggcggctgtacgtcgttggcgttgccttcggcgatgggcgtctgcggaattggggtgttccacggatcgtcgtcttccggctccttggcaaccttcttgccgaggttcgcggtcagcagggtggcggccttcagctgttcctgcaccagctgcgcgttgatcttgctctgctcttccgggctgagcttgctccacggcaccgcggtggaaccgtcggcaagcttcttggccggcgcgagagtgacatcggggccgaacaccttatgcacttcgccgcgcacgatctgcaccacattggtggtgccgtcgactgcttccttggccacggccttggcgaacgcgtatttgctcaacgacttgtcgaatttaatccacagtcggcctttggccccgtccagcagcacgcggggcactttctcgcggtccacgtagcgacggacatcctcaggcaggccggcaacgatcgcgtcccacttctggtcgggagtgcgatcgtccgttgccgcaggctgaggcacggactgagccacggactgggtgggagcggatggttcggcattggatagtttggatggcgcagactgcgtttcaaccggcttggactcggctgaagcggccggctcgctgccttccgacagaggtccacccatcgcctgctggacttccgccaatacggaggccgctccggaaacgacggcatcggccggattcgtgggagccgcggacggttccacggcatgccttctacgtgccgattgcgcggcgtacctacgggaaccggacggacgctgcgattcagacgctgcggcaccgcccgcatgcccagcttccggcatgccggacgatggtgcggcggcttgcgcgaccacgcccgtctcacgaccggcaagcaggcgggcggcgagcagttccaggcgcatgcgcggcgaaatcgcaccggtcatgttggccagcgtggcgttgatcgtatccgccatctgcgtaagcgcggccaatcccagcgaagccgcctggcgatgcagatcgtccatgttctcggtcgcggtgtcgtcagacagcacgctttccgcacgctcaccgcccaaggtgagcaccaacaggtcgcgcacgcgcgccagcaggtcctcaacgaaacgtcgggggtcgaatccgccgaccacgaccttttgaatgacgccatacagcgcctcgccgttcttgtcggcgacggcgtcgattgcctcgccgataagcgcgtccggcgtgaaaccaagcagcgcgaccgcggaatcgtaaggaatcttgccgtcgacggcaccgaccatcagctggtcgagcacggacagcgtgtcacgtacggatccgccgccggcacgcatggccaagcgcagcacacccgcttcggcctcgatatgctcgtcggcgcagatctgctcaagatacgggcccatgacctcctgcggcaccagacggaacggatagtggtgggtgcgggagcgaatggtgccgatcaccttgtccggttcggtggtggcgaagatgaacatgacatgctccggcggctcctccacgattttcaggagcgcgttgaagccctgcggcgtgaccatgtgggcctcgtcgaggatgaagattttatagcgatcgcgggccggggcgaatccggcacgttcgcgcagttcacgggcatcgtccacaccgttatgggaggcggcgtcgatttccaccacgtcgatggagccggggccgccggtggcaaggtcacggcagctggcgcattcaccgcacggatgcgaggtcggacctttggcgcagttgacgcaacgggccagaatacgcgcggaactcgttttaccgcagccgcgcggtccggagaacagataggcgtgcgtgagcttgttctcgtcaagcgcacgcatcagcggaaccgtgacctgatcctgtccgatcacgccatcgaacgtgtcgggacgataccttctatacagtgccagtgccatcgcaaattccttccgccgtagtgttctagagtatcgatgaattacgacacgttcgccaatcgggaagcgccgaagccgaccatctccgcaagtccatcgcgtgtctgtctgatctacaaccggcgcagccggtactctggaaatcagacatgaaccgtgtgatcggcgtaccgtcggtcacgaacgctgactgttgcgcgcctaaaacccgtgcgtcaccaccatgccgcacaaggcgttgccacgcgattgggaggagagagccatgaccgggaaaccggaagcgtccaccagcaccattggagacgcgcgtcgcttgcagatcgtgcaggcggcacgtgagatctgcttggaaaaagggttttcgaagatcacgatcagcgatatcgccgaacgggtcggcatgaccagatcgcttttctaccactatttccaagacaaagaccaggttgcggatgccgtgctcgacgatgtcatcagcgaagtcatcgcccgcctagaagagtggaacgagcatcgcgaggccggcaacatctcgaaggcgcttgacgatgtggtgcggctgacccgttcgctcatcgccgatgaaggcccgttcagccaacgtctcatcgaggatggcaacgctgcactgtatctgaggttcatcgaccgggccgcggaccgcatttccgaatacctgtgcggttccacggtacgtgaattcgaggaaaagcacggcatgccgatccgcaacgagcatgagaccttctacacgctgatcgtcggcttgatctcgctgatcagactgcatcctgacattgacgatgacattgtcaggcaggtggcggcacagacgctgcatttggacgaatatctgtgacggtgctctcacacgcgtcattcccgccggcaagcaacatataacggccgttcaacgtccggaggggcatcgagcggcaccggctggctgacggaaaacgacgtcaggcgaggaatctaccggtaagagggtcacgaccgtcacgtttgatggtttccaacacccgttcctcgctgtcggccgcctgcgcttccgccacggccggcggcaccagcacacgcagcgcacggtccttggctaagaccttcaccggcaaatggcccacgtattcgccatcggccatcaacaccggaggctcatccccttcggtggcgcgggtgatttcgatgtcgcgcacccgcttccatccgaaagcatggctgcccagcagtcggccgtggtaggcgcgtgccaccgcgtccacgcactcccggaaattcggcacatggtcaagccacaccagatcaagcagtccgtccgcgaaccgtgaatacggggacacctcgatgccgccgccgatatggcgggaattggccacggtgagcagtggcgagatgatatcccgctcctccaccgaaccgtcggccagcgtggccttgatgtggtatccgtagcttttcatgtgtgtcagctccacgatgaccgcggcgaaataccgcagcgagccattcggcagatgcgaatgattggcgcggtcgttgatgcttgcgtccaaaccgcacgacagcatgcccgcataatagcggtcgatcggcgagcgcgactgtgaaacatcggttccgtcggtcgaatcgatggcatgaccgtcaggcaacgaagtcaccaagcccatgtccacgtcgatatgcgtgccgcgcacaatcgcaccgacaatgccttcaacggcggtttcgacgcgattgaccggcaaatccagtccgcgtgcgaaatcattgccggagccgatggccacgatgccgagtggtttgccggagcagccgactgcgttggcgcctaacgcgaccatgccgtcgcctccgaccgcgaccagataatcgtattcgtcgccgcggcggcgggcgttggccagggaatcgtcgaagcttgtgccggtcacatcgattacgtcgaagccatgcttgcgtccggctccgcgcagcagatcaatgacatgaccgcccacttgggcgcccttgcctttgttcgatgtcggattgcagaccacggcaacggtcgtattcgcatgtgacgtcttgctcatacttgtacgataaccatgtttcacgtcaagcgccagattgcccattaccttcagctgaacattccgtgccgtcatgcaacgactgtccggcaatctcctaatcacaggcaataggccccgcacgtgactgccggacgacccacggtgcgaacggcacctgcgtggccgcctgcacggcgaccaccgcatcctcgccttcaatggcacaggattcgagccgggttccattgcccgacgttgtacgcgatgcggccgcgcacgggtcggcggcaccgtcacgcagcgactgcgcggcggccaccgacgccaggtcggccgtattctgcgcgcgatgcacgcacaatagcagattgcctgccatggcgaccgcaccgagcatggccgcgacgattgcgatcagcgcgactcccgatatggttccggaaccttcgtccgtgcctttcaacacatgcgacacacgtcgcacacactgtttcacgccatgtttcacggaagtcgcttctttcttatcgcgcattggaagcctttcaaaaaccgttacggacagcacgctgtcatgaacatcgcaatcagaaataccgagttgccttgcccacgacgctggcgggcagcacgccggtcggatccgccgcaaccgggcaacgcaccacaacggtgacgctgttcgcattggcggcgaacgacaccgtggaaccgccaccggcaatggtttgcgccgcagcgcgggctttcgcttcgccgccggcgtcaatcgccatggccctcgcaccggcggccgcagcgtcctgacagttcatggacactatggaggcacgccccaaacacagcaccagaatcgccaccgcggccacgcagggaagcaccaccgcgaattcggcggtgacggttccgcaatcggcgtcacgggcatggcgtctccaccatcgcgcaagcatggttaccccacgctcaacgctttcttgatgaggccggtcagcagcgttttcacgacatccgatttcacgatggcgatcagaaccgcggcgaatgccgtggccgccaccagcaccaccgcgtattcggcggtgaccgcgcccttctccggctcggcggtcagcaggcgcatgcgcgcgtccaataggcagaccgccttattggcacgttccttggccgcacataacttctggccgacgcgacccatcagacccggcgaaccatcgacattgattgacattgcgtcgttcatgacgctcctttcattcggctaatcccggccgattgaccgggtacgctcagtgtcaggtattggcatcggcgatggcatggttttcgtgggttgtggtcgaagaacgtgggttatccacaccctcggcgtgtcatccacacttatccacaagcgattagggcatgacggaacggaccgcgcatcatccgtcattccgaccgcggtccgattcgagcaaatttgagccaattcgcaccaacccgcactaccccatggcgaatcggccgctacagaaacgacatcaccgccggaatcacgccaatggcgacaaaggccggcagcatgcacaggccggtcggtagcaacaaccgaatcgacagtttcgccgccgactgttcaatccgcgaccgttcatcccaatccagctgctcgattgcggttgccaaccgattcaccggcgaggagccgctcgaccatgatgaggagaacgtgtcacggaccacggcgcaatcatcatcgtcaggccatgcctcattccatggcatgccactattcagccgttctccagccgagcgcaatccaccgccgaactcgccttccacaatgtttccgaccgtaatcagcgcgcgtggaatggacgctccttgacgtatcgccacgctcaacatttccaatatcaagggcaatggcagattgcatgaccgcacgtcggaatcgggcggatttctggctggcgaccattcatacagccatgtcgcgccagcggcgcccaccgctgccagcatcggccatgccaagctcatcgcacatgctcctgccgcatcagcctgcgaatccaataccagccgaaggcataacagcagccggcgaagccgaggcacatccatcctttcacgtcttccacaaggaatcgcaagggatgggctcccatgcattcccctagcatcaccgtcagcaacggcaatgccatcagcagcttcaccgtggcctgcggcatggcaaaagcgttggcacgcaagtcgtcgagcagccgtcgccgcttcaacgacgccgcgacggcctccaggcatcggctcatctcgcagcccaactgcagactcaacgtgcaggccgcatgaagttccgcaccaagctgatccacatgcttgtgttgttcctgaagcgagcagcggcttcgtacggccatgtcaatacggaaacgggtcagttcaggcactgcgaaaggagcgccctgtaattcctcgaacgcttggaccaaggtggctccgctgcgtacggacgcccgcagcgcggccacgcatgcggcagcgccgatggtcggcatccgtggcgatgcatcccggttttccccatcgttccggactgttctgccatgcccgtcggattcatcatcacaagttccatctccatcggccccgccgctatcgtcagccgaacgaagcccgaagcgaaccagcacacgctgtaatcgccgcaatcccgcccattccgcgttccgattcagccacagccagacggccatcgacgccagccatgcggcgcaatattcccaaccacacgcatcacgcatcatgcgctccatcggctcatgaatccatcccaacgttggccggcacggaccgtacggccatcccaggcggccagcagacgcccatgcaatcgcccttccaccgcttccaatctgccgacctgcgcaatgcgccgtctgccggcgatacgttccacatgaagcaccacgtcgaacgcatcctcggcgagcgccgccgtggcacgtggctccaatccggccagcaaacccaatgagaccaatcgcgccggaaccgcctccacttgattggcgtgcaatgtggtcatgccgcctcgatgcccggaattcaaggctctgagcagatccacgacttcaccgccacggcattcgccgaccaccacgcggtccggtctcatgcgcagcgtcgcgcagatcagttcggaaaggcctatgccgccggcaccttccgtgttggcttcgcgtgtgaccagagacacgtggttggcatgttggatcatgcccaattcgcgcacttcctcgacggtgacgatgcgctcgttcggcgggcatcgcatcagcatggctttgagcatcgtggttttgccggcaccggtgccgcctgtcaccagcacgcttgccttgcaggacaccagtccggccagcaggggcagccattcggctggaaacatgccgttgcgcgccaacgattccagattgggcgagaccgcatcgggcaatcgtatgctgatggccgcgccttgcggcaccagtggtgcgatgacggcgtgcacgcgcagaccgtccacggtggaggcgtcggcgatcgggcaggcgtcgtcaagccgtcggccaagttgcgagcataatcgcactgcgaattcacgaatcgactgcgctgacggaaagcatctgcgcagcagacatacttcctgcatgccttggccgcaatccgcccaaaccgtgccgtcgcaggtcaccgcgatgtccgtgacgcccggctgcgaggcgatggcgctaaggggtccgagttccatgcttcacccgcttgccttccaacgattcctgcagttcatccgtaagcgcggccaaggctttgacggtttggcggttcggtctgcgcaggcccaggccgtccaacagttcaccgcatagcttggcgtccggtttgacaaccgccgcgagggaatggccaagatagttttccgtctcttccagcgtggtcacgccacgtccacgcgccacgccgcgtggttcaacgccgacgatatggccatgtttctgccgttccgccgttccacgcgatttcatggccactctggctcgggccagtccgagcaccgtcatttcgaccacggtgatgtgtgtggcctgggccagttccggaatgtcatcgagtccacgccattgcccggcgtccacgatcaccgcgtccttcacctgcgcgagcgcgcggatgcatgcctggatctcccaggattgcgggttttcgcttcgccagggattgcaggccagcagcggcacgccatcccacacgggcagttctcgcagcagcgctttgccgtccactttgccgagcggggcgctgatgtctccgaagcgtgaaccgtcttcatcttccacaccgagcagcacgtcaagaccgccaccgttgagatctgcgtctaccagcacgcttttgcatccacgttccgttagttcgcgggccagcagcgccgccaacgtgctggcaccgactccggcgacggcggatccgaccaccacgacgttgagtggagcaggttccggttgcgcttcaacgggtttcatccgtgtggatgacgattccaacggcgaacccatgaaaccgcccgccacggcaggcccggcccatcgtgccgacgttcgcgcgtccatggcgttctgtggcgtatagaaccgttgcggcggggctgtttcccgccgaacggtttgctgggatcgagtcggctgccgcactctggccgctggctgcgaccggattttcggcgaacacgtcacgcgtgcgtcacggcctccgtatgacggcaatgggaccggagggacctgtaatgaagaaattgcatcgctcataccgccgattgaaaaacgaaaccgcacatgggttcaagccgaaacggcacctgtggtcggagaatgtgggttatccacaccctcggcgtgtcatccacacttatccaccgcaacgcgattcggcacatcgcaagacattacgcaacgcagcacggcgcaacgcaacaaaaaaggaagacccgccgaagcgggccttcctgcaagaatcttcggagcagaatcgctgcacaacaacatcgtcgtaacggtaagtctatccaatgcccgttcaacgtaacaacctatctcggtcatacacaccttgtggggctctgctcttcagttgttcttgtacttcgtaattatgctcgccattgcggcaagtgcaaaccgaaacgggacgatgttccgtatttatcgcaactgttgctttccgatcgcaagaatcgcaaaaatgctccatgctgtgcgaatcgcaacgcttgcctgttcattcacgttcattttccccgaaaaaacggcgtgtcggaagcatatttcaccaactcggcgaacgaatgttaactcctgcttaattttcctgagttttgcaagacattccaagcacttgaggataaagtagataactatggcacagatttttgacgcaccctcaaaggcgatcctgcgcagccagatagctgagcatatcgctgagaccgataagaacgataagcgcgagcttcaggcaggcgaggaaccgctgccgaacgaccgtttcttcgaccgtgagctgagctggctgaagttcaacaagcgcgtcctcgagcttgcacaggatgaggacctgccggtcatcgaacgcgcgagcttcgccgcgatcttcgcgaacaacctcgacgagttcttcatggtccgcgtggccggcctgaagcgccgcatcgacaccggcatcgccgtgacggccgcttccggactgagcccgaggcagcagctgcgcgccatcagcgagcaggcccaccgcctgcaggacgagcacgcgcactacatcatcgatcacatcctccccgacctggcgaaggaacagatcgtgctgctgagctgggacaagctcaccgcggccgagcaagagcgcctgtcgcgctactaccgtcagcaggtgttccctgtcctgacgccgcttgccgtggatccggcccacccgttcccgtacatttccggcggttccctcaacctcgccgtgctggtggagaatccggcatccggcaagtcgcacttcgcccgcgtgaaggttcctgacaacctgaaccgtctcgtgccggtcgacgacctgaccgaagacgagaacaccaacgtacgctatggcttcatcaccatggagaacctgatcatcgcccacctggaatccctgttcccgggcatgatcatcaaggaggcacgctccttccgcgtcacccgtaacgaggacatcgacgtggaagaggatgacgctgagaacctgctcaacgccatggagaaggagctgctgcgccgtcgtttcggaccgccaatccgtctggagatctccgatgagaccagcccgttcctgtcccagctgctcgccgaccagctgcgcgtgagcgccgacgaggtctaccgtctgccggcaccgcttgacgcgaccgtgctgttcgagctcggcggcatcgaccgtccggatctcaagtaccgtccgttcattccgaccaccaatcgtcagatcgccgaagtcgaatcgtcccgtgcgcaggacattttcgccgccatccgcgagcgcgacatcctgctgcaccacccgtacgattccttctcgacgtccgtgcaggcgttcctggcgcaggccgcggccgatccgaaggtgctggccatcaagcagacactgtaccgtacgtccagcaattcgccgatcatcgacgcgctgatcgacgccgcgcatgccggcaagcaggtgctggcgctggtcgagatcaaggcgcgtttcgacgaggacgccaacatcgcgtgggcccgcaagctggaacgcgcgggcgtgcacgtagtgtacggcatcgtcggcctgaagacccactgcaagctgagccttgtggtgcgtcaggaagccgacggcctgcgccgctactgccacgtgggcaccggcaactacaatccgaagaccgcccgcatctacaccgacctgggcttgctgacctgcgatccggtggtcggccaggatatgacccgcctgttcaaccagctgtccggctacgcgccgaagtcgagcttccaccgtctgctggtggcgccgcgcaccgtgcgttccggactgattcagcgcatccgccgcgaggaggacgccgcacgcgccggcaaggaggcgtggatcaagatcaaggtcaattccatcgtcgacgagaagaccatcgacgcactgtaccgtgcaagccaggccggcgtgaagatcgacatcgtggaacgtggcatctgcgcgctcaagccgggcgttccgggactttccgagaacatccgcgtacgttcgatcctgggccgtttccttgagcacagccgtatttacgcgttcgccaactccgatggcccgcagatcggcgaaggccccgcagccggcccagaagtgtggattggttccgccgatctgatgcaccgcaacctcgaccgtcgagtcgaagcgctggtccgcatcgtggctccggagcaaatcgacgagctcatcaagtacgtcgatctgcagatggccgattccaccgcgtcttggcatatgcaggccgatggcacctatgtgcgccattgcaaggatgaggaaggtcgaccgctggtcgacagccaggaatacctcatcaagaaacacacgcgtcgaccggtaaggcactgatcgatcgaggcgaatggccggttccgcactttgcgggcccggccattttctgtatgttcggacgtcacgcgccgccgccagcccggcccagcctagaataggacaatatgagcgaaaagatgagacgcatcgtggaagccgccggcggcatcgtatggcgatggaaggcgggcagcgatatcgcgaacgatcctgcgatcgccagtagcaaatctgcgcaggaacagctcgacagcattgaagtatgtatcgtgcaccgtccgaagtatgacgattggagctggccgaaaggcaagctcgagcagaacgagacgcatcggcatgcggcggtgcgtgaaatcggcgaagagacggggtcgccggtcaaactcggaccgtatctgtgcgaagtcgaatacccgttgtccgaagagggcaagaagacccggcattcgcacgattgcacggccgacaccaagcacacgttgtattggatggcgcagccgatttccgccgacgacgccgaacatctgctggacgcgttcggcccggtgcaccgcgcggacgtgggcgagatcaacgatatcgtctgggtttccgtgcgtgaggcgcgcaaaatactgtctcattcgaccgataaggacacgttggcagtgttcgtggaccgcgtgcaggagggtgccgcgaccgcgcagaatctgctgatcgtacgccatgcgaaggctgaatcgcgcaagtcgtggaagggcaccgacgcgaaccgtccaatcacgccgaaaggcgcggcgatggcgttcgccctcaaccgcgagctcgcctgtttcaacccgacgcgactggccacctcaccgtggctgcgctgccaggaaacgttgcaggtgctgagctggcagaccgaacggccgatggaacacatcaacgcgttgactgaggacgcgttcgccgagcatccggcggcctcatggctggcgttccgcgagcagatcacgcagacgctcaacagccgcgaaaccacggccatctgcatgcaccggccggtcatcggcggcatgtacgaccatttgcgcggcctgtgcgcgcgtaagcagcttgccaagcagctcatcgcaaaatcgccatacatgcctaccggcaccgccatgtcgctgttcatcatcgacacaccgcaaggccccagcatcatcgacattcagaaggtctcccccattgtctactaacatgcactacggttccggttcagtcgttcccagccgttccgccggtttcacgaacaccggttcgccgcgtccggcacgccccggccagctcgaccagatgatggccgacaatatcgccggcggcgccgatccggcggagatcaacgaaatgtgccatgcgtcggccgcggcgctgcttgaccgcgtgcaccacacgcaggacgccgaactggtggaacgcgtgctgacgctggtggaccgcgaaggcgtggacgtgatcgccgaactgtggagccatgccgaccccgactcgctgccgggcattctgtggcgactgtatctgctgcgtacgtggatgcggaagaaccgcgaatcgatcgcgcgactgtggcgcgtcggcgagcccgtcgccaccaccgcttccgcgattgccggcgtggaccaggcaccgacggaagacgacatcgcacgtaccgccgattcgattttggccggcgcgtttacaggcgatttcgccgtggcgcttgagcgggccgccgccttcaccgacgtggttgcgttgggattgcgtatcgaagcgcgcaaactggcttcgctgggcggttccagcgaggccggatcatctgatgtttccgacggttccgctgcgtctgctgcggccggcagccacccgtcggccgttgagaagcgggcgcgcgcgaaggctgcgaaactgatgcacacagccggcaacctgttcgccacggccaaggatttccgccacggggcgaatctgtggcggcgcggacgattggaataggccgttccactgtcgttttccactactgctttccaccgccgctttccgtaattttccccccgtttcataccccacgcgacacggcgctgcgaagcgtcgagcgcgactgtacaataggaattcgcgccgggccatgcatagccccgggctccattttttgccgctgcgagcggcctttgcgccgacaggcgctttcgtggttcggcgcttttctcctctttcgatgtttttcgaatttttctctggctttcttgcgattttcgattgccatccgatcggcgctcatctgggtttcatctgcccgacctaccggcgcgttgccgaacagccgatacatggactacgcttagaaaccatggatattcatgttttgaaccacccgctggtggaccacaagctcaccgttcttcgcgacaagaacactccgtcctccacgttccgcgagctcgtttccgaactcgtgatgctcgaggcctacgaagccacccgcgacatcgaagtcgtggacaagcccatcgaaaccccggtggctccgatgatcggcaagcacatcgccgccccggctccgattatcgtgccggtgctgcgcgcaggtctgggcatgctcgacggcatgaccaagatgattccgtccgctgaagtcggtttcctcggcatgaagcgcgacgaggagaacccgacccagcagatcacgtacgcgaaccgtctgccggaggatctcaccggccgtcagtgcttcctgatcgacccgatgctcgccaccggcggcacgctcgttgcggccacccactatctggccgagcgcggtgcgaaggacatcaccgcagtgtgcattctgggcgctccggaaggtctgaagttcgttgaggaaaacctcgacccgtccatcaagttcaagctggtgctgtgcgccgtcgatgagaagctcaacgacaagtgctacatcgtgccgggcttgggcgacgccggcgaccgtctgtacggcgtgatcgactgagctgccaatcggaataaatcaatcgaataaaaattcggcctgctaccgcaccaatcatgcgatggcaggccgaaaccatataaaaccggctgtcgcctgtcgatcatagtccgtcgactagcgcccggctgctgtcgctcgccgggcaactatcagtcggctactgttcgtcgggcacgaacgcttcgaagatgtggcggtcgaactggtcgcagcactgcgcgtattcgtcgcggctgcgcacggtccacgacaccggcaccgcacccatgaaccgggccagcttcacctgcgggctgttgccgcccttccaatcgtaggcaacgaaatcaggacgggaaatccagtcgaacaccagcgcgccggccgcgtattccttgccgagcgccaccggatcggtgggcttgtcctcgccgtacggccaccaggacagctggccgcggcacacttccggacggttctccttgtaccagttcacggccgccggattgaacgattcgatcacatacttgccggagtatgcctgcagcaacgcgtcgcccttctccatgagctccacatcgcgcggatcccacttcgaattatcatcgaacttatattccacgatcagcggcacgcggccggcgaccactttgagcacgtcggagaacagcggcacatgctggtagtagccttccggcgcgttgtcaggcgtggtgaccagcggcggattctccaacgccaacggcagcggcgcggccttgcatgcgcccggagcgtcggtcgggaacagcggaatacgagtcagctcgtcatacgtgagatcggcgatacggcgcggatctccggcaacacgcatcaggtcgccatcatgcaccaccacgacctcgccatcgcgcgtcatctgcaggtccagttcgataccgtacccggcttcacaggcggctgcgaacgcggcaagcgagttttcaggggcaatcacgccgggtgtatcagggctgccgtacccggctttcatggccatacggcgggcgagcgccacgtattcgccgctttcgttggcgtattgcgcggtgagtccggaaccggcgtcatgcagaccgcggtgcgcgtaccacacgtccggaacggccggcacataatgacggcgcttgtcggagaaagtacgcggcgcgattgcccagaccgcagctcctgctgccaccgcaccgccgagcagcgctttcttgagaaacgactttgacatgggcatcctcccttgcgattgaccctgctcaccgcatttgcgcgcgcaatgagccacttgttacgagcgtagcccagtttgccggttttcgctcacgatttcaccgattattcagtttcgccgttgcatatggcgattcccacgctctaacggcacccacgtcggcctcgaaaggctttcgcgggacaaaatatggaagggcgattgccgagtcggtggtggggcctggcaggtgcgcccttttgctcacgacttgcgatttaggccggtttggcacagtcgtgagcgaaagagggtgccgcaaagcatggtagggggtataaatcgcctgtttttccgtcttttttgacgcacatcccgccaaagatacgcaaaatcgtaagtcgtgagcaaaaggggtatcgccgatcgtttccctttcgcattttgttaccaggaacggactttcgcgggacaaaatacggaagggcgattaccgagccggtaagactggctaatcgccttttattagcggactgagacggtgaggctatgcggccaatcggcggcgtgatgcggggtgcgggccgctgcgttgcggcgttggctggagcgttggcggagcccgtttcgccgtccttggtaagcgatggcgactcgaaaccgccgttggtcacgaggttgccgccgtcgccgccttccgcggcaacggacacgtcgtccacgagattgccgtatgcgaggttgccgttgagcgtgttgtagacgccagcgcgaatacggtgtcgtcgccgtccgccgcgaattctccttcgtattcgttccatccgttgcgcgtgtactggttgaagacgccgctgtcggggaaggtccagccggggctgtcccaaccgttgccatccactcgaacatgttgtggaacaggtcggtgccgccaccccatgagaacgatggcggttcggcgccatgcgtgtccgcggtgatgaccgcgagtgtatcgaaaccgctcttcgaaccggacggacgcgccctgtgcttcagggaccatcggtatttcgcgccttgtgtggtggcgagccgctggtagatcgaatagttgccgttcgacgtggccggcttgccgaattggctgccttcggccgcggccactttctcgccggtgcgcatgtgcagggagtcattgtctccgttgccgtttttgaagacactgccgatttcgatgttgcctgaagtcgtggtggatttccaatacggaacatcgctggtttcacggtactggtacacgtccggctgttcgaaactgccgttctgcaggctgttttcggcggagacggtggcaacgtcggaagcggcggagacctccgtcccttcggcggaatccactccgacaaggggaataagggggataccaaatccaagaatcagggcacaggtgatcacgagcgcgagcacgcttcgctgggatttcccggcctgcatgtcctctcctccatgggaaccgggtggtgatgtcatcgtcgacattgagcattatgccaccaaaacagtaccccgtcaatgggtccatattagggggagtgaaatcattgacaacttgtctgattattcagcaaaaagccgtgtcccatcgaataatccgggaacgcaaatgcaatcgcaaacgcagatatgaacgcaatcaccaacacgaatgcgagcgcgccgcaacacaagccacccgcaacgcaagacgcccggctaccgcttcttcgaatcgcgtcctttgaagtagatgtcgaacacaatccagacggacaggatgaacgcgatcacgtagccgaggaaaccgacaatcggaatgccgaaaatcaccggcttgatgcccgcgtaatacacaatcgacgagccgatgaacaggccgaccacgataagcgccatcgtaagcctgttcaccatgttggcgagcaggtggatcggctcctgcgaaccgaccatctccatattgacgcgcagctggccgcgcgtgagcatgcgggacgccactttcagctcgttggcggcggcaagcagactgtgcagcgcctgatggctttcgagagccagcgatttcgtctcgtccttggcgaaatccttcttcgacgtgctcgacgcgatgtggtcggagatgatctggatcatgttcacgtcgggaatgaactcgtcgagcaaaccttccaaggtgaccagcgcgcggccgaccgtggtgacggtgctcggcacctcgatgccgtggcgttgcgccatctgcgttagagcagtcagcatggccgcaatatcgagttcagccaaatccactgtgccgaattccttgacgatcacgtccagatcggccagcaatgccggataatcctccggatcggcctcggcaccggcgaaacgcagcagaccgtcggcaagcttgggggaatcctgctcggccacggcgaagatcatgtccttcagcacggaacgggttttggcgttgagccggccagtcatgcccaggtcgagcagcacgatctgcccaccgcgcaccatgatgttgccggggtgcgggtccgcgtggaagaagccttcgtcgagtacctgcgtggcgtagttgtccacgagtttggtgccgatttccttcaggtcgtagccggctgcaagcagctcgtccggatgggagacggagatgccttccacgtagtccatgaccaccacgtgttcggtgcatagttccgggtacggcttcgggcagtccatgtatttgtagcgttcgcagaatcgtttgaattccgccagattgcgcgtttcgatgaggaagtcggtttccgattcgaaggtgtcccacagttcctcgaccacgccggacaggtccaccacctgcgcgctgcgcatggttttggtggcgattcccgcgatggtgcgcatgatggacacgtcctgcgccatggtttcgcgcacgcccggacgttgcactttgatggccacgtcctcgccggtgagcagtttcgcacgatgcacctgcgcaaggctggccgagccgagcggggtggggtcgatatggtcgaagatctcgtccacgggccggccgtattcgtcctcaagcacctgcagcaccgtgctgtatggcatggggtcggcgccggcgcgcagtttggacagttcgtcgcagaacgattgcggcaggatttcggagcgcatggacaggatctgtccgaccttgacgaacgtggggccgagcgcttcgagcatgagacgcattttgacgggcgtgagtccgtgaaccacgtcgaatttgttggcgatctgcgcgatttgcgcaagacgccggagtttgccgcggcgggtcagatggtagcgcgcggagaacgtgtctttgcgcgctccgaagatgccgatggtttcggacgattgcgcgttggcaccggccgctttgccggtatcgtccgtttcgccggcatcgtccgcggattcgtgggcaagctcatccgtcagtccgtttgcttgggaggcggcgtccggcgaagggtcggccgtggggttgatgaccgcgttgaccctgtcggacagcgtgacgggctccacgctttcggggcgtgccgcgtccggcttgtcggatgggtgtttcaaagacatgtcactgctcgcaaacggttgggaaatcggctggaaagcccgcgatgccagacgaacgtttcgccggcgtcgcgcgggcatagcaaatcgccgtccgggcgctcacatgcgcggcagacggcgatacgaaagactggagctactcggccttgtcttcggtttcggccggggctgcatccttggactcaggggcttccttagcctcttcgaccttgtgcttgagttcggcgttgagggccttgccctgctcgacggtcagctcgcccttcttgacgaggtcgtcaacgatttcctggctcttctcaacagtggtcgccaaggcaccgacgccggcgagaaagaccttgcgcaggccgtcaccaaaattaaaatcagccatgatgtcctcctttaggtgatggtggtaccactctatcgcattttcttcacatctgcgccgagcgaaaccggtcaatcgcataaaaagtggcggatatccggcgttcagcgcgggcggtgcgattgtcggcgaaccggcatggcagccgtcagcgcggacgggacatggccacgcggcgagcacggtcggcgatttcgtcgatgcgatgcagggcggcccgttgcgcgtccgtctgtccggcggcggccggatcgaacgtgccgtaacggcgttcgacggcggtgcggatcaggaaatcggcgatcgcggaattcttcggcagcagcgagccgtgcatgtacgtgccgatcacgttgtggacgcgcgcgccttccgtatggtcctcgccgttgttgccggtgccgtcctgttcgacggtgccgagcggctgcacgccgtcacgcaggaacgtctgtccggaatggttttcgtagccgatgatcttgccgaaatcggcggaggtttccgtaagattgccgatcatgcgtgtttcctggccgaccgtgtacgcgccgatcacgccgatgccgtcgagtcgggagccgtcgaccgtttcgaaatactcgccgaacagctggtacaggccgcagatcatcagcatcggcacgccgtccgccgcgagcgaacgcagcaggtcggcgcgttggaagaagtcgtcgatgatcttcttctggccggtgtcctggccgccgccacccagaatcatgtccacgtgctcgggccagtcgcagccctggttgtaggcgtgtacgcgcggctcgtagccgtacagcgcgagccggcgctggatggcgagcacgttgccggaatcgccgtagatgttcatatccttcggatacagcgacacgatgtcgatgacctggctcatatcgtctcctcgtcttccttccgctgttttgctttgcgattgcgcggtttcgtttcgcgcggcgctcacttgcccacgccggcgtcggccacgtcggcgattttggcgagcgcggcacgcgttttcagcatggccgtgtacgtgcagtagatgtgtttgggggtgccagaattcgcgttcacgaagtccacgaccgattcctccaggtcggtgctgaccgattcgaccggcacctgatcgtattcgaggcgcagggccatgtcccacgcgcgtacgccggacacggctttgacgccggtgccgcgcagcgaggtgaagtccacgtcccacagccagctcatgtcgcggccgtcggcgtattcgtcgttgatgcagatcatggtgtcgcagccttcgggcttgaacgaggccagcgacaggcggaagcccatggggtttttgacgagcagcagttccacgggggtgccgttcacggtgatgacctcgcctcggccgaatgccggtgtgacctcgccggcggtgtcgatcatggcctgcgtggtggcgtgcgcgaaggcgatcatacggggtgagacgcctgccgcgcgcagaatctcgtccgcagcggcctggtcgatggcgtcatgcgagccgttgccgtccgtttcggtaccggtatcggcaccgtccgcgtcgacactgtcggcgagcgcgtcttcgaacggcaggaacatcgcctgcgcgtccgctgcgacggcgcgcaccacggcgagcgcggcggccgcgttgtacaggttgtatacgccttccagtttcacggccgtctcatacgtttcgccgtcgatcgcgaaggtggcgcggtggtcgcccacggcgcgcaacgtcacgtcggcgggcagcgcgtcgggaccgtcctgcggttgcgatgtggccggcgcggcggccgcaacggcatcgacagtatcgccggtattgcccgaatcgccaatatttccgccatgttccgcactgtcgtgcgcttccgcgtcaacagtggtgctcatgtcgtcatccgacgggaagaagccgcgcaacgattcgtcaaggccgaagtagcgtacttccacgccgtcttccgtatgcgccacgtcagcaagacgggcgatgcgcgggtcctcacggttgagcacgacggtaccggtggtggcttccgcagctttggacagcagtcgcgcggtgttgtcgatctcgccgaaacggtcaagctggtcgcgcatcacgttgagcagcaggcagtagtcgggcggcacctgcttgacgaaatgcacggcgtacgcctcgtcgagttccagcaccgcgatgtcggcgtcgagtttgccggaaagcgagacttccgcaagcagcgacgaaaccacgccacgggtgaagttcgagccggtcgggttggtgaacaccttcaatccgagcgattgcagcatgctggccaccatgcgtgtggtggtggttttgccgttcgtgccggagacaagcaccacgccgagcggcagttgcgccaatgtgcgtgcgaggaactgcgggtcgatgcgttccacgattttgccggggaacgcgctgccaccgccgtgcgccaaacgggaggccgcgcgcacggccttgccgatcaacggggtcgcgaaggaattccaagccatatcacaccgcctcctgctgggactggtaatcctggggcatatccttgaacttcgaatacgcgccaaggaacgcaagattgaacgtgtcggtcggaccgttacgatgcttcgccatgatgatgtcggcctcgcccgggcggtcctccttgtcgtaggcgtccggacggtgcacgaggaacaccacgtcggcgtcctgttcgatagagccggattcacgcaggtcggacagctgcggcttcttgtcctgacgcatttcggggccacggttcagctggctcagtgccaccaccggcacttccagctccttggcgagcagcttcagcgcacgggagaagtcggacacttcctgctggcggctttccacggccttgccggaggtcatgagctgcaggtagtcgatgacgacgagtttcaaatcgttcgtctgcttcagtcggcggcatttcgcgcggatttccatcaggctcatgttcgggctgtcgtcgatgaacaggggcgcgttctgcagcttgccttgcaactcgttcaggatggcccaacgttccggcgtgatgtcgtccgcgcggcgcatggcggcgagcggaatgttggattcagcggagatgatacgttgcgccaactcgtttttgctcatttccaagctgaagatgatggtcgtcaatccgtgatgcagtgccgcggaacgggcgaaatccacaccgagtgtggacttgcccatggccggtcggcctgccacgacgatcatctggccgggctgcaggccctgcgtcacgtcgtcgatgtcgcggaagcccgtcggcacgcctcgggacacttcgccgctttgcagacggtcgagctggtcaagcgtatcggcgatgacggtgccgatcggcgcgtagtcctgccgcactttgccggtggacatctcatatacttcggcctgcgccaggttgacgacgtcttcggcctgcgagccttctgcggtgtagccgagctgtgcgattttggtgccggccgcgatcacattacgcaggatggcgcgctgatgcacgatgtcggcgtaatacgtggcgtttgcggcggtcggaaccgatgcgaccaggctgtgcagatagtcggagccacccactttttccagattgccttcggcgagcagctcgttggccaccagcacggcgtcgaccggctgggaggccgagaacagtttgatgaccgcttcgtacacggtttggttgcgtggctggtagaagtcggacacgtcgatcatctgcgatacttcgccgatggcgtccttgctcatcagcatgccgcccaacaccgccatttcggcggcgtcgtcatgcggcggcacgcggtcgaacagggcgtcgcgcacggcttggccagatcggccgttcatgccgttcgcaccgtttccagcgttcgaaaatccgcggttctgcgccgaaccgttgttccaagagtcgttctccgccatgtccctccaaccgcagcagtcaatcgaatgtgttcaataccgaggaaaaccataatacgtgcgtgccgtcacgaccggtgttgcattgagattatggatgaatctccgcatccaccgaacgacacgcgcgaatggctttggtgtggataagaaagtcgaaaaagccgagttatccacatattggggataaccatgtggaaaacgtttcgacttatccacagagtggggataactgagtggacaacttggggacatcctaaagcatgcaccccgattcccttatttcgatttgccgaagtgaacggaaggtgatatacaccccgcttttccgtaaacgacgagaaatacgggggcatatcggcttggcgcatgcgagaaaccggcgctcacatgtggtatcgggtggcgttgtacatggtgcgcaccaacgtttcacgccatttgctccacccgtactgtttggagatggtctcgccggacgtggcccccaacgaggagccgtcggcgcgggtcaggtcgaacagcatgtcgagcagcacgggattatggtcgagccggccggccagatcatcgccgacgttgggatcattgggattgcggcctgtggcgaactccgacaatgtcagatgctcgcgtaccagcagcgtgacccagcggacgatgtcgcggtcgaatcccatgcgttccacgaccacggtcgcatgccgagcgccttccgccgcatggttggccacccccggtcgtttgccgatgtcatgcaggatgccggcgagcagcagcgcctcgtaatgccggtcgtcgtaccgcccaccgctgggtgtttcacggccgagccgcgtgacgacctccaccatgtgccggtcgatcgtatagcggtgcgcggcggacgcgcttggccggttgcgcacgcccaaccattcggggatgagcttgccgggcacgtcgatgaaatcgatgtcttcccacacgttgagcagcgcggggccggaagccagcaatcgtatgaacagttcacgcgattcgtccgtccagttgcggtcgccgataaggcactttttgagattccgcaacgttcccggggcgatcggcaggccgaattccgcggccgcgacggccacgcgcagcacgaggttcgggtcggcggccggttccgcgcccggagcgagcactatttcctcttcatgcttggccacgccgggggcgatcacatcgaaggtcggtgcctgacgtttgccgccaccgcgcggctggaacacttggaagaaggcgaatcgcggcttgtcgtgcgtcagcgaatgctcggcgcgcgacgcggtggaatcaagggagaacgcgatctgccggccaacgcgtgccagcaacgtttgcagatcgtcgatcgacttcgcctcacgttcgccatcgggcagcgtcggatcggccagaccgagcatcgccgcgactttggcttggtagggcgatagcagcatgttcgtacctttgccggcgaccagatggatgcagtcgcgcacgtccagcaaccgttcgacggcgtcgtcatacgtgccgtgcggacggtcggcaagccaggatgcggcgagcgcggacaccaatacggagtcgcgcaggccaccgcgtgcctccttgatgtccggctggttgatgtaggccatgcggccgaattcgtcgaggcgcgatttggcggagccgagcagttccggcagacgtttgcgtgcggccttgcgccatcgttccaatatggatacggctgtgctttcgataagtccagtgtcccccgcgatcggcaccacgtccaaccatcccatagctgcgggcaggtcgcggtcggtgacggcctcgcattgcgcgacggtacgtaccgactggtcgaggtcgaggccggaatcccaaatcggataccacagtttgttggcgagctcgttgagctgctggtcggtcagcgcgtgcggctcgtagatgaccaccagatcaaggtcggagctggggcccacctgtccacgtgccagcgaaccgaccgcgccgagaccgatgccggttgccggaacatcgaaggaaaccgcctcgcagacttcgttccacaactgtgtgagattgcccatggccaagtccgtgcgggctttgcgtttcgccgcgccattgcggtagacgccgtcggcgtcgggctggctcatggccatgaaccgttgtttgagaccatcgactgctgaagtcataacgcacgttccttatgaaacctatgacgacttatgacaatccccgcacggcgcgaggcacgtacggggatgtgtcgtaattgataacccgaacttcaagcccgggggtctttatttcatcttgtccgaatcggcccgatcacaaggccggacggatcagatggcggcggaaccggtttcgccggtgcgcacgcgggtcaccgagtcaagcggagccacccagaccttaccgtcgccgatggtgccggagccggcggacttgacgatcacgccaaccagggtttcggcatcggcgtcgtcggacagcacctcgatgcggatcttcggaatgagatccacggtgtattcggcgccacggtagacctcggtgtggccgcgctgacggccataaccgtttgcctcggacacggtcaggccgtgcacgcccgcggctgcgagggcttccttgacatcgtcgagtttatggggctggatgatagcggtaatgagcttcatctcacttcacctccttgaggacggagctggcggtaccagcaaaatcgtaagcacgttcgccctggtcggcaagatcgatgccgccgacttcctgggcttcagtgacgcgccagccgatcgtcttctccagagcgaaggcgatgatgccggtgatgacggcggaccagacgatggccacgagagcgacgatgagctggacgaccagctgcctccagtcgccgcctgcgaacaggccggtgccttcgccgaagaagccgatgagcacggtgccggtgaagccgccaacgccgtggacgccaacgacgtcgagggaatcgtcatagccgagcttgaacttcagaccgcaggccaggcaggtgagcacaccggcgatggcgccgaggacgatggcccacagcggggagaccacatcggcggccggggtgatggcgacgaggcccgcgacgatgccggaagcggcacccattgcggtgtagtggccggtgcgaatcttctcggtgaagccccaggagagcattgccgcagcggttgcggcggacgtggaaacccacgcgtagccggcggtgccgttggctgcgaaggcggaaccggcgttgaagccgaaccagccgaaccacagcaggaaggcgccgagcatgacgaacggaacattgtgcgggcggaacggctgcgtgccgaagcccttacgcttgccgatgatcagcacgatgaccagagcggcgactgcggcgttgatgtggacgaccgtaccacctgcgaaatcgtgggcggctgcgccgatcgcctgggaaatggcgccgtcagcggacagcaggccgccgttccacaccatgtgagcgagcggagcgtaatcgaacgtgatccacagcgccacgaaaatcatccacgtggagtacttcacacgttcggcgatggcgccgcagatcaacgcgacggtgatcatggcgaacgcggactggaaggccacgtccacgctgaccgggtagttgttgccgttcagtgcggccgatgtgaagacgcccttatcggaaaccatggtgtccttcagcaggaagccggttgccgggtcgccgaagatgccgccgaccgaggtgccggcgtaggcgatcgaccaaccccacagcacccacatgatcatcgtgacggacagtgcggccgcctccatgatcatcatattcagcacggccttggcgcggaccatgccaccatagaagaacgccacaccaggcgtcatgaggaacacaagggacgcggaagtcaatatccacgcggcatttccagaatcaagctggcccatgtcaccctcctctttctttctctatatttggttcaacatttccgtccccatcgtgtggggctgacagaacgatatggaacgccggccgcgttttgaaaacgttacgacgtgttacgccaacgtaacgccatccgcgcgaaacgtcaacctacgccgaaaaatggcggaattccaacgaaactggcggtacggaaatacggaaggcataatcgcccggcaatcgcaatatgaaattgcgacggtggacggaagcggcgggcaacgctgcggacggagtaagttaggtagctgaaacttacggaacacgcgtggcacgcgacgggagaacgccgcgtacggcgagcgcgtggcatgtacaccgaacgcgcggtgcggcgaacgtatgacgcgcgtaacgagagagcggcgaggaccatggcaacgttcatcatttcactgtgcgccattttgatgctgaccacggtttccgggctgatctgccgcaaagcgcagctgccggaagtgatcgggcagatcctcgtcggcattctcgtgggcccttcgctgctgggcgtgatgcacatgagcgattcgctgtcattgttcagcgacctcggcatcatcatcctcatgtttttgggcggtgtcggctgcgacctgcagttgctgaagaaatattcgaaggcggcggtcatcatcgcgtgcatgggcgtggtgttccccgtggcggtgatgggtggagtgagcctgctgtttggcttcaagccgattccggctgcgttcatcggcgtggtgttctccgccacgtccgtgtcgatttccgtggcggtgctgaaggaagccggactgcttgattcgaaggaaggcgtgtcgattctcggcgcggccgtggctgacgatgtgatcggcgtgatcctgctgtccgtaatgtgcacgctcgtcaacaccggcagcgtggacgtggcagggctgggtttgattctgctcaagcaggtgctgttctttgtggcggccgccgtggtggtggtttggatggcgccggcgctgatgacgctggctggcgtgctgaaggcgccgtccggcatcgcggtgatggccgtgatcatctgcctggcgatggcgtgggcgtcgaatctggccgggttgagctacgcggtgggcgcgtttttcgccggcatcgcggtaagcaacagcgattacgcggaggacgcggaccggtatatcgagccggttggagacacgttgttcgtgccggtgttcttcgtgggcatcggcctgcagaccacaggcgtggatgatacgaagatgattgtgttcattgcgatcatgacggttctcggcgtgatcacgaaggtcgtcggctgcggtttgggtggccgcatggccggttttggcggcgcttcggcgctgatgatcggcgcgggcatggtaccgcgtggcgagatggcgttgattaccgcgcaaatcggcttcaacgagcatgtgctcggcagcgaatactattcgacgatcatcttcatcatttcgctggtgacgctggtcgcgccgctgctgctgaagctgacgatccggaaggtgccgggagtgggggctgcggctgccggtacggctggcgctgagcagtaatcgcaatacgaaaacctcccgccacgtacggaacgtgacgggaggttttcgctacggaaatcgcaaatccggaaaatatgggaacgtcaggcgaggatgccgtcgacgaaaccttccggagcgaacggggcgaggtcatccgggccttcgccgaggccgacgagcttgacaggcacgccaagctccttctgcacggagatgacgatgccgcccttggcggagccgtcgagcttggacaggaccacgccggtgatgccgatcgcttcggcgaacaccttggcctgcgtcatgccgttctggccggtggtggcgtcgagcacgagcagcacttcatccacaggcaggttcttttcggtgacgcggcggatcttgccgagctcgtccatgaggttcgccttgttctgcagacggccggcggtgtcgatgatgagcacgtcgacgttcgcctccttggccttggcgctggcttcgaacgcgacggacgccggatcggcgccgtccttgtcggaacgcacgaccggcacgcccaccttcgcaccccaagtttccaactggtcggcggccgccgcgcggaaggtatcggcagcgcccagcatgacttgcttgccttcggaaacaagcaggcgggaaagcttgcccgcagtggtggttttgcccgtgccgttcacgccgaccatgatgatgacgctcggtttgttcgcgccctccttgtcggcgttgagacggcggtcgacgtcggtgccgacgagcttcagcagcttgtccttgagcgcggcacgcacttcggccgggtcggactggccggcgatgcgggcgtcgttgcgtagtccctcgacaagctgttcgctggcttccgcgcccacgtcggcaagcaggagggtgtcttcgacgtcctcccagtcggcttcagagagctgatccttggcgaggatgttgaacagggccttgccgaacggattgcccgacttggacaggcgcgccttgaggcgctgcatgcgggtgccggcggcttcgggggtttcgatggccggaacgggtacgttttcagccgcttcaggttcggcaggcacggtttcgaccggcttggtttcgaccggcttggcaggctcggttacggcaggttccgccggagccggcttgttttctactggcgattcgctttcagacgatttggtttcagtcgattcgctttcagctgattcagatgcgtcggccttcgcagcggccgcctcggctgcgagacgagcgtcggccttggccttcgccgcttccgtggacttgctcaccgcggacttgcggctcttgccgaaccaccatccgccaatcgcaagcaatgccgcaataacaacaacggcgacaatcgcaataatcacattcgtatccatggctccagcctaaaaagcgcaacggacacgccactcatctctgccagggcaggcaatggggctatccacgggacgtgaaaaactgggcaatatggccaatacatccagaatgacgtcgtaccagcggcgcgaacagctcatcgaaatcggtcgatcgctgttcgcggccaagggattcgaagcagtgagcgtggaagaaatcgcctcgaccgcaaaagtgtcgaaacccatcgtctacgaacatttcggaggaaaggaaggcctgtacgccgtggtggtggaccgcgaaatgcgcgcgctcaccgacgttctcatcaacgcgctgtccgacccgcaggcgcatccgcgccaaatcgtggaacgcaccgcgcttgcgctgctcacctacgtggaggaaaacgccgaaggcttccgcgtgctcacgcgcgattcgccgaaaaccgacccgtccaactcgttcaattcgctgcttggagacattgccgtacgcgttgaagacattctcaccgacgcgttcaaacgccagcatctgccggccaaaagcgtgccgtattacgcgcagatgctcatcggcatgaccgtgtacacctgccaatattgggccgaccagcgcaagctcagcaaggagcagctcgccgcgcacatcgtgaacctggcatggtatgggctgagccgcatggaagccaagccggaactgcgctacgaaagcgaaaaggccgcccgcgaggcggaaaagcaggccgcgcgggaagcgaaggcgatcgccaagcaggagaagcagggcaagaaggccgcgaaatcgcaggagaaggcggttgctgcgggagatgacgcgacggacgggacgaccgtgacggacggatcgcaagcggcagacggatcgcaagcagtaggcaaatcgcaagcggcagacgaatcaaacgaatcagacgagacgaacgaatcgcaaaaaccgcaaagcccgcacgaatcgcaaaaacaatcaacaattgacgaaaactgacataccgtcacccgaaatgaccctaggggaaatttcaggtgcagattgcgtatttcagggtgccgtttgtgcgcaaaaccgcgccccggaaccgcacatggtgctacgttagtttcgttatgcttttggccggagcggtcggccagccgcacggcccgacacgagcccgatccgaggaagaatatgcaggagaagaagacgctcaccttcgtggtgcccgcgtacaacatgacggaatacctggaacggtgcgtcgaatcgttgatcgcgtcgaagcgcaacgacgacatcgaagtgctgatcgtggatgacggctcgtccgacggcacgctggagatggcgaagacgttcgaggcgcgcaatccgggaatcgtgcgcgcgatccatcaggagaacaagggccacggcggcgcggtcaacaccggcatcgcggcggcgagcggcatgtacgtgaaggtcgtggacgcggacgattgggtcggcccggaatcactcgaacaggtcatggccgtgctgcgcggcgaggtcggcaaggacgagccgctcgacatgctcgtcaccaactatgtgtatgacaaggtgggcaagcgcaacaagcacgtcgtgaacttccgtcacgccatggagcccggcaagcggctcacttgggacgatctgggacatttcggcctgaccgaatacattctcatgcacgcgctgatctaccgtaccgccgtggtgcgcgaatcgaagatgcagctgccggaacacacgttctacgtggacttcatctacgcgtaccagccgttcccgtgggtcaagtcgctgcaatacgtggatacgccgttctaccactatttcatcggccgcgacgggcagagcgtgcagacggacgtgatgatccgacgcgtggaccagctgcggctcgtcaaccagtgcatggtgcgcgccacccccgaacgaggtacggtgccagacggcctgtaccgctatatgattcattttctggcgattcagagttccgtcgcgagcgttttcatgattttgtcgcgcgatccggagaattacgagaagaagaaggccatgtgggcggatatcgaggcgtattcgccgacgatttacaaggacgtgcgtaagaaggcgatgtcgcgcgcgctgaacctacatggttcgctcggccggtttgtgattcgaaagggatatttcgtggcggaacatgtggtcgggttcaactgatttcgcgcgggtttcgcgggtttcgcaggtttcgcgcgatagagggtttacgcgatattgcgtgagtattgcgattattgcgatcggctaggcgctcctgtgtccgtttctggtgattcggacacaggagcgcttcattttgatgcctgtgtgtccgattcgggagaaacggacacggaaagcaccagcgggcttagttccagcgatccgacatggcgaaactgttgtgcatgagattgctggacgtgtacagcacgtcgccgagcagcttcgtattgcgcgatcgcaggtattccgccatttcgtcgttagccgccgcaagacgggccggaacagatgtaggactagcaagcccatcggaaccggaatcaaccgcagcaccagacatagaaccagaaccgccaaccgcagaaccggcaccagaaccagcgccaccagccccagtcgccgacccaccaatcgcaagcgcatcatccgtacgttccaccagacggtggccgaaggaacggacgtcttccgagaatccttcaatcgcattgctcgtctcgtagaagtgcgcgtcagcgatcgcagcaatcagacgattcgtccaatacaggcagtccgtggagacttccggcgtggtgtcgcgcagatatgcgggggtatcgtcgacgttcgcgtagaacggcgcggacgtggtgaatgcgccggaaccgtacgaaacccacatgatcgaacggctttcggctggcgcatacgggcggatctgcatcgccaccatgtgcccggtgcggttgatgccgattggacgatagcgatggcggctttcctcagtcccctgcgtgccatacgggtcgtacggggtgccctcgaagtgcgaaccgagcaggaagtcgacatcctcgacggtcacggcattctccggttcgagacaccatggaatgtcgtccgattcaggggtaaggttttccgcgtcggccggatcgagatagcggtacatgtaccaggcgcgaggcgtgttgtagatatggtccttcgcggtggcggtgccgaacacgacgcgcgggttgcagtggccgccgttcatgccgccctgcgtgccggccgcgcggccgagatgatgcgtttcgatgaattccgtcaggtcggcgctgcacatgaattcgcgcgcgtcgctgaaggcgtcgtcgaagtcgaaatagtcgatgccgagctggttggggatgatggcgcatttgtcgtccggcacgcggcgggcgatccaatggtggccgccgatggtttcgacgtaccagatttcgtccacgtcggaaatgatgatgccgttcgattcgtacgttccgtacgtttcaagcagttcggccagacgtttcacgccttcgcgcgcggtgttgacgtacggcagcacgagggtgatgatgtcttcttcgccgatgccgcctggggtttccggcttaccattggcttcgtcggccgactgcagtgcgaccagcgggtcggcggcgagcacgcgctcgttgacggcgatggtttcggtggcgctcatggccacgttgcgttcgttgacgccagcttccgcaaggattccacgatttggaagcacgttcggtacgatgctgtaccggcatggattgtcgggaaggtcgatttcaacgtggctcagcacactgcggtagtgccgcggctgctcctgcggtgcgacgactacgaatttcttgggatcgtaacgtcccgaaccagagtcgtcatctcgggcgatgatggtcgaaccgtcgtaacttgcttttttgcctacaagaattgtggtacatgacatggtttcgattgtaggcacaccaacactccgaaggccatttcgacgcccgtccgacgcccgtggtggcgattggtccgaatatgctgtatactgtgttgctgttgcccctctagctcaacggttagagcagcgtccttttaagtcgtgggttgtgggttcgaatcccacggggggcacaggttcgaagtcctggaagccgatggttctcaggactttttcatttgtttcgggatgaggtctcagcacttcaatacggaacgcaccatatcgcgcaccctctttcgctcacgaatcgcaatttcggtcgattatttcgcgacgtgcgccgaaaagtatggaaaataaggcgatttataccccctaccgcactatgcggcaccacctttcgctcacaatcgtaagaaaacgagcgaaatcgcaatatgtgttccgaaatgaatagcgaacagcccgcgggcgattcgcggacggaccatacgcatgcaaccggcgtggcgcaatcgaggataatgatagactcgaatatatcgaacatttgttcgtatagattcggtattacgggaaattccccactatatacagtgggcaaacgtacgaaacgccactacaggtagtgtatactgatgaacggcctgctcagccaggcaaaatcaaaaaacgtggccgacaaggctttccacaccaaaggaagccgatttgcatagggaggaaaagaatgaccgtgaccgtcttcaccaatccgaacaatcctcaatgcgaggccaccgaacaagagctttccaaactgggagtgcggtacgtggcggtcgatttgacgcagaatccgtccacattcgaacagatcaaggacgccggcttcaagcaaattccggtcgtcatctcaccgaattcctcatggagcggacatcgccccgacctcatccgccagctggcgcaaagcatcgcggcgtaggcgcggcaacagcagtcaagcatccaaacagccggaaggcacgaatcccaaacggcaataatccggaagaatcaaatcccccgcggcaaaacccgcaacaaaaccccactgcaatcgtccgaaatcgttcaaaatcagccacccaaagcaaagcggccagccggaacatcgcccgaccagccgcttagcaaaacccgcaaaacgcaaaaaccagcctacatacgaccggcagtggacgggtcgatcttcatggtctggaatcggtgggccatgaaatcgtcattgaaatacgtggcgaaaaactgcgaaacaggagaattctgcgcaaccccagccatgcgggaataccaagcgtcaagcgccatcagcgtcatcacgccatcgacgaaaatgagtatgaaacagaccagcgtcaacgaatagcgaatcttccacggaatacgctggatcaatcgcaacaatcgcggcagaatcaacttgacccaaaccaagccgaggacgccccagaagaacatgtatttgccggatgtacgcccgtcaatcgaaagccattgccccgtgtaatcccatgcgcgaataccgaacgcggcctgcatgaaccagctggtgaaatattcgaacgcgccaccgatcaccgcgcttgagcagaaaatcagcaaccaattcgactgccacaaatggttgagcaacacggtgacgatcaccacgccgaaaccatagatgggcgagaacggcccccataggaagcccgcacggtcctggtattcgccaaacaggatgaaatggtagatggtttcgatcaccaaaccgaacacacaaccgatggcgaacaaccagaacaaattgaagaaatccagcgaaatatagcctttgccggtcaggtcgcggccggccatgccttgggaggcggcgttctcatacgcgctgcgggcgtccatgcgccgcaacgcgaactgcagccggcgctcctcccgcagcgatgggtcggcggtgatgtgcagggcgatcagcacgacaagctggacagccgggctgacaaggttcaggccaagccccttcaacgccagcgacagcaggccttcggcgagcgtaagcggaatcagcaggtacgtccattgcgcgatgtgccggcgtttgttcctgaaaagcagcacgccgaacaccgtcaggcacgcggtggtgaccatcagcacgaccgcgtgaatcgccgacagaatcgtggtgaggctcagcgcgtcgaacgtcatatcgccggaaagcacggcctgcacgacgtacaggcacgacagcacgatgaacggcagcgtcaccacgccttcaataagcatgacgatgccgtaaatgcgaacgattaacggtagacgacggtcagcgggattgccgacttcgccagtgccctgctttccgccttcttcgatagccgcgatttcggtttcggcggcaatcgccttgatttctccatccgtcttgcccgcggcggaatcctcggatcgtgattcagattgtgcggtttcgctcatatgccgctccttccttcagcccacgctaccaaacgtaggcaatatccgccgcaagaaaagcggttcaggtgcgattattggcggacgcgagcaaaagagggggacgtcagctggctgcaatcgccattcgcacaccacctttcgctcacgtccgcaagaaatggcgatgtatagcgcatcgtgagcgaatgggggtataaatacggacggaaaatagcgatttattaccacctttcgctcacggacatacagaaatggcgatttgtcacggacgtgagcggaaggggctacgtcagccggcgatggttttgccgaggctttgccgcagtactcgacccgatttccgtcatccatgaaacgcgatggcgattgtcccggagcgcgttatacgatacgtaccgcgtagcgctacgaaatacgtatcgctatgagaggaatgattcgccaaaccggagagacaatgcacaacgtactgcagatcctgcgccgtgacttcaaacgattagtcaccgtacccgccgcgtgggtgattatgatcggcctgattctcattcccccgctatacgcatggttcaacatctacgggttctggaatccctatggcaacacggacagcatcaaagtggccgtggccaacatggacgaaggcacagacaacgcgctgcttggcaaagtcaatctcggcgatcaaatcgaaggcacgctgaagagcaacgaccagctcggctgggagttcatgggcaaagccaacgcgatggaagcggtggagtcgggcgactgctacgccgcaatcgtcatcccttccgacttcagcgaagatctggccaacgtcgtcaccaacagcaagcatcgccccacgctcgaatattacgtgaacgagaaggcgaatccgatttcgccgaaaatcaccgaccaaggcgcgaccgtggtcgaccgcaccgtcaacaacaccttcgtctccaccgtcagcgacgtgctcgtcaaagccgtcaactcggccaacggcaccatcagcggcaacaccaacgccatcgccaacgaaaccatcggcgaactcgacaacaccaagcggaacgtaggcacgatccgctccgcaatcgcggatctcgacacccagttagccaatgtgccacagcagacaaaagcagcacgcaatgccctgaacgacgtgcagctggccgcggcgagcgcaggcagaggactagcaggcgcatccaccgccatcggcacagcgcaaacccagctcaacacgctttcgtccaacgccaacagcgcgctggaaaccggatccggacttgtttcccaagcgacggcgcaatccacagccagcatcaaccagatctcgtcggcggtatccgcggcaagtggatcggcgcagcaggcggtgaccggcatgcaaaacatcaccgacagcaatgcgaaactgctcgagaagctcaaatccgccagcgacaacgcgcaataccagcaaatcatcagcaaactggagaataccaacaacacggcagccggaacactcgccgacctcaaaaccctgagcgagaacacacaggccacagccggcagcgtatccaaactgtccaccgatttcaacataggcacgcagaactcgctcaaaagcgcaggcatggcgcgcaacgccatcaattcaggcgcactgccgcgactgaattccgcgctgggctcgctggctgggacggccggaacacttgccggcaccgtgaccagccaggacagcgtggtcaggcaaaccaacatcgtgctcgaccaactcgaccaagtggcgtcagacgcccgcatcggccttgagcaaaccgaccagcagctggcgaagatggagacgaagctcaccaccgtcagcaccgacctgaaggcgctgggcactgcggatctgctcgcatcgttgaccggcagcggttcgcttgacgcggataagatcgcctcgttcatggagtccccgaccgtaatcgacacgaagaacgtgtatcccgtcaactcctacggctccggcatggctccgctgatgaccaatctggcactgtgggtgggcgcgttcgcctttgtggtgatctacaaagtggaggtggacgacgaggggcttgagggtctcgatccgaccgcaaccgaaaagtatctggcccgatacctgttgctcggcacgatgggcgtcattcaaggcgcgatctgcaccgttggcgatctgatactcggcgtgcagacggcttgcgcgccactgttcatactgaccggcatgatcacatcgctggtatatctgagcatcacgtacgcgctgtccaccacgttcatgcacatcggcaagggcctgtgcgtggcgttggtgatcgtgcagattccaggcgcttccggcctgtatccgatcgagatgatgccgaagttcttccgcatggtctatccgttcgtgccattcagctattcgatagacgcattccgcgagaccatcgccggcttctacgacggccattggaccaaggcgatcggcacgctgctgctgtttgccggcatggcgttcgtcatcggcctggtggtccgtcctctgttggtcaacctcaaccgactcttcgcccgcgaaatcaaggaaagcgacatgattatcggcgaggaagtggagcttccggaacgcggatacaacatgtcccaagccattcaggtactggccgacaaaggcggctaccgcgaggtgatcgaggaacgcgcaagtcggttcgcggaactgtacccgaaactcaagcgcggagctctggtgatcggattcgtagttccggtcactctggcggcggtgttctcgttcaccaacggagagaaagtggtggtactggccacgtgggtcgtctggattctgctcatcatgggcttcctcatggtcatcgaatacatgcgcgataatctgaaccgtcaagtggagctcggccatttgagcgatgaatcgatccaatccatgctggtggagcgccaagcggcacgcatccgtcgcaaaaagcgggcgcaacaggaacggcggaacagactgctgcgcaaaacgcggagacgcaccagcggcaaacgcacgacatccgataatcgcaataccagcgtcatcaaagaaacgacggaaaacgtgacgggcgtcaaccacaatgaagatgacggaatcgccatactggtgcagaaaatgcagaaaatgcagacgaccggtccaagcgccgccgcgaacgatgccgccacggacaccgccgagaccgccgagaccgccgagacaaccgagacaaccgaaaacaacgaaaacaacgaggaaaggagcaacgcatgaaaaccatctggaaactgttcgtcggcgacatccggcgaatcaccagcaacgtcgtctccatcatcatcgtcatcggactcgttgtgatccccggcatcttcacatggttcaacgtggccgccagctgggacccgttcgccaataccggcaatctgaaattcgccgtagccaatgaggacgacggataccggtccgacctcattccagtgaagatcaacatcggcgaccaagtggttaacacgctgcgttccaacaatcagctcgactggaccttcaccaccaaaaaagaagccatcaacggcaccaaatccggcaaatattacgcagctgtggtgattccaaagaacttcagcacccgtatgatgacgttcttcgcatccgatggcgaccacgccgaaatcgcctactacaacaatgaaaagaagaacgccttggctccgaagatcacaggccaaggcgccgatacggtcagcgcgcaggtcaacgagacgttctccgaaacactgaccagcaccgcgctgagtgtggcatcgcagctcgccaaccaactcgacaagccagccgcgcaggaacaactcacgcagttcaacggcaatatcagcgacttcgcggaaacgctcaccgacgcttccggaacgctccgcacgttcagcacgctgacccaaagcgcacggcatctgcttgagtcctccgacggtctgatcgccaatgtcagcggcaatgcgaaaagcgcaggaataacactcaagcaagccggcagcggcgtggaggatctgacgggcgcgttgaagaccggcaccaccgcgctgggcacggctctgactgattccgccaacagcttcacagccatggaagcagatgtggacagcctattcggcaatgcgggcacgcaggccggcaacaccgccaacgcattacgcaaccaggccacgaacatcagcaagcaggcgcaaagctaccagcagatctatgattcgctcgacgcgctcagcgcaaacgaaaagctgccggaagcggtgaggaacgccatcgaccatctcaaaaccaacgtcggcaccaccatcacacagctcaacgacctagcatcggcgctgaatggcagcgccgacaacatcgacgccaaagtaagcgataccacggccgaacgtgcggagatcaagaaactggcgcagcaggcggcaacgtccgtcagtggcatcaaaaccgactatgagagccaactgaaaccgcaacttgacgatatcgccacgtccattaccagcaccaccaccgcgctcaatgccacagcggccgatctgaaaggcgcgctgggcaatctgaacggcaccaccaagaccgcggataagaatctgaccgccatcagcagcgtgttggattccaccgccgatagtctggccggcgcgggcaaaaaactgggcgcattcacaggaacattgaccgatgcgctgaacagcggcgatatgagcgccgtcaaagatgtgctcagcgataataccgactcgttggccgccgcgcttgcagcccctgtaaaagtgaaacgcaacgcggtgttcccagtcaagaacttcggttcgcagatggcaccgttctacacgatcctgccgctgtgggtcggttcgctgctcatggcagtgacgctcaagaccaccgtctcgcgtaaggtgcgcaaggaactcggcgacccgaaaccgcatcagctgtttctcggacattacggtgtgttcggcgtgatcggactattgcagagcacgttctccttgggaggcagtctgctgttcctccatgtccaggcggtgcatccgctgctgttcatgctgtccggctgggtgagcagcctagtgttctcgttcttcatctacacgctcgtggccagcttcggcaacgtcggcaaagccatcggcgtgctgtttctcgtcatgcagatctccggagcgaacggcgcatatccgctggccgtgctgccgaaaatcatcagcggcatcagcccgttcctgcctgcgacgcattcaatcacagcaatgcgcgcggcgatcggcggaatctacagtaacgattactggtttgcgattggcgcgctactgctgttcattccgccgctgctgctgataggcctgctactgcgcattccactggtcaagttcaaccattggtacgtaagcaagctggaaagcacgaaagtgatcgcggcatgatgggcggaaccacgcaagagggcacgcggaagacggtgcaaaaaaccacgcaggaagacgtcggcacagcacgtggccgacgtgagcgattacgggagcaaaccgaccgcaaaatcatgaaagccacattggggatagtgatttccgatggtatcggagcggtgaccatcgaagaggtcgcacgacgttcaggggtagcaaagaccacaatctaccgacgctaccgaaacgccgacgatttattgcaacgcatccaaccggaagttgccggactaccgaatttcaacgatttgaagccgtcgcggaacggactggccaccatgctgcaacgcatccaggactgcttcgacagcgaactcggattgaaagccgtgggcgtggtgctgtcttccgacaacgccacgctgaaggcgattgcctcacaagttctagcgccggccgaagaacggttcgtggggttcatggaacgtggcatcgccgacggagtgtttcaaaaccgtttggactacacgttcctgttcagcacggtgctgggttccatgctggcttgcaaagcgttggcgggacaggaagccggaggggaacggcaatccggcaaggaacgcaagtctgattcctgggccgagaacatggccacgttgctctggccgaacgtatgcgccgaatccgcacggtaaccacaggaaaaccgtccgcaccgacgcaagacgggcatgccgtgtcggtttcagaaggaatgggctattggattgacgcttcctgacgcgccacttccaacgccttgttgaaggcttcggaggtccagctggcgccggcgagcttgtctactttaaggtccttcaacggcttgccgaccaccgcgtccggcacggctttggcgaagtcgttctgatgctttttggagatggacgtgaacggatggccgacgatcttcacggccgtcacgttctggtctttgacggtcagttgcacgtcgatggtgtcctcgccgaccgggccgtactggccgttgaccgaataatcgccatccgcgtagttgccggtgtcctgcttgctggacgtcgtggaattcgcgtcatcggcatggtttttggtggtggcgtcgccgccggccgtattgtcagccgccttgccgtcggttttcgacttattttcctgcgattgcacgctttcgccggaattgccggcgtattcgtcgtccatcggcgtggctttcggctcgccgcatgccgacagcagcgcgatgctcgccgcggatagcgcgatgactttgactgcgttcgattgtgcggtgctcatgcctgctcccctttcgtgacgtcgggctctacgtccgtatcgtcggcaacgccagccgcaacggcaacgttggccgcgtccgtatctccggtttttgcggccttcgtagggtcggcgaacaaaatcgcgacaccgccgttctgtgcgccttcctcggcggaaccggtgtgcgcaggcttgccaccggccgcctcgtacgcacgtttcgcctcctcgtcattccactgttcgccgacgagcacaccatggttgagcatgatttcgcgttgtgcgcaggaggcgacgagcgcatcgtgcgtcacgacgatgatcgtagtgccctgctcgtgtagctgacggaacaggtcgagcacgatcttctcattcctctcatcgagattgccggtcggctcgtcggcgagaatcagcttcgggcagttgatgagcgctcgggcgatgcacacgcgctgctgctcaccgccggacagctggccgggcaggtgatgcgcacgctccttcaatcccactcgttccagcgcttccatcgcctgcttctcatcgactacagaatggtagtattgcgccaccatcacgttctccaccgccgtcagatgcggcacgaggtaaaacttctggaacacgagtccgatcatgttcttgcgcacatcggcgagctggcgggcgttcagatcctccagccggcggccttcgagcatgacggaacccttcgacggcgtatccatgcagccgatcatgttcatcagcgtggttttgccggaaccggacgagccgacaatcgctagccattgcccttgcggaacggtcagactcaggtcgtcgacggcgtgcagatcgccgtaaatcttggaaatgtggtcgagttccagcagcatatgttcgttgtccatgattattcctccctcaaaacgatggcggggtcgatacgggtggcgcggcggaccggcggaatggaggcgatgacggcgatcgccacgctcagcagcagcgatccggcgccgagcagccagtcgaagccgatcgcgcgaccgaagacggtggcgcacagcacacgcgccagcacatagccgatagcagtgccgagcagaccgccgatcaagccgtagatgccggattccacgtagaattcgacgccgatggcgcgtgaatcggcgccgagggccttgcgcaggccgatttcgttgcgacgctggctcacgatggagctgatggtggtgcccacgccgacaagcgtcagcacgagcacgacgagcgagacaatccagaacagggtctgcagcatggcgatgatgcgggtgtcggacgaggtgattttggtgacggtctgcgctgtgactgcgatgtttggatttttgccggttttgttggttttgttgatgttgctgacgatggcgttcagcccatcccccatggcattcaccgaatactcgaccacgtcggcaccacgcttggaaccggcaagtttagccacgtccgcggtagtggcgtagatgatggaatcctcgttgccgccggtgtcgacgatgccagcgatacggaattcggtgccgttgttatccatgatgtcggacgagacgcggccgttttccgtggcttgcgtggtctgttcgccttgcgtagtttgcgtactctgcgtgccttgcgcggacgattctgccgtttcagttgattcgtccgaatcggattttgcggacgcggaagaagacgctgaagcagacgcgtcggcggcgcggtagccgatggtgatgcggctgccgaccttcacgccgagcgcgtcggcgacgtcgcggccgaccatcacgttgcccgagccgggccaatcgcccgtcacgttccaatggcgattgagcgcgcggacggctttcacgtccacgccggcgatggtgtacggcgcggaattgatgcgcacgctctcataccggtatgcggctgatttcacgctgtgtccggcgccgacgagcgccgtcacgttgcgtacggttgcagtatcgatgccttgcgatttgcccgttgcggacgcgggcgtgacgatcaggttcgcgccgtacgcgcgcatttcctcgttcatctgctgcggcaccgcgacgcacacggatgcaaggcagaacagcgtggccgcgccgacgagcgacgcgatcacggccatcatcgcacgggagcgacggcggaacaccgcgccccacagcatggtgaagaacatcttgcgattcgtcatcgcacaccccctacgaaagccaagcacaactcacctaccatgcagcacctccgccggacgcaagcccagaatcgcccgaatcgacgaaagcgaggccacgagcacagtgaccgccagcaacacgaaaaccaacacgaacaccatcggacgcatggtgatgcccgagccgaacaccacgtgccccacgatctgtgcaacgcccgagccaagcagcgcaccggcaatcgcaccaaccagcgaaatcaccgccgtttcggcgagcataaggcgcgaaaccgcaccgtccgtggcgccgatcgccttcaacagcgccaattccgaaccgcgttcgccaatcgacgcggccatcaggttcgccacggcgatcgcggcggcaaccagcgacagcacggtcatcagcaccatcaccgcctgcgtcttgttcagcacatcgccctgcagcgcggccacctggcgcacctgcttggccaccgcgcccggcagcacctcttcgatctggtacgcgatcgacgacggatacgcggtgcaataccacgtctcccactcgtcctgcgtgagcgcgttcggattcttcgacgccttgcgcgcgaggtcgttgtcgggcgtggtgagcgccttgacttcaatcttgtcgatggaattcggcagattcgcaagcgtttgcgcggcgatggacggcatataaatggcgctgttgtcggaatcgcccgaatcgaagatgccgacgattttcactttcacgcgattgcgttcggtggaggatttgccggttttcccggtacctccgttcgtattgtcgtccgcaccgacggcgatcgtcttgtcgagcgtgacgctgtcaccgacgttcacgcccagtttcgcggcgagcgcgctgccgaccatcgcctgctcgctgtcgtctttcggccaggttccgttgattttccaccatgagcgcatgccgttcatgccggccacggtggactcgccggagtccatgtgcagggttttcgcgaaccacgtgcccacgatcggcacgttggtcgccttgcatttcgccgcggaagcagccgcacctgacgcaccagccgttccagcagagccagccgaaccagcccccgaaccgacacaccccgcatccgcgtggatgttcaattccggcgcgaaattggtgatgttgaacgcccagaagatggtcttgatcttctgcgcgtccgactccttcagaaacgcggtcgggtcggcgctgtccgccgcagccgagccgtcggaagtggaacccccgtccgaaccggacgaactacccgaagccgagccagcagaatcgccggtattgtacaaatcgctcaccacagcgtcggacttcggctgcacgacgatattcgaaccgtacgtgctcagctccgcgttgagcttgtcgcccacgtcgaacaccacgccgagcatggccacgctgacggtggcggacaggcacacggtgacggcgatgagcagacggcgtttgaactgccggctgaacgagcgagagatcattttcaggaagaacatggcacccccttacctttctcggcgctcactggaaatggctcgacagcgcgtcgagcgtggacgtttggatgacgattttgcccggcttgacctggtagtcgaacggtatcgggttgcagccgcctttgaagccgatggtggcgaggttgatggccacatcgcacttcttgcagatgattttgccgtccttctcgtagtagccggcgtcgccgcagttgtcgcacgcgtcgaggccgacgccgtacgcgccgccgttcttcttgatgatgatgaatcgcatggaggtgccgtccttcgcgcggtattcgaagcgatgcaggtggccgtcggaaatctggctgaatttgatggtggccacgccgtcggcgagcgagtagtcttccggcggcgacagcgtgacgactttctgcgtttgcgcgacgccgtacgtcagggccacggtgacgcagatcatggcgaccaggctgaacgcgccggccgctttcgcgcggcggcggaacgcgatatgcgtgcgtgcgatcgcctcgttggcgccggtcggcttgactttgaagcccatgacgatgctggcgattgccggaatggcgaagacgagcgccattgcgatggtcaggctgcgctgatggttgatgccccacacgagcgcgaggaaggcggcggtcgggaagctgacgatgcgtttggattggaggatctgcgcaaggtcggtgaaatgctgtgcgaacaacagcgcgaccaacagcagcaccgccgtcgtgaacgaccagcggacggcggtggaacgcatcgtgcggaagataagcgcggcgatgattgcgacggccgcgcccaaagcgaagccgagcgcgcgcaacagcatgtcggaagtgaagatgggatcgcccggctcgacgaagatcgtcagtcgcagaatcacgtcgggcagcgcacgaaaggtggtggccgcgatcgcaagcgccgcaacgagattcgcgatgtcgagcagcgcgcggtggttgtgccagtcggcggtgatgcggcgggcgaacaggacgatgacgaacacggccacgtcgaggatcacgcagcaccacagggtcggatagttgacgaacgtgcgttgcgtgatgacggcggtggcgcgcagcgcggcgaatacgactgcgccggcgaatccaacaacgaaaccggccagccgccagtacgcgctcagaggcttgtcacgcccctcaccgacggtgagcatgacgctcaacgccatgacgagcagcgccggcgccaacaccccctgcaacaccgtcacaaactgcagcagcatcccaaaatcctttcatccaaaaacccaactcaaagagcccaacgattcccattccgccccatcccaaagagtcccacccctctcacccccctaaaatgcgaggatttcccggaccccctccacaatcgcagaggtgaatccatccccctaaacgcgagagagcggtttcggtatgcattgcccgaccgtaagcttggccgaacggccttgaatgtgtcgggtaatgcataccgaaaccgcgaacgggctacgctaggagatcaccactcctgcggcgtatagttccagtccgggaaggtgacctcgatcggttccgtccagaagcgtcccttcacacccgtctccggatcgacgtgcagcatccagcccttcttctccggggattcgatcttcagcacgagtttgtacgcgccggccttgtcgagcttgacgttggcgccgtagtgcgggccgtcggaggcgttcatctgcatgaaggttccggaggcgacggacgcgttggaggtcttgtcgatgatgtcgtagttgacggtcaggtccggcacgaaatcgcccttgccgtagccgagttcggtgcccttctggttggcatggatgtcggcttcgaggtggaagctcgcatcggcggccttgaggcccatgccggacggttccatgtcgatcggctggaagtacacggcgttgacggtcagcgggccgcattcctggtcggagtgcttctcatcgacctggatctcttcgaaaccggcggaatcgctggaatcgtccttgctggagtcgtcggccttcgaagccgacgcggaggcgctggacttgtccgaagcggcggaatcgttggaattgccgcatgcggacagggagaaggccatggagccggccagcaggatgccgagcagagcggcgatcttcttgttcttcatttctctttcctttgttgttggatgtggaaaaaatatcggtaaatctcggaaaatttgcgtattacttgcgattgtcaggcgtgcgcaacttgcgtttgcgtgcgaagccgacggcgaacagcgcgagtacggcaatcgccgcgatcgcttgtgccgcaaggcattcgacgtacggatacaggccgatccagtcgtttgtgggcacgctggacaggtagtggccgtcgatcaggtcaccttcgatgagcgcgtggatgccaccgccggcgaagatgacgaccagcacggccatcaggatcgacgtaacgaggaagaacgggccaatcggaatctttacggaggtgaagcgcagcacgaggaagatgacgagcagcaccacgcccgcggcgatgccgccgatccacatgccttgcgcgtcgcgactcatcgagtagatcgattcgtagaagatgacggtttcggcgccttcacggaacacggctaggaagctcagcatggcgagcgaaacgaccatacccaggcccacgccttcgccggcggcgactttgttttgcgcgtcggccacggcggactcggttttggtgcggatgtaacggttccacgcttccacggaacttttgttgagcatccagttgctggtccacagcagcatgagcatggcgatcagcgcgcacacgccttcgctgatttcctggaccgggccggagccgccgaacaggaacgtgaagagcacggcgaccagaccggagccggcaaggcccgcgagcacgccgaggtaaatccacttggtgaaacgctggttgccggatttgacgaggtaggccaccacggcggccaccaccagcagcgcttcgagaccctcgcggatcaggatgaggaacgcctgtccggcggagctggtgatggctttggtgaaggcgttgacgttgccgaccgcgccaccgtcgagggtggccgcgtcttcgacgagccagcttttcaggtcgtcgacaagctttttgatctccttgtcggaaccgccgtcgcgcatggttttgcgggtcatcttgaactggtattccacctgcgagacgcggtcgccggagatggcgttcatgacgttcttttcgaagccgagcttttcgtagtactggtagtacgcgtcgttgacgaggctggagccttccgcgcccttgccggagatggcggccttgtatgccttgtcgaggatgacgttcatttcgctggcgacttcgctccacgtgcggtcgcctttgcctttggaggaattctttttggccgcgtcgagcttcttacgttccgcggcggtctgttcggcgcgctgcttcgcgtaggttttggggtcggcgaggttcgcgttgccgtcaagcgtctgcgcggccgtgtcaaggtccgcgttcagcgcgttgattccgtttgcgatcgcgctcccctggccctgctggtacgcgagtccttccaaatcggtgaactgtgtgagcagcgcctgctgcttgtcggcggaaatggtgtcgttgacggccttcgagaagttggatgcgtcgtagccgatccaatgcgcggtctggaagccggtgccggcctggccgtaatcgccgtcattgtagtctttttcggcggtggcgagctgcttggcgatgttctgcgcagcggcggtccaggaatcgaaattcgtctggttgccgtcagcggcggacgcctgccgcggcatcgcgatgccgacaaacagcgtggcgagcgcgatcatcagcgcggcgacgagcgtgatgagacggccggaagccgagacgcgcgaatcgcacgaatcgtaggaaccggctgcgtggcgctgcgcgacgcgagatgacatgggtcgaaccttccttccgcaaatcttttcggcgcgatttccccgacgtacccgacgtacgaagcgcgcatcggaagccaagatagaacgaaagttttttgaataacagtcttgatttttaattggtcttgttgtatcgcgcatgaaaaaacgttggaattccgccgtttttatttttcccgttttccgcgtgtcgtctcacattgtgacgctcaccgccgttccgcaacacccccgtccgcccgaaaacgtgaagcgaactccatgccaaagcgtcagtttgtataatcgcgacttgcataatcacgattagcataatcgtaaccatacaaagctacgggggtatcaaaataaggcgatgcctcatgccacacccacgaaaaaacatctcgcttatgagtggcggatttggcggggtgacagttggtatctcgcttatagatggcggcccctttgcaaaatacaagggttagaggggcgaaaagatgccccctaggttcgtttctccgccaagacccgccatctataagcgagatagcaccgggcgaaccccggaatccgccatctataagcgagatacgcgtctcaattggctcaatcacccaacagccaatcaatggcgttgacaatgcgtataccatcctcggtgacgcccgcgcctcgaccgcacgcaaaatcccgcgcgcccgccagccccaggcacgaactccgccaagccgggcacgcgctagcatcgtgggtatggattccctcgcaccgctcgcgcatcgcatgccgtacaccgccgcgttccccaaggcgctcggcacggggttgttgatttcgacgcctcacccgatcactgcggaattgcgcggcgagatggaacggttcatcgatgaatacgagcatgcgctttcgcggtttcgcgctgattcgctggttgcgcacatcggcaatgcggagcatggcgggcatttcgattttcccgattgggccggcccgctattcgatttgtacgacgcgctgcacgccgccacgcgcggtgcgatcgacccgtgcgtgggcgaggacctgattcgtctcggttacgatcccgcgctgagtttcaccgttgaagccgacgccggcgagcgcctgggcgcgctgcacggtcgggccgtatggggtcgtgatgtggttcgttcgggtggtacgacattggttacacacagtccggttcatgtggatttcggcgcgtgcggcaagggttatctggtggattcgctgggcggattgctcaccgattcagaactttcgcgcacatcgcatgtcaagtcagccgaaacgaccaacccgacatgccaatcttccacctcagacagcaaacgcgaaagcgctgccccggaatttgtgattgatgcgggcggcgatctgctggcgcgcacgaacaagccgatccgtgtggcgcttgaggatccggatgatccgtcctacgcggtcggcgtcgcactgatcggcgatggcgcgttctgtgcgagcgcgcccagccgtcgccattgggaggtggcggtgaacgaacagacgcatctggcgattcaccacctgctcaacgccatcgacggcctgcccgtgcagcagacggaggccacctgggttgcggtgcgatccgcgtcgtttggcggctatccgactgcggtggcggacgggttggctacggcgctgttcgttgcggatccgaacgagctgagcagcactttcgctttcgattgcgccacgttggacgtcgaccgtcacgccaccatcagtgccggtttccccggccgcttcttctgatttccaacaaaactcacggaatgaggttgccggcggccacgtacaggtcccaccaatcctgcttgtcgaggtcgatgtccgcgccgtcgagcatttcgcccagccgggtggggttcatcgagccgagcacgatctggatcttcgccggatgcctgagcacccatgcggtggcgatggcgttggcgctcacgccgtacttggcgcccttttcgtccagtaccttgttcagctccgggaagtgctcgttgcctacgaacgggccgtattccgtgccggactggaacgggctccacgcctggatggtcatgtggcgcagtcgcgagtaggacagcaggccgtccgaatggttggccacgaccatgccttcggcgccggagttggtcatcagctcgtcgctgaccatctgcgcgtgcatcaggccgaactgcagctggttcgcctcgagcctcatggccgggtcgtcgccgagccaggactgcagcagttccgcctgccacgggttcacgttgctcacgccgaagtggcgcactttgcccgccttgtgcagggtggtgaacgcttcgacgatttcctcggcctccatcagggtgtcgggcctgtgcaggagcgcgaagtccacgtagtcagtgccgagcgcttccagttcctcgtcgagtcgcgtgatgaggtgcttcgcggagaagtcgtagcgggtggcgtgcacgttgttcgggtcgctgaagtcgatgttgataccgaacttcgtctgcaggaagatgtcctcgcgcttgagcccggcgtccttccacgcgcggccgagcacacgcgagctggcatggtcgcggttgacgttgaatccgtagatgtccgccgtgtcgaagaagttgactccatgctcggcggccgtacgcacgacttccgccgcagcgtccgcatccagcgcgtccatgcgcatcacgccgagcgccgcctgcgatgcgaccactgccgatttgccgatttcgatgcttttcatgactgcccactttctttgtgattttcaaatacgtcaatcgattgacgtcagtcacctcaatggtaaatccgccgtcccgtcagcgcaacacaataaaaatgccgaagccaaaacgcaaaaatccggaggggtggcccctccggattttttagcgagtcagcacaccaacctcactcggccagcgtgaactggctgttgtagatgtcggcgtagaagccgcccttggcgagcagttcctcgtgcgtgccgcgttccacgatgtcgccgccgttcatcaccaggatcatgtcggcgtcgcggatggtggacaggcggtgcgcgatcacgaagctcgtgcggcccacggtcagcgcgtccatggccttctggatcagctcctcggtgcgtgtatcgaccgaggaggtggcctcgtcgaggatcaggatcggcgcgtcctccaccatcgcgcgggcgatcgtcagcagctggcgctggccctgggaaagcgacgccttgtcgtcgagcacggtgtcgtagccgttcggcaacgacatgatgtagtggtgcaggccgacggccttgcatgcggccacgatctgctcgtcggtgacgtccttcttcgaatacgcgatgttttcacgcactgttccacggaacacccacgtgtcctgcagcaccatggagaactggtcgtgcacgttccagcgcggtacggacttggtgtcgatgccgtcaatcgaaatcgtgccaccggaaatctcgtagaagcgcatcagcaggttgaccatggtggtcttgccggcaccggtcgggccgacgatggccaccttctggccggctttcacggacgcggagaagtcgttgatgatggtcttgtccggatcgtagccgaaacgcacatggctgaattccacgtcgccgcgcaccggctgcggcttgccgtccgcgtcaacgccgagcaacgcccgcttgccggattcgtcggccagttccggctcgtcaaggaagccgaacacgcgctcggaggcagccgcgcaacgctgcaggttctggaaggcctgcgcgaactgggagagcggctgggtgaacaggcggatgtacatcatgaacgccacgatcacgccgaattcgatcttgccgtccatggcgagcgccgcgccgaccacgcacaccaccacgtagccgaagttgccgacgaagttcatgatcggcatcatcaggccggacaggaactggcttttccagccggacacgtacaggtctttgttgtacttctcgaactgctcgatggagcgttcctcgccgcagtatgccttgaccacggtgtggccggtgtacatttcctcgacgtggccgttgacgtcgccgagcgccacctgctggcgggtgaagtacttctgcgacaccttcatgatcacgcccatgatgatcaggccgagcagcgcggagccgatggcgcacagcgtcatggtcacgttgttgtagaacatcatgatgagcgcgccgaagaacagcgtgatcgaagtgatcagcgagccgaccgactggccgagcgtctgtccgatcgcgtcgacgtcgttggtgatgcggctcagcacgtcgccgtagctgactttgtcgaaatatttcagcggcaggcgattgattttctggctgatcgcctcacgcagctgctgtgccgtgcgttgcgtgacgttggccatcagccagctttgcaggtagctcagcagcgcgtacccgacgtacagcgcgacgagcagccatgcgatgcgcgacaccgcgtccatatcgatcgaattcatgacgggcttgccgtgcaccatggccggcagacccttcgtgatctcgttggtcatgtccttgagcttgtccgggccgatgatctggcacaccgtgccggcagcgcccagaaccagcgcgagaatcatcaccggaatgtaccggctgcagaatttcacgagcttcttcatcactccgccgaagtccttcggcttttccacggccccacggccgcgtcccattcctcttggcatgcctcccctttcagcgcttcagttcgtcttcgctcaactgcgattcggcgatctgccgatacacttcgcacgtgtcgagcagttcctcgtgcgtgccctggccgaccactttgccgtcgtcgagcacgatgatgcggtcggcattcatgatggtgccgatgcgctgcgcgacgatgagtttcgtggaatccttcgcttccttttcgagcgcgtcacgtacggcacggtcggttttgaagtcgagcgcggagaaggaatcgtcgaagatcaggatttccggatgacggtagacggcgcgtgcgatcgacagacgctgcttctgcccgcccgaaacgttggaaccgccctgcgaaatgccggaatcgtacttcttctgctttttgtcgatgaattccgtcgcctgcgcgacgtcgcatgcgcggcgcacggtgtcgtcgtcgcggtccgtatctccgtacgcgacgttgctggcgatcgttcccttgaacaggaacgactgctgcggcacgtagccgatcttgtcgcgcaacgccttcagcttgtagtcgcgcacgttgacgccgtcgacgagcacctcgccttgcgtggcgtcgtagaaacgcggcacgaggttgatgagggacgatttgccggagccggtcgagccgatgaacgccaccgtctgacccttcttcgccttgaaattgacgccttcgagcatggcgtgacgcgagtcggggtaggcgaagctcacattgcggaattcgatttcgccttcctcgcccggcttgcccgcgtcctgcgtgccgtcggtgaccatcggctcggtgtcgatgacttcgagcacgcgctgcgaggacacgtcggcgcgcggccagagcacgaacaccatgctcagcagcaggaagctcatgatgacctggatggagtagctggagaacaccaccatgttggagaaggtggtgagcttgtcgacggcgtcggcagcgtcgatgaggtacgcgccgatccagtagacggcgagcatcaggccgttcatgatggtgttcatcaacggcatcatgatggccatggcgcggttggtgaacagctgggtttcggtgagttccttgttggcttcggtgaacttggcttcctggtagtcctcggcgttgtacgcgcgcaccacgcgcaggccggtgaggttctcgcgcgccacgaggttgatgttgtcggtcaggcgctgcatggccttgaacttcggcatgacgaagctcatgatcacggcgatgaccaccagcaggatggccacggcgatgccggttgcgagcgtccaatcgaagccctttcctgcgatcttgcacacggcccacacggccatgatcggcgctttgacgatcatcatgaggcccatggtgatgaacatctggatctgcgtgatgtcgttcgtggagcgggtgatgagcgacgcggtggagaaacggttcatttccgccggtccgaagctttccaccttgttgaattcaagcgaacgcaggcgctggctgaacgaggcgcccacgcgcgcggcgatgaagccggtgacgacggcgcaggccgccgagccgagcgagacgagcagcattttgccgccggccacccagatgtcgtgcatttcgctgccgggggtttcgacgagctgcgtgatgtcggccatataatccggcagggtcaggtcaagccagatctgaccgacgatgctgaccagcgcgacgagcatctgaccgatctccgctttggagaggtatcgtacgatgcgaagcatgcttggttccttctcttacgttttgtgttttgcttgttttcttacgattagtttttgcgatttttcgcggtttttgcgattactggattgcgattacttacactgtgaattatttacagcgtaagatactacgcgtcttcctgtgcgtttcctgagaacgcggctttgacctcgtccgccgtggggcgcggtttgccgggcatgcacagcgacatgtacgtggtgaattcctcggtgagctcaacgaattcgcgcgcgcggcgctcccccatctgcgagaagatccagcagatcgcctcgcgcatgctttcgcgctgccgttcggcgcgttccctgccggcttcggtgaggttcacgtgcaccacacggcgatcgtcggggtcggattcgcgtgtgatctggccttttttctccaacgcggacagcagtgtggacacgcgtccggtggtggttttcattgaagaggcgagctgcgatggcgtcagcgggcctttcctatagagttcctgcacggcgaagggttcgcccttcgcgcctttcaccatctcctgctgcatgcgcgagcgtttgtcccatgtgttggtcgccaattcgtggaacagttcctcttcaaagcccacgcggcacctccttccgtcgcaatcgccgtcataatatcttacagtgtaaacattttacagtgtaagttattcccagggcgattttgcagcgagcaagctacagaaggcacgaaaaaggccgcggcccgaatcgcgattattgtgcggaatcgggcgcggccaatcgtacgtattgcgcggaattcagccgcgacgggcgtcgacggaggcgttcagcatcgccagctcatcctgcgtgagcgtcagttcggtggcggcgaaggaatcgttgatctcctgaggattgcgggcgctggggatggtgaacaaccgctcgtagcggctcagttcccaggcgagcaccacgcgctggtaggagcagccgtggttgccggcgaccgtgcggaacgggtcgtacgcgcgctggtcgaacgcgtcgaggaagccaccgagggggctccagcacacgaacgcgagtccaagttccgcgcagtgctccatcgtatgctcagggtcggggtgcgagggcgagaactggttctgcacggcgatcagcttgtcgccaagcatctcacgggcagtgtcgatctgcgcgttgtcaacacgggagatgcccgcgtactgaatcacgccttcgtcaagcaattgcttgagcgcgccgacctgatcctcataagccacttccgggtccgggccatgcgaatacaacaggtcgagcgtatcgacgcccaagtgcagcgcggattccttggcgtcacgaatcatggtttcggggcgcgaatccgccatccacccgtattgactgcccgccgcctgcaaatgctggcgttccccgccaggccgacgactgcagccctcggaatcccgcccctgagtgtccgattctggcgaatcggacacaggagcaacaaaagcgggaacctccatggtgcgtcgatagccggttttcgtggcgaccagcacttcatcgcgagggccgtcccagctggcgagcgcgtcgcgcaccattttttcgccgtagcccaggtcttcggcggtgccggtgccgggttggcttggcaggtaatacgaccaggcggtgtccagatatcgcacgcccgcgtccaagccggcgtggatcgtgcggatcgccgtatcgcggtccgggcggccctcaatcgccaaagccatcgttcccatgccgagccgaggaatcgtaaatcctgccaactcaccgttcatcatcatcttccccttccttgcaagcacgcagccgattcgcacatgttcacatcaagactaacccaacgtgaaccggcgcaagcttgtcgggcgcgtgcgcgaagataaaggcacaaccgaacgggagccggaaggctgagagggagctcgacgagcttcgaccgaggacttgatgcgggtaatgccgccgtaaggagacgggttgttcgcgccgcgaggcgcatctcatttccgttcgcgataaccgaatatcgcgtgattagggtcacggaggggcgcaccacctcatagggtacggttccttcggcgacccttttttcgtaccaaccgtgaatgtccgattcaccggaagcagacgctcggaagcccacaaagcagttctgaacgtccgtttcggcgggaacggcactcgtggggcctgacatacagaagggaaccgaaatgatcatcaacggcaaggaagaggacgtcgccacaccgatcaccgtggccgagctgattgaaagcaagggactgcgcgccgaccgcgtggccgtggagctcaacggcgagatcgtgccgcgcgcccagcgtgcgcagacgcagctcaagggcaccgacacgttggaaatcgtcacgttcgtgcagggcggctgagcacagcagcgaaacaaaccatacgagcggaaacgagaatacgagaacaaccatgacttttgaaccatccgcatcgcaggcgcagatcgacgcccgccagcacgctttcgacaaccagcccgacccggccaccttggtcagccgcgaggagatccgcgcggccctgctcgaccgtcacacggccgccacgcaggacaagctcgacgcggcgcacgtggccatttgcggctgcggcggccttggctccaccatcgcggtggcgctgacccgcatcggcgtcggccatctgcacttgatcgacttcgaccgcgtggatatgacgaacctgaatcgccagcagtatttcctgaaggacctcggccagtacaagacggaggcgctgcgcagcaatctgcgccaaatcaacccgttcacggacatcaccatcgacaccgtcaaggtgaccgacgagaacgtgccgacgctgttcgaaaacgaggacatcatctgcgaggcgttcgacgtgccggaaaacaagacgatgctcgtcaacgcggtgctggagaatctgccgggcaagaagctcgtcagcgcgtccggcatggccggcttccgcagctccaacctggtgagcacgcgtcgcgtttcgaagaacttctacttctgtggcgatggcgagacggctccggtaccgggtgccggcctgatggcgccgcgcgtgggcgtggtcgcctgccacgaagcgaacatgatcacgcgactgatcctcggcgaggaagacgcctgacgcactgctacgttactccactgccgtaatcgaaatttttattgcgattacaaacgcacgttgcacacaacacaacagcgacgcaacggcaacacaacagcagcacagcaatcgcaacaacagcaacaccaaacaccccaacgaaaggaaccgacgatgagcaccgaaaacaccatcaccaccgcagccgccgacgtcgcggccgcaccgaacgccacgcttgacgagctggtcggcaccaccacgaacacggcgatcctgccagagccggacgcgcacgcgtacgacgagatcgccacaggagacgccgatccgttgattctcggcgggcacaagttcacgagccgtttcatcctcggttccggtcgttacgacctgaacctcatcaaggcgaccatcgagaacgcgggcacgcagatcgtcaccatggcgctgcgccgctgccgcaccaccgaaaacaacctgctcgactacattccgaagggcatcaccatgctgccgaacacgtcgggcgcgcgcaacgcggaggaggcggtgcgcatcgcacgtctcgcgcgcgaggtgtgccagacggacttcgtgaaggtggagatcgagcacgagtcgaagtacctgctgcctgacaacgaggagaccatcaaggccacggaaaagctggcgaaggaaggtttcgtggtcatgccgtacatgttcccggacccgatcgcagcgaagcgtcttgaggacgcgggcgcagcttgcgtgatgccgctcggcgcgatgatcggctcgaacaagggcctgcgcgcacgtgacttcatcgaggtgatcatcaagaacgccaacattccggtgatcatcgacgcgggcatcggccggccgagccaggccgcggaggccatggagatgggtgcggatgcggtgatggcatacacggcgatcgcatccgccggcaacattccgctgatggcgcgcgccttcaagaacgcgattgaggccggccgtgaagcgtacctgtccggcctgggcaaggtgacggaagaccacgccgtcccgtccagcccgacgaacgaggccgactacatcggctgattcgcgccgatttcgtacgattcgtgcactaacgtttcgcactgttttattgcgattacacgacgagggtcggtggaaacgcacattttcgcaaggtttccaccgaccctctttcgtcggatgcgcgacacgtagcgcaacacgcgcatgccacgcataccgcagcgacaggcaatacgtctacttccctagagccgccttcaggtcgcggttctggaatcgctcgtgcagcaggcagcagccgccgaacacgacgagccacagcaggccggcgatggcggaaccgcgcgtatctgcggacaggaacagcgtgacgtacacgaacacgtagaacgcaatcgcaatccagtcgcacacctgccatgccggcatgacgaagccgtccggcaggaagtcggcgctttgacggtagcggcggtgcgcaagcatcgtcagcacgtagatgaagatcacgacggcgctggctgcggaggcgaacagcacgaacgcgctggagatgcccgggatcgcgttgatcagcggggagaacagaatcatacagccggacacgataatcgccttcgccggcaccttgtgatccgacacctcaccgaggcgctgcatagcgggcgattcggagtcctgcgcaagctggtataggtggcggcccgccgagtagatcagcgaattgagtgccgacgcggctgcggtgatcaccacgaagaacacgagcgcggcggcccagtcgagcccagcgtatttgaacaccatgatgaacggggagccgaacgagccgtccgcgttctgatggaagttgcgccacggcacgatggccatgatggccacgagcgcgcccacgtagaagatgaggatgcgcatgatcagctcgttgacggctttcggcagcactttgcgcgggttctgggtttcggacacggtgacacccacgaattcgatgagctggtatgcgaagaacaccatttggaaactcagcaggaagttcatccagccgttcggcgcgagttggaatccgtcggtgatgtttttcaggcttacggtggcgccggagaccgtgccatccacgccttcgatatgcgtggccgggtagtggaagccgaggaacagcatcaccacggcggtgacaatcagacccacaatcagcgtgattttgatcatggagaaccagaattccgcctcgccgaacactctcacggctatgaggttcacacaggtgagcgccacgaggaagcacagttcgataagccatttccatgatttgaggtctatgccgaacgtaccgaagaacgtgacgaaatacgtgctgacggctgtgatttcggtcatgccggtcaggatgagcacgatccagtacgtccagccggcgaatttgccccacgcgcggccgaggtagcgggtgatgaagttgatgaaggtgtgctggcttgggtcgctgtacatcatttcgccgatggcgcgcatgagcaggaacatgatgaggcccacgccgatgtacacgaggatgatgctcggtccggtcagcgcgatcgacttgccggagccgaggaacaggccggtgccgatggtgccgccgatggcgatgaactggacgtggcggtttttcaggccgcgttccatgtcgttgtctttgtcgaggctttcgatggatttgatttgcgcggtttccgtcgcttcggacgtgcttgtaccagtttttccggttttcgtattcccaaaagtcataatgttcacaccctaccgcgtcaaccgcacaatctctgccgttgttcgtaccgcgaaatgcgctatatgtggcagattcgcatcttttccaaaaaaacgctttgcgacgggtggagtcagcttgccaaggttttcagcctgccacggagcgattcgttttcgcgttccagctcgttgatacgccgagcctgttgtttgatgatgacaagcgccgtctcgctgtcaaggccgccgctcgcgctgagaggtgcaggcggcacggcgatggcagccgcatcggacgggacgggcacgtcagcggatatacacccccccccgacacgttcgccccgtccagcgaattcggagcattttcaatatttgccttatcgggattggcgattcctgcgatgccgtcgagtttctccttgcgcgtcaccgcatgaacatacaggttgacgagctccgtaatgatttcgccgttactcatgttactgctaccgttcacggatttgaggacggcagccttccaacgcgccacacttcgttctatacgtttatacccaatcagttccggcggcaatcccgcctcgcggaagattttggtcggcgattcccccgcaagataccgtatgacacacacctgtttgaaagcgttggagtacgtgatgcggtctttcgacacgttagccaccgccggcagatcccgcaacatttggagctcttccatgctgaatgatcctccaccgcgcatcgttttaccccctttgctataccccgtgatgaagcaagtgtatatccgacttctcacaagcagcttttcaaatattgctgaccgtatatcacttcaaccggtcggtcacacatcaatgcgggcgattatggaatacccacaaccgcccgcattgacttttattgtgagtgagtcaattcacaactcactcacaccgaacgcatgcgctcagtacgtgcggcgacgactcttgaccgccacagccacgccagcgccacccaccagcagcgccacgacggtgaacaacacggttcccgcggcaccggtcagcggcagctgagtgacattcttcacgttcagcacggtagcggtggcattcgcagtggtgttatcgaccggttggacctgacgaagggcatccggctcgaaggtgatgagaccttcatctgtgatctccacattgaaagtgaccctgaagttctgggcgtaatcggtcggagcctgagtctccacaaccgtgtaggttcctgccgcaagacccgcgaccttcaccaaaccatcattctcagtagtgaacgtcttggcatcattctgatcggaaacaaacgaccacgcaccgtcctcagcctgcttaaggaacttgccctccgcattcttgacaacgaacttggcgccggctagaggcttggcctcattcccttccttgccaatcttcgtgaactggaaaccgtaggtcttaaggacagtcttgccttcaccgctggtaccatccttggtggtgattgtggccttgttgtccacactgccgctcaagccatccaacgcatccttggtgacggtgccctggtacgacacgacgatcgtcctaccggccagcgttgtggcatcggcaaaatagatggtcgtggtggtgccggattgagcattgccttcctgcgttatcgtgtacagatcgggattcacagtagtatgatctctgaactggaccttgaagtcactcgtttccgcaatccgcaaacctttggacgcgatatcggtaatggtaaaggggtacgcatcccagccagccgcagcatgaggaacctccgcggccacagtgaagtccacggtgtcgcccacctttacgctctgaccgttcacatccacgtcattcatccgggcgaacttgagcggctcgtcggtcggattcgcgttcttcgcgttgaactggccttcagtcgtgatgttgccctgaccggtcgtcgcatcggcagcaatcctcagattggacagtccattgacggtggtggccaccacagccggagttcccgacgtcgcagtcgtttcgccagccttggtgaacgtatccttcaccagataccagccttctccgtccacattgaccgcctggctcgtatttgcctgctccttggttacggtcaggccagtaccatcaggtcctgccggcggagtaattccagccaaggtcttggcgaagacacggagctgatccgcagtgaacgtcgccacataggcggctggattatccttgtactctgtcgggatgccgttgtgacttccatcagccgcgtcagcagcggtggtcacagctcccttccatgcgtcaaccgttttcacttcgaccgagccattgccaggattctcgaacgtggcaaacttgtatggcgtgtacgtatggtcttcctgtgcgtggttaacttgcagcaatggagcatcatcagcctgtgcggcggcgacgccgatggccatgccgctcagcaacgttgccgcggcggccagccctgcgaaaagcttcctcatcttcatgagaatctccttttcctaattgttggttactgtgttctgcaatcgcgggaggcgggaacccaacgcgcccccgcgatccgcaaatcctgtgttattcagctgagccgcttcttacgtctccactggtcggccgcagcgacggcgagcaatgccagcacgccaactccgccggccgcaatctgccaccatcgttccgcacccatgcggcccgtcaatggcagtgacgatgccgaaatgtattggttggtgaacagcattggctgggtctcgtcccaattcgaaccagcggcaccataatcggttttcagctggatcacggattcgacaacggccttccattcaccggacgttccgtctttcatcacggacacgaccacccggtattccgcctgcgagtaatacattgcggaagcattaccagcgttctccgtcacaagatatgtgtactcggcttcacctgcgtcatacgtgatgtcgccgaagtaagcaacgtgatcgtcagacgaatcgcgtttcaccgtcaccgtgcacgccgactggttcttgcaggaagctggcatcggcgcgtctggattggaatcgtctgccttcagcttgaaagtgaactcgtcggaatccttccaatcgcgccccttcagctccttctgcacgccaatcgcatgcgtcagcatggtctgcttcaacgtgttggtgatgactactgtggcgttctgcgatgccgtggattccggcaccgtcaccacattgccgtcagcaagatttccatcgccgaccttgtgctggtaggaagccttccacaagtggctgtccggttcgacttccgtcaccgtgtacgtcttttgggcgcctgccggaataatcacgtcggtggaccatttgccgctatcgtcacgcttcagcgtgaccgtcttataggtatcgttgccctgtttgatatccaccgtgatgctttccggcttctggccgttaccgctccactgcttgtcgacgtgcagtgtggaatgcaccacctggattaccgggtgcggatacgggttctccctgcactcatgagtcttgccatcggccgtataggtcaagcatgcggaatcgttcgtatggaaacccggctggttcgaggacgtggcgtttcccggcagatcggtgttcgcgttaccctttacgccgtcatatccatccttgccggcattcaggttggcggcatactcgtcatatgccttctgcgtgggcttcacgttgtattccagcgtgtatgtcacgttgtgggccagaggcttcaggaatgcgaccgtgaatttcttcgtgctcgcgtcatacgtcaaggtgtaatcgacattcttagtcaaggagaccaccttgccggaagcatccttggcaacgaccttgtagttgctatccgcaagctcgacatagccggagagcgtgtcctccatggtcaccttggtgtatgcggatgtggtggtctcgctcttctcaatctcgtcgaagatggcattcagctccgaagcgttcgtcgcgcttttataatagccggctttgatattcccttcaccgcgctggttgtatttcgttgcctttgggaaattgctggacaccgcatgcatgaactggttctcgttgctggagagcgaggacgggttggcactggcgaagatgccgatggaatacaccgtggcgccaccatctttcaatcccttggcagcttcgacggccttatttgccactttaccctcgaagccattagacgatgtaggcgaaccatccgcgaagaagataacgaccttcttcgcatcggttcgagcactagcactgcccatcaccttgaccgcacgattgaatccattgtcggcgcgggtggcgccagcggctttgagtttgctgactttgttcttcagaccgttcatatccgcagtcagattgctaacgatttgggagtagttgtaggtgtacccaccacttcggtacatgtcatccccgattttgtccgttttatcgccggcgaacttcaccagtccaacgtgaaccagttcggaaccggcctccgtattagtattcgcagcttcatcaagaaatgctttaaccgcttctttcagtgcgtctaaccgcctggtccgatccgtcttactcatcggatcgtccatcgaaccggacacatccagcaccagcgtgaagtcgatcggctgggtggtggtgaccgtggtgctgttgacggcgcccttcacatccacgttcacggtgtaactgccattatcgttcttcttgatgcgcttatgcttctccggagcgcccaactgagaaccagtctcgttctgcgcaaccgactgcgcccgatttgctcgcgcaatcggttgagcggacaacgtaactggctgctcatcaggttgttcagattgttgttcagattgttgttcaacctcctgctcaacccactgctcagtctcttctttcgtttcttgttccgtttcttgttcgacttgctggtaagcctcttgatctgacggctgctcttgctctgacggctgctcttctcccaccatcaaattttgttccaccggctgtgaatcctcttgcccagattcttgcaataccggctgctcgatttgttgttccaaggctcccgtggcatcttccgccgccgctgacgaagcagtgacgcaccccacgccggcgagcattgcgaccgtcgcgacggccgcaatgacacgacgcgtgaacagacctgtgcccctcgccctgtttcgctcaaagacgtgtctcatacgcctacccccttgcaccgttaagcgatcggggaaataccttcctccttcgaccggtatatttgatgcgtcttcgcttcacataccgtccgacaatcgcttcgttgcctaaaccttaaggagaaaaacagagggatacataccctcccaacgaggtaatcaaggggatatactttccttgaaatcgcacatatcatcgcgattctagagtattcttgcccccgtaaatcgcgatgcaaaaactataagcaaacgttgtcatgtctctttcagaattttccccgacaaaaaagcatctgtcaagtgcaacattaacgccatcaacccctagttgcgctttggccaccaagcggcatgcctacggacatgccacggacagcggagcagccaaaccaacaacaaaccgaccagcaacgtggcagctgacaccacgcccgcaatcacacgcacatcttttgccgcatcatcctccgcgggaatctcttcgggaatggcggaacgcagcgcagaaaccaacagacggtgcgtattcacgccatacggggtgcatgtcatcaacgtcacacggtcctcgccgggcacgatcttcaacttcgacgtgtcatccgggttgatttcggtgatgcgatccaccatatagccaagcgtatggcccatcacatcgatatagaagtaatcaccaacccgtatctcatccaaacgcgtaaacattgaggcttcaaccaaaccccgatgtccggtaatcaccgcatgcgtatccttgccacccaccggcagactactgccatacaaatgccccgcaccggacgcaagcgtctgctccgacgtgccatggtaaatcggcaaatccacagaaatctttggaatgcggatggaacccatcacgccatcgccagtatccagcaaacgctggtattccgcgtctttggagctagcggaatccttgttaccatcgccagtggcgcctgcgcccgtcgagctggaaccggaaccgtcgctggagtcggactgattgttgttgtacaactcggcgagcggatcctcagcctcgccaatcaccggctgccccgattcggcgagacgcttgttgtacgccccagctgcggcgaatgcctcgtcggcctgcggatacggccagcccgcgacgctctgttcggaacgggcggacgtgctcgccagcttttgcgcggactggtattgcagcactttcgggaaaagaccaatgccgattgcggagaaaatcagcaccgccgcaagcacacgcagggcaatggatctacccacgtcggtacgacgctcgcgaatctcttcggacacatcggtcgcctcggcgaacgtcggcggaacgtaggtgcgtgtgttgcgcgtggtgtcgtgcgaaccgcgcgagccgtcgttgccatcgtgcgaatcgccataaaaatcgtcggcgcgtaagtccttaatttgctgcggaccgtcgcttctcgacccgccgcgcgcgctcccatgcggaaaaactgccatcagtcttacccccttgaactgccagccatagggaacattatattgcactccgcccgcgtgcctcacatcatctgctgcgcttataaggcagcgagtcgggacacgttttatgcaaatcgtgggttagacccatcaaaaccctttgcaggaagccaaaattagcattttcgccaagagcatctctaaccgagtctgcccatggtcaaactgatgggcctatctggcttatagatggcgggtgttggacgggaatagacagttcgggggcatgttttgtacccctgaactggcaaataaggcgcaccatccgccatctataagctagatagcataagtcaggcctcagcggaggcaggattgggcccgacttccttgtccagcttgttgcgcaacctcaccacatcgcgctcgagctcgtcgatacgacgagcctgctgcctgataataatgccggccgtatcaccgtcgaacagtccgagagacaacggatgaacgtcattcgacgcagccgttgcggcaggcttcggctcagtggccgtattggcgatgtcttcaagactccgcctcgtcgccaacgcacgcttataccgcgccgcaagctgcgctatgatctcaccatcggtcatggtgtcgctgccgctcaccgacttgatggccgcatccttccaccgcgccacactgcgctcgatacgcttgtaaccaaccaattccggcggcagacccgcttcgcggaagatcttggtgggcgactcccccgcaagatatcggatagtgcacacctgtctgaatgtgtcggaataggtgatacgatcacgagtcacattggaaacagccggcaatccacgcaacagctgaatctcctcgtcactgaatgctcccccactgcgcatcgcaatacctcccattgatgcttcgttgctttcttttgcggatgtgtctgcgattctatggccctccttccgtgcaatacccccacttcactcccctgactaacagcccccataacggttcacgtttccagattccgtttgttgcaacacatcccaccgaaacgccttataccctcgaaaaacgcaatgtccacccacatcgggtggcacgtccaaagcaacgcaatatggcgcaatccaagcaatcccacatgaaatacagagcaatacaaaaaggccgacccataatgggtcgaccttaaatcactccgaattggtgttcttaacgaacaccgtcagagatgggcgatcaggcctcggcgttctgacgagacttgatggcgatggtcacgccagcgccagccacgagcagagccacaacggtgaacagcatggttcccgcagcgccggtgagcggcagctgggtgatggacttgatgttcttcacggtcttttcagacgtgttgaccaggccccacggatcggaagtggtggtcttagccagaacagctgaaccgttctcctcgttgaaagacacagtgaagctcggcatgatgtcgagataggcatcgctggcacgcttagtttccgtgacggtgtaggtcttggtcttatcaagaccggtgaaggacaactggccgttagtaccagtcgtgacatcagtagttgcgccctgagtgttagcagaagcagccttcttgtaggaaccgtccccctgcttcacgaaatacagcggaacgccatccttatccttcacctggaaggtgacgccttcaatgcctttgccatcaggatccaccttggtgaaattgaaaccagtgaacttggtagaggcttcaacgttagtgccgtagttgtcaagcttgttgacaacgccatcctcggcatcggcatcatcattaatcaccgcatggaaggtgaccttgatggtcttgcctgcatacttggacggattattcaccgtgacatcgaaagatgcgtcgtcgccaccgatcacatccgcagtcggaacagtgaagtcagatgcagcagtttcagcagaaatctgcgcaccatccacatagaaattgaaagtaccagccttgatggtcagacccttgcccggcttatcggtgaacttgaactcggtcggagccgggttcgcgatagtaccggtaagggtataggtcagaatgtcgccgatggcagcaaaaagcttattgacttccttagtctttccggggttgttggtgttcttcatgttcacggtggcagcggcagtcggatcggttagaaccttcttctcagcgttaacggtgccggaagcgacaatcatcgggattgccttggtcacagaaccagtggcagacgcggaatcaatgaacacatagatacctgcaggcagggtcgcggtagcagtgtatttagcatccgcactaccattcgtagcaggaactggcttgcccagagtgaacgacgtcacagcagttagtttgccttcactctccagagcattagcaaacttacgggtcttctcaggagaagcccacggacgagcagcagaaacatccagagtgccggcattcagggctgcggccagatggtccacctcagaatccgtagtatccacaccggcagccttcaacgcggagtcaacggcagtcttattgttagaattcgtcaccacaccataagcaacgttctcgccggaaccatactgaacataatcgccaatcttgtatgctttcagtttggcgttggtcaactgttcagcggtttcagcagtgaacgtgaacgtcgcgtccctcgtcaccgttgtaggagtgtcatcagcctgtgcgctggctgcgcccaatgccatgccaccgagcagcgtcgcagcggcggcgataccggcgaaaagtttcctcatcttcatgagaatcctctcttccttattgtttgattacttgtttttgcaatcgcgggaggcgggaacccaacttgctcccgcgatccgcaaattttgatttgccggccggaatgccctcaagttggtaggcattccggcctcacacagcaactcagacgagtcgcttcttgttattccaaatttcggcagcgccgataagcagcaccgcgagtccgccgatcacgccaccgaccagcagccactggcgtcccgtcgcaccacccgtcaacggcagcgccgacaccgcgacatatcggttggtgaaggtgacaggttcagtagcagcactttgcgattcgggaaccgctgcaccgttgtcatccagcaccttggtcacggacttcacggaagccttccactctccgttggagtccttcgcgacagtcacgacaacctcatacttcgcctgcgaataatgcaatgaagcgatagagcccttgacctccgtcacgtaatacgtgtaagaggcatcgccagcgttgtaagtgatgttgccgaaggacgcggtatggctgcccgaatcggagttcaccttcaccgtgcaaggttgatcggcttcgcacttatccggcaacggcgcattgcccttcgccgccagagtgaaatcgaacgtgtcggaggtcttccactcgcgtccggccaggtccttcttcaccgaaatcgcgttctccagggcaaccgtcttcaacgtgttagtgatggtcgcgttcaacgtgcccgcatcggcattggaagaccacaccatctgcttggtcaagtcgacattgtttcccgtataggagacgtcatatcggtcattaccagagatttccgccacggaatacgtgtatccaggaaccaggttgtcgacagtcgtctgccaaccattgcccttattcagggggattacgccaccgacgttctccagctgagcattggaatcgccgctcttcttacgctgcaactgcaccgtaacggaaccgtcatcatgcttgctcgcaccatccgaccattgcttgacgatcttgatcttgccgagcttcacctgcaccacaggatgcggatactcgacttcagtcggtgcgcatgacgtagttccattaacctcggtaagcacgcaatagttcaatcgcgcgtccacattggaatagaatcccggctggcccgcagatgcggtgccagtattcggctctcccacattcgggtattgctggttgccggcataagtggcataggcggcatcgcttggcttgaccttgaaggatacgtcgatgctgtcggctttctcagtaacgataccgtctgtgccgttaaacgtcaccgtcaccgtgcgattgccagattgatcgacaccgtacgtggccgtatatccgcccgtcagcgccttattgccgtttttcaccgtcacatactgtgtgatatcggcaccgtcggccacgccagcgaaatcgaccgggtcgacccactgggacaaggtgtcagtgatggaggagaccttgatcttcgcggatgaggtgatgctggaatagatctggccgaatgcttgcgtcagattctcagcattcgtgccatcgaattccttaccgttcactgccttggcttcacgggcgaaatcggacattctattggcgtcagtcgaagccttcaccacataaagcgaaacattactctcccgcctgttggcctcggccagagcggcagcatagttgtaaccgtagtaattatcactaccctcggtacctgcaccatgcacaccctgaggtgtagtacgccaatcatcatcaggattgcacctttttttgctgcacccaatcggataattggatatacggaacgtcggattgccatcggacaagaaaatgatgtgcttcttcacgcccgtgcgtccttgcagatcattcgcctgcttaagcgcagcctcccagttggttccaccatcaggtttgctggacacagctgttttaatcttgctgacagatgtggtgaagctctgcttagtcgaggccttgtcgctgaatgtcacaaccgccatttggacttgttgagattccgataatttggaattcgcctcggtcagtaatttctcagcaagcttatttgccgcgttcttcgcgttagtatcacgattgtcgtttttatcctgcatactgccggacttatccataaccagcacaatgtcggctggcgtgacggtagtggtttcggaagaagcgctatcacccgaagcattcaaatgcaactcgtactggtcgccatcaccatcgaccttttcgatggtcttattgttttgtggcttcacattggaattgataacagtcacatggctggtatcgctcaccttgaaagaatgggtttccgcataggaaccaccatttccatcgttgtgctgcgacaacgcctcaccattcgcggaaacagtgtatttgccggaattcagctcacgcaccgaataggttgtgtcatcagagaaatcattggattgcacacgagcaaattggcctttggccaaagtgatcacaccgttcgaaccggtgttcaaaccagagctgacaacctgattggtggacgcatcgtaaacgctgtatttgccttcatatggcgtttgcgagccattggcgaacagctggaattggaactgttgatcggctggaatagtgcccaatgtctgcttttcaatgtcaatggccttggacggcttcaccggcaaattgaagctgatcttgcagttggatccgccgtcgccgcgttccagatagaagaagctcaaatgatgggttttatatgcagcggaatcccagttcttgcccgcattactgaatgcctggttaattgtcgtcgcgcgatccgaaccataactttgatttcgatcatacgtgatattcccagtagcaaaatcaatcgttccgcgtatcgcctgatggataccacccaaatcaagcaccagcacatcatcgatgaacacccacacatcgtcgtcaccggtgaaatcaaacaccatgttctgattgttgactttgccatctttaggcatatagaaatcggccccaaggttcatgccgaacgaatacctatcggcgtcgctgtcattgccaaacggcgtgaataacgggttacgatccccgctctgggtctgcttggtcaattcgaatcgattgctattgccgttatatttcgcatatttcgacgccgcatcgaaactgtaattcccttgaccatccgaagtcagcaaaccaccgtccggcatgtaattagtcacagccttatcagacgcaccgccgaagagataatccagcgatccgttgccatccgccatggtcggataatcgttagtcagcagaggcttcacaatgcccgcgtacgcacctctgccatcttgaacatagcggttataaccggtttcgtttcctccgctcataaaatgcaacgcatgattattgttgatggagttgcgatcgtaatcatgcagaccaatgctgataccattctgctgctcaacagtggcattgacgtcatcggccagcgcggcagaagtggtggcgtagcccatgccaccaagcatggcgaccgcggctaccgcagctacgattcgcttggcaaagttcccctttggctttgcctcagattcatgtacatgcctcatatgcattgtccccttaataccgcgcttcaacgcggtttccgtctctaacaccgtccgcgcatcgcgcaccggcacatgccatgtccagtacggatacacttccagcgctccaacctcgaacataggagaaaagacgtcgggagatgcacaccctaagtgcgggaaagtcgaggtaccataccaccgtcaaccgttgcaatcgcaacgtttcacaatatgggtgatacccgaataaaaaagccggcagggggcatcggcaaacagcggtcgttagccacgcttcggccaccaagccgcatgcctacggatatgccacggtcgcccgcgcaaccatgccagcagcagaccgagcagcaacgtgaccaccgcggccgtggtcgcaatcgttcgcgcatccttcgccgcatcatgctccgccggcaccacgtcgggaatcggcgagcgcaccgcagaaaccaacagtcgatgcgtattaacgccgtacggcgtgcacgtcatcaacgtcacccggtcttcgccgggaacgattttcagcttcgacgtatcgctcggctcgattacggaaatgcggtccacctggtagccgagcgtgcggcccatcacttcgatgtagaagtagtcgccgacgcgcatttcatccaatcgggtgaacatcatcgcgtccacaagtccgcgatgcccggtgattacggcatgagtgtccttgccgcccaccggcagactactgccatacaaatgccccgcaccggacgcgagtgccgactgcgacgtgccatggtagatcggcagtttcacagaaattttcggaatgcggatagtgcccatcacaccgctgccggaatccaacaggctttgatattccgtatctttggcgctggcgctgtctgattcgttggaaccggattcgctggaccgcgaactgccctgcacctgggagaacgggtctttcgcttcgccgagaatcggctgccccgatgtggcaagccgttcgttgtattccttggccgctgcgattgcgtcgtccgcttgcggatacggccagcccgcaaccgcacgtgcggattggtccgacgtgttcgacagttcgtgtgccgaccggtattgcagcatcgtcgggaatccgccgatacagattgcgatgacgatcagcagtgccgcggagacacgcatggcgacggttttcctacgacggccacgccgtctgcgcatgtcgtcggaaacgtcgattatctcgttgaaagacggttctgcgccttccgtacgttccatgtttttcatacgtttcgcacgcatcactggatgaacttccgcagcacgcgttccagctcgtcgatacgcaacgcctgcttggctatcagcatgtcgcatttgttgatggtcagctgtgcctgtgcaagtttcgacagcatatcctgcgatgcgcgcgattcctgcaacttgtccgagccttgcgattgcacgccgttgcttcccgacgcgccaacgtttctcgtcgcgacgtcgcttcccgacgtccctgccgcgccagcgccataaagatccaccacggactgatccacatcgtctccgcgcagttcgatggcttccagctcgtcatcacaatcctgcatgtaatggttcgtatgttcgttcctgcgcttgttccgctcctcctgctgcttccagcgcgcgatgcaccgttccacgcgcttgtagccgatcagcttggggtcgagacccgcctcccgaaagatggccgacggcgattcgcccgcgttgtaccggcacatgacctcgaccttaaagcgatcggtataccggatatgggatgggctcacgcttttgaccgctggcaggctggccagatacgcacgctcctttgctgtgaatttgccatcaatcattttttacaccccctaaatcgcctaaacagctcgattcagcatcatatcgggctctttccattaacaccctcgttaaaaccctcgaacgaaagacccatccccttcaacgaaaagagggggccaaccttcaaacaaaacagtcccgccattttccacggataataaaagctcatagaccccccccccataaaattaacaaaaacttaacctcacccccagcgcgtcatgggggtcaccgcgtatccgagcaccgtcacgcagactcactaggctggaaacatgacgcaagagctcgtttcattaaccatcatcatggcggtggcggccgtcagcccaatcgtggcgcagctgatcccgggcaagttcattccgcaaaccgtgctgctgctcgccgccggaaccgcgctcggcccgtacggactaggcgtgatcgaagtaaacgacgccgtgaaactcttgaacgagctcggcatggcgttcctgttcctgctcgccggctacgaaatcgaccccaaacgactcgccggacatcaaggcaaagtcggactgcttacatggggaatcacgctaggcctcgcctggctggttgtgacattccttccgttcttcaccaagcaaggcatcaacggcgtggccacggtaatcgcactcaccaccaccgcgctcggcacgctcatgccgattctcaaggaacgcaacctcgaaggcacccccatcggcgacgccatcatctcgtacggaacgtggggcgaactcggcccaatccttgccatggctatcctgctatccacccgaaccggctggcaaaccatgctcgtgctcggcgcgttccttgccatctgcctactgtgcgcgatgctacctacgaaagcactgaaaaccggccatcgcctgtaccgtttccttacggaaaatgcgaacacgtcatcgcaaacgctcatgcgactgaccacattcctgctcatctttcttgtcaccatttccgcactgttcgaacttgacgcggtgctcggcgcgttcgccgcaggctttatcctgcgttacatcattcccgacggcagcaagtcgctggaaatgaagttggagggtgtcggctatggcttccttattcctgtgttttttgtggtgtcaggcgccgcgatcaacgtgcgcgccgtggcaggccggcctgcactgctcgtcgcattcatcgtcatgctcatgctgattcgcgcggtgcccgtatatgttgcgctatcgctcgataaacgcgagaatccgctgtcatcgcatcaccgcgtcaccgtagcgctgtattgcacgaccgcgctgccgatcatcgtcgccgtcacgtcactggcggtgaaggtcggtaccatgcaaggcgacaccgcgtcaacactggtcgcagccggcgcgattacagtgttcctgatgccactccttggctcgatcacatatcaggtggccgacgtgcatccggtcaccgcggttcgggagattgcacacacgccatccgattggcggacgatcgtacgcgaacatgcgcaggtgcgtgcgctgctgcaccatcaggaccggctcaagcgtatggcggagacgttggaatcgctggaaaagcaggaggggctgaacggtttggacagccgtcgcgccgaacttgtggaacgtgcgcgcctcgaaatcgaccgccaactcaaggaactcggcctggacccgcagctcaccacccaactcccccacagctaccgctacccgaagaactgagagggcttcggaggggcgctactccacggacttgagagagctgatggggtcgatgcggtcgaggacggggttgacgaacagctgcacgagcagcgcgaaggccatggtcgccacggccgcgatcacgtagctcagcggcttgacctccacctcgaaatacaacgagggcatgttgagcgccatcgtcagcatgccgccgacgagccggccgagcggcaggcccagtatcacacccatgacggtgaggatcatcatctcgcggttcacgtaatggtgcacttcgcggtcgaagaagccaagcaccttgagcgtggccatctcgcgcacgcgttccgacacgttcgtattggcgagcgtgaacagcaccaccagtgccagaccgccggcaagcgccacgatcagcgccaccaccgcgcccatgaggtcgaatttgaagctgtcggccatgtgcgcgcagcttacggccttcatcaccgaactgtcctcttcgagcgattccgcatagtcggtttgcgaagtgtcggagccggaaagcttggcgagcatggcgttccacgtcagagcctcggaatcctcggaactcttggaattcttggtgttcttcgcgtctttcgagtcgaaaagcttggcgtagtaggtttcgcttacatacacatccgagccgatgaggttgcgattcaccgcgctcaccttcgccgtcgcctgcacgccgtcgccgttggtcagtcgcaccttggaaccggccttgacgcccagcgcgcttgccgccgactgcgcgacgatcacgccatcgtcatcgagtttcagcgaaccggttttgccgacgccggacgtgcccagtatgccggacgagaccggctgcaacgtgaccatttcgcccaaatcggacagatgcttttccggcaccgcgaccagctggatgctttcgctgccgctgctgccggccttgccgctgtcaccgtcgccactgcccgcaaccgtcaaatcgcccgactctatgcgcacgtcaagcgatgacgtgacgcgcccgtctgacgcgactttcgtgcgcatcgccgacgcgtccgaatcgtcggaaaccaccatcaggtcgtactggtagatgtcgcggtattgcttgatgccgaggtctgcgacggtgtcgttgatggccaggccgcagacgatcagcgcggtgcagccggccacaccgccgaccgtcatgatgaggcgcgacttgaagcggaagatgttgcgcgcggtcactttgccgaggaagccgatgcgattccagaccggccgaatccgttccaacagaatgcgcgagccggcgcgcggcgctttcggacgcatcagcgcggcgggcgtcatgcgcatctcctgcacacacgcgtagatggtggcggcgagcacgccgaccacgaacagcgcgatgccgagcgagccgtacagccagtcgtattccagtcgcaggccgggcatcacatacatgccttgcaatacgaccagcaggaacgcaggaatgccaaggaagccggcgatcaggccgaggccgccgccgatgaggcaggcgagcaacgcgaacagcaggtagcgcgacgcgaccgccagccgcccgtagccgagccccacgtacgtgccgatgagcgagcggtcctcttcgaccatgcgcgccatggcggtcaggctcatcatcacggccaccagcaggaacacaatcgggaacgcgttgccaagcgattggatggagtcgaggtcggatttgagcgcgctgaacccgccgagcgactgccggtcctgcacataccagcgcacttgcggaatgctggttttcagctcgttttccttggttttcagcgtttgttcggtacttgccttctgctcgttcaattgcgattgcgcctggtcgagctgctgcttggcttgcgtcagttcgggactagcggcgatgatggtttcacgcattgtttcacgcgtggtttcgtcaagttggggggtagttgcacctgcggccgccgccgcacctgcgttcgcgccgtttgccgcagctcccgcagctgccgcgcccgcctgcatgctgacaatctggtcgacctgctggttgaattgctgccgattcgcgtcgatttgcgactgcgcgtccgcgaacttcttgtcggcttccgcacgcgcgtcgacgatcttcttgttgcccgcgtcgagcagttcctgccgacgggcattctggcggtcggttttcacggtgccgtcgatgcggtcggtcacctgcttgacagtgttttcgtacgattcgtcgaacgtgctttcggcggccgcacccttgacgagcagcgtggcggacgtgtagagggtgccggtcacgccatcggacggcgcgaagaacgtgtagtcggtggtggcggtggaacggaacgaggtcatggcggagtagccgtccgggttgctcaggttctgcggatcgagcaccacgcccacaatggtgagcttggtcgggaagctcggcgcctcgtccgtgccgttcgtttcattcgtaccgtccgcaccgttcgtatcggaagtatcggaggaagccgattcgggggttacggtgaggcggctgccgatacgcttgcccgaatcgcgaataaatttcctggttaccgcgatttcgccggctttcttcggcatgcgcccttcctgcaagtatggctggtcaatgccgttcgtgccgatttcctgcatggtcgccgacttgcggccgtccaaatcgaacgtcacttcctgcgaccgttccgcctgcactttcgcaacaccgttcaccttgcgcaacgcggcgatatcgccattcgacaggcccgcagtggacagcacctggacgtcgtgcaggccctgcgcgtcgaaaaagcgatcggtgctgcggaacgcgtcacggcagcccgcgtaaatgccggtgagcacggccacaccgagcaacgtgatcatggcgatggaaatgaatcttttccacgaatgcgcccacattcgcagcatgtccttgacgaatgccatgtcgacctccgttcgtagcccctcattccattgaacaccatgaagcttggaaagacgcgccaaaccgcacatccgcaacacgtgtccaaatcgcgcgttcgaatcgcacagcaatcgcgcgaatcgaacttctaaaccaaacaacccgttaagcaaaccagacattccggaacgaacaaaccaacactttgcccgccgcttcccgctacaatcgggaacgttccctcacaaagggcgaatcgcaaaaaagcaagcaaaacaagcacatgcaagcgtgcaacagcacgcaacgcaagcagcgagcgcaacgcacaacgcgcaatcgcaaggaaacagagaagaggaaatctccatgagcgacgtcaccgccgcaaagaagccgcgtggaaccgacgatgtaccggttccgccgacgctccgtaaatcgttgaaaaaccgccatatccagctcatcgcgctaggtggcgccatcggcaccggcctgttctacggctccagcgaatccatccagctggccggcccgtccattctgctcgcctacctcgtcggcggtctcgcgatcttcatgatcgtgcgcgctctgagcgaaatggcggtcgaggatccgaaggctggcgcgttcagctactacgcgacgcgctactggtcacggcgagcgggcttcatttccggctggaactactggttcaactacgtgctggtggccatggtggagcttgccgtggtcggctcgttcgtgaactactggttcccgaacattccgaagtgggtgtcggcggcggtgttcctcgtggccatcgcggcgctgaatctcatgggcgtgaacaagttcggcgaattcgaattctggttcgccatcatcaagatcgtggccgtgctggccatgattctcggcggcctgtatgtcgtgatcgccaacgtgccgaccgcgtcgggcattcgcgcgagcttcgccaactggttcaccgtggacggcggattcttgccgcacggcctgatgacccgcaacgccgacggcacgtggaccggcctgctgatggcgctcgtcgtggtgatgttcagcttcggcggcaccgaactcatcggcatcaccgccggcgaaaccgagaatccgcgcaccaccattccgaaggccacgaacggcatcatctggcgtattctcgtcttctacatctgcgcgctcggcgtaatcatggcggtgattccgtggagcaagatcgacggcgattccagcccgttcgtgcagatcttcgattccgtcggcgtgcacgcggccgccggcatccttaatttcgtgtgcctgaccgctgtgatgagcgtctacaattccggcctgtacgccaactcccgcatgctgtattcgctggcaaagcagggcaacgcgccggcttacctgggtaagctcagcaagaaaggcgtgccggtcgggggtgttatcacttccgcgataattattgcgattgccgttgtcgtcgtgttcgtatggccggaattcgcgttcaattacctgatgtcgatcgccacgatcgcggctgcgatcaactggatcatgattatgatcacggagatcaagttccgtcgcatggttgcggctggcgatggcccggccgaacttaaggggctgaagggcaaggaagcgctcgacaagatcgcgttcaagctgccgttcgccaatgtgacgccgtacgtggtgatcgcgttcatgctgctggtcgtagtgctcatgtgcttctccgcaagctaccgcatcgccgtgatcgccggcgtcatctggctggcggtgctgttcgccgcgtaccagctcacgcaggtcggccgcaagcaggcggacgcgtccgccgcggacgccgaatgaccgcgcttccttacgcacttccttacacgattccttaaaggaacggcaaaaggaacgacaagccccacgcgggaagcgtccataagcaacataaaacggccttcccgtccgtatggaaatcaccggatcaatcgatccgcggtgacaacatacggacgggaaggccgttttttacgccggctgatggaggctcagccctgcttcttggccgccggtgcgatggacagactcgggtcgcgcagcggaatcatcatggactgcgtcgcgtggtacaggtcggacttgcccggccacacggtgccgatcggctggttggtgcggtcgagctggtggaaccaggatccgttgacgtgatccatcaccgtgctgtccgcgtactcgaggaacgtcgcataccacttggcgtacgattccttgccggtcacgcgggcgagcgtggaggacgtgttgatgccctcggccagcgtccaatgcatacggtcgtgcacgacgggcttgccgtcccagtcggtggtgtatacgaggccgggcgcaccgtccgcgttccacgcatcctcgaccgcacggttgaacagatgctccgcggcgtcgatgtacggggccgcggccgccggatcggacggataggtgctggtggcccactgggtgatcaggcgggcccattcgatgccgtggcccggagtcgcgccgtacggcttgaactggtcgtccggcttctcgcggttgcattcgaggtcgagcgaccagtcggaatggaagtgttcggggatgcgccagttgttggccttcgcccagccgagcacgtgctcgatgatgcggcccgcgcgcttgcgccaggtctcgtcgccggtcacgtcggccacggcgaggaacgcctcgacggaatgcatgttggcgttgaggccgcggtacgggtcgagttcggtgaattcggtgttccacgtgtcgacggacaggccggtctcgtcgtcccagaacttgtcgaggaagaccttttcggcatggtcgagcagttcggcggcaccggggcgaccgagcagggtcgcggacgatgaggccagcagcacgaaagcgtgtgcatagcactgcttggtgggcgtgtagccgccttcgggggtgatttccggataccagccatcgttgacgtcgtcatgcagcgcgcccttgagacccttcagaccggcgtcgaccagctcctcggcacccgggaaaccgacgaatgcgcccaggcagtacacgtgggtcatgcggcaggtgatccaagtggcgcgattgcggtccttccatggggtgccgtcgtcgcccagccagtaggagctgccgtcgggagccgggaacttcgtgccgaagttcagcagattgtcgcgggccgcgtcgaggaacgccttgttttccgccgttcccagctgatattttttgtctttgacagccatgtcaaatcctttcctgatttcctgcgatcgcgcacttggttttcacgcaacgcacgttccggcgcgccgatgagcgacgcgccgcatgtgcatgcgccccttgcgttcgcaccttgttcggttatgcgctcgggaaacttcgtcatattccctcgccgctgtgccctactgtagtgattaagcgcttaagctgcaagtgggacacgccatccgcgccgtcaagtccttcatccgcgcctccggcatcgacgacgattgccgtctcaaccggcgcggatggccgcgggaatccgggaatcagtacagcggcggaagggtattggccatacggatgaaaggatgcttggtgaaacggcggaaatcagccgcataacgcgacccctccaccggagtgccgtatgcgccggttccagcggcgcccggatcgttgcgccacggcatgtaccacagcacccgacgcgtatcgctgttggcgagcgcggcggtgagcaggtagcgcgtccacggcgaatcggattcggacggcgcagctgtctgggctgttccggagccgacagcattcgattcgccatgggcagcgcaaccatcatccgcggcactggcacaagcgccggcgccggccagcgcggcttcgtcttccgcgctcatcacgtaccgcgacgcgaattcgccaggcgagcccacttcggtggcggcggcgatcttgccgcgttcacgggcgagccgcccgaccaccgtcagcatgatgatcagatcgtcgtgccgttcacgcggccgctctgcctcgacgtcggcgggcgcgatgtcccagtagtcgtcgaatccgagtacgtccacatagtcatcgcccgggtaggcgtagagatacccggcctcgcatgtgctttccgagctcatgtcgatacggctacggtcgggcgagtaggcgtagagcacgttgtgtaggccgcacgagtcgcgcaggtagtccacggtcatgcgccacagggcgacgaattgttccggcgtggtgtcggtgggttgcgcgggtgacccggtgcaccaccagaaccagtcgccggtgtgctcgtggaacgggcggaatacgatcggcacggattcgccgctgacgccgtccaccaccgagtccaggaacgaggccacgcggtccagccattcgaggaactgcccgtgccgtgcgccgccgggcagcacagccgccacggaaccgggcgccatattgtgcccgtacccgccgaaggtgatcggattggcggaatgccagctcatggtcgtcaccgcgcccatggtgtaggcgcgcagcagttcgtcgcggacgtcgcccatggagaagccgtcgatattggtggtttcgtcgcgttccacgccgctcaggtcgctgccccacagcgcggggtaggtgccggtgaccgcgtgtacgtcggaatcggtgttcggaccgatcacgttgctggtttcgttctggtggccgaacatggcgaatttgccgcttgcctggtgcaaggatcggaacaacgtacgggtcagcgtgttcaggtgcgggtcgaccggctgcggatcgacggaccgcaagttttccccgcccatcgtttccccgctcatcacagcgcctcgaattcaaggatcacggtctgcataggacgcagcggcgtgaccttcagcgtcatcgcatccagctgggccagactggtctcatcgccggaaatgccgaaatcacggccccaatattcgacttgcggcatctcgttttccggcgtcttcagcacgacgcagacgccatcgcggcgcagcacgacatgtggtccctgatcaaacatcattgtctccttgggctgtttcaagcggttaccacggcaaaggactcgacctcgccatgagcgcaattgacttttacggaaaaccagtatatattaagcgcttaagtggagcaaatggcggcaagccatcacaggcaccgcagcaacgaggcatcgcagcgacgcagggaggcggaagcaggcatggaatcgtccacaccatacaaaggcggcgaaatcgacagccggcaggccgaagccatcgacacactctcctcggccaacgaataccaaggccaatcacgcatccaaacactgcggaaactgccatggaaccgcaaatggaagtacttccgcgaccagttgctggcacgcaccgtggttatcgcggccatcgtctgcgtggtcgtatacatcgccgtgcagatcctcgcacccgcaccagggccgaaactgtacgtggcggtgttcgacgatgccgtcggccagcagggggcagcaagcctgcagtcgcaggtcgcgaaacggctggacctgccggaaggccgcaagggcggagtgctcgtcgacacctatttttccaacgacgagaacgacatcagcaagctgcagaccatgatcgccaatcatgagatagacgcgatcgtggccacgccgaagaccttcaagcagctgtccggctacggctatctgaccaatctcgattcgtcgctgaccaagcggcagcgcacgttgctttccggcgatttcgtcacgatgaagggcttcaaggattccgacgatcccgatttcgaaggcggcggcaaaggcaaggccgagccgttcggtctttcgatgaccgacttccggcagtggaaccggctgaaatcagccaagtccaacgcactcatcggcatcgtgcgggaatcgccgaatcccacaaccgcgcaacggctcatcgactatctcagcgcatagcggttccggcaaccgcctgcacagcaccacaaaaaccacccacggaggagaccatggccagcattttcagtcaggacaatccattcaacgacttcatgagcaccgtcggcgatatggcgatgatcagcatcgcctggaccatctgctccattcccgttgtgacggtcggcgcttcgaccgcggcggcctgcgaagtggcgcgcgaactgcaaagcggctcctgcaagggcatcttccgcagcttctgggcggctttcaagcgccgcttcccgaccacgcttgccctgacggcggtaatcgccgcgttctgcggattggcgctgttcgacctgtggtacctgtcgagacaatccaccgacaccgtagccgtcctttatggcgtaaccatcgtggtcatcgcggtcgtcggctcggcgctggctttcgtgctgcctttgaccggccgcagcaagctgagcgtcggcgagcagctcacgcaatccgcccggctcgccctgggcaagccacatatcgccttcgccgcgcttctgctgaacatctggccgatcatcgtggtgctgatcgcgccggagcagacgctgatgctggtgccgctgctgtggatattcgtcggcgccggagccagcttctgggtgcagatgaatctaatccgcaagaccttctcgctcgactagattccgtccgaatcccgcgaatccgcccaaaatccttcacgcaacgcgaaaacacacgaaaacgccgcacggccatatggccatgcggcgttttcgcttcatggttccacgccatcgcgcgatcaacgcgcaatcaccacgcgttcatcgcccagcgggagcgggaccagtggattcgcgcgcacgccgctcgtacggctcctccatgatatggccgaccttctcaccgtcgatgagcctgagcatcagccgtgcggccgtcttgccggtgtccaccacgttgcggcccatggccgtcagattcggataggccgcggtgcacatgaaggaatcgtcccaagacatgagcgacaattcgtcaggcacggcgatgcctttcacgttggccacgccaagaccggccaacgccatcacgtcattgtcgtagatgatggcggtcggacgctctccgaaacccagcaggcgattggtggcctcacgtccggattcaggcgtgtagtcggtatgcaggcagcggtaccgtatgcccaattcggcggccacgtcggagaacgcggcgtcacggatatacgagtgggccaacgcctcaggaccgcccacacgcgcgatatgccgatggccgaggtcatacagatactgcaccgcctgacgcacagcgtcggcgtcggcgctggacaggctcggcaggttgccggccacggaagcgtcggaaatcgcaaggaccggcacatccgggttcttctcaagcagggagacgcacgggtcgccaagctccacgttgaccagcagcagtccatcgacgttgccggtggcgatccaatccttgatgatcgccagtttggcgtcctcgccgacggccatacggaccagaatggaataatcatgcttttccagctcggcacccaagccggagatcagctccatcatgaaagattcgacggacagcagctcgggatcgtaatccagcaccaagccgatgcgctgcgtcttcgccttggccagcgcctgggccgcgccgttcggcttccagcccaattcatgggccacctgcagcaccttggcacgggttccctcggagactccgggtttgccgttgagggcatacgagacggcgctgctggaaacgcctgacgccttggcgacatcgaaaatcgtcaccttgtttttttgaactggcatacccacatcttctctttgctgaaatcgaacttaaacggttcacctacatcatacagcaaaggcgccaccgacccccgcaggaagccagtgcttacggcactttgcttcgtagggtcggcggcgccttcacttaatttttcacttaagcggaactgtcatgctgaaatgttcagcggaatgccctcctcatccatcgttccggagggcattccccggacagcggccaagacgtcaccactcgcgtttgagatcgttggcactgcgcagcacgttggccgctgcgaacgcggccggatcggagaccgcgtcggtggcgatgtgcagcgtgacgctctcgccggccagcagggagaccatgccttcggtgacggacgccttggcatcgaccttgtcgaccatgcagaacaggtcgcgcacgtagcttctggcggtaaccgtaagctccacgccgccttcaacggccttggcggaggtttcgaacgcgtcggcgggagcggcgagcttctggtcgatgatctcggccgggttgaagaccacgcgggcgaaggcgttgtcggacggggtggccacgaccagctcattgccggcgtccccataggagacgatgtcctcgttgagcggcagtccgatatgggaaaccgcgcctagctcgacgtcatcgaagctttgggaagcgagcacctcgccggacaggttcacgcgctcgaccttccaggagcccttccacgccttgcgggtgtcgttgagcacgatcagctcgaagtggtcgttggcggtcttcacgccttcccagctgtgggtctcacggtattcctcggagacgcgcggctggatggtggccaggtgcggcgcgaagaagtcgcgggacgcataccagaccggcttgcggtgtccgttgaaatcgaccgcggcccaggagacgaccggccagtcgtcgttcagctgccaaatcagcgcgccggcgttcaccggctcgagggagcgcatgtgctccacgccgaagcgcatggcctgcgcctgctgcagctggcatgcccagtgccagtcctcgatatcggcccagttgtcggtggggatcagccagctgtgctcgccgtcggacggcttgccgttgaccacgccgccgaaactcacgtcgtcgaggtggccgggggtgatgtgcgagcgcatgccgcgcgccagtttgtagttgccgccagaggccttctgatgcaccagcatctgcttgccgaacggttccagcttgccgtcgtgcacggcaccggtgagggtgctccatgccggcggagcctggtagccgaattcgtcggcgaagcgcggggtgtactgcgcgtacacggtgtagtcggcgcggttccaagcatcccagatgtgcatggtgccgtcggtgtcgaggttggcgcccgtgaacttggtgaagctcatcggggagctcggcaggtaggcggagcggctcggatcgagttcggccaacagggacgggaacagttcggaatagtagtagtcgccccacggcttctcgccgtatccgtatgcgttcggcttgcggtcgtcgtcgcgcagggcctgcttgtaaccgccccactcggagtaggccacgtagttctcgttggagccgttccacacgatgaggctggcatgttcggacaggcgggtgatgtgctcgcgggcctcggcctcgacttcggccttggtttcggcgtcctccggataggcggcgcaggccagcatgaagtcctgccacaccatgatgccgtactcgtcgcacaggtcgtagaactcgtcggactcgtagatgccgccgccccaggcgcgcaccatattggagttggattccacaagatcgcggatgccgcgctcgtagtcgcgctgggagacacgggagatgaaggcgtcgtcgggaatccagttgtagccgtgcgcgtgcaccggcacgtcgttgacgtagatctggaacggacggccgatgttgtcggcacgggtgtccacatgcacggtacggaagccgacatggccgttccagaacgcttccttggcatcaccggcggtgacgtcgacatcgtacaacggttggtcgccgtagccgacgggccaccacagcttcgcttccggcacggcgatcgtcagcacggcctcgttgcggccttcggccacgacgccatcgacggacagattcgtgccgaagccggagatttcggcgtgcaccggcacggcctgacggaccggatgggaatcgtacggggacatgacgcgtcctttgccggcgcgttcgatttcgacgtgcacgttgagcagtccggtgccgtcggcggtgacgtcgaccagcggacggacggatgcgatgcgtacgccggaccaggagtcgatgccgatctcacgccagatgccggcgttggccacgtcgatgccccaatcccagccgaaggaatagctcggcttgcggatctggttgaaggcgtggtgttcggtgtgcggatagtagccacgggcctgttccatgtggtcggattcacgcacgggggatgtgaaggtgacggtcagttcgttggcgccgtctctgagcagaccgcgcacatcccaacggtaggaacggtggaagttgcgggtggaggcgaccgggcggccgttcaatgcgatgtcggcgatggtgtcgaggccgtaggccaccaggtcgtgacggtcggagccgtcatcctgccaatcgaaacggcaggtgaatcgccaatcgacatcgccgatccactgctgcttgttctcgttgtcgccgtcgaacgggtcgtcgatcagaccggcgttgagcaggtcaagcgtggcctctcccggcacagtggccggaatgcccgcggcgagcgtcgcgcgcagtgcctcaggagcggcttccgggttgacggcggtcaacgtccagccctcgttcagaggagcaaacgtgctggggatgtgagacatggtgaatccttctaacaaatattctggaaagaaaagggccgcaccgcgatatgaatcttggcgcggcccttggttgtggaaaaaggaagttggaggttacgttttttattccttcacggagccggctgcgatgccgctgtagatctgcttctggaagatcaggaacaggatcagcatcggcagcagcgtgatgatcacgccggcgcagatcaggttgtacttgctgcccatcgggccggtgaaggagtacagcgcgatggcgatggtcttcagattcgcgtcctgcaggtaaaggttggcggcgtagtactcgttgtacacaccgacgcccttcaggatggcgcaggtcacgatcgccggcttcagcagcggcagcaggatcttgtagtagacggtgaagtaggaggcgccgtccatgatggcggcctcatccagggaggtcgagatgttctcgaagaactggatgaacacgtagatggagatcacgtcggtgccgcacatcatcacaatgtagccccacatcgtgttgacggcgtggaagttgaccatcatcttgtacagcgcgacttgcatggcgatgcccggaagcagtgccgcaagggcgaacatgccacggatcaggccgttgccggggaactggaagcggctcagcacgtaggccagcatggtgccgatgatcgtggtgaccaccaggaccaccaccaccacgatgatggagttgcggaaggcgaccgccatgttcgacgcgacgaacgcctgcacgtagttgtcgaagttgaaccagttcttcggcatgtccatgacggacgtgctctggtattccttgtccgtcttggctgcggtcacgaagcagctgaccagcggcagcagcatcatgaaagcgacgaagatcagagagaaatacttgaggaatacggccaccccgatcttgaacttgtaccagaagcccgcggtcttggctgcggaacgttccttagcgagtgcgactgcgtcagtcatcatgccaccgccttttccttgttgctcggtccgttcttgaagaccgaagcgttcttcctggccatgcgggcgcgctggcgctcgatcttggccgcctgcttccttgccttctccacgccgtcatcggcatccttgaacacgtacttgaagaacaggttctgcaacagcgcgcagatgaggatgatgatcagcaggacgattgccatggcggatgccaagccgaccttctggctggtgtgggcgagacggtccatgcgcacgaagtaggtggcggtgccgttggcgccggaggtgatgacgtacgggccttcgaaggcggacagcgagccggtgatcgaaaggatgacgttcagcaccaggatggtcttgatgcccggcaggatgatgtgcttgaactgctgccacttgttggcgccgtcgatttcggccgcctcgtacagcgtcgaatcgatcgacatcatggcgccgatgaacaggatcacgttctggccgagataacgccagacagaggcgcccaccagagaccagttgttaacgctttggtctttcagccagtatggcaggttgtcgagttggaatccgcaccattggagcacggtgtcgaacacgtatccgcgggtgtagaagaacttgaagatgaagccgaccgcgatgccgttgatcagatacgggaagaagtagatggccttgaacgcgctgccgccacggaccttgaacgccagcatggtggacagatacagcgccagcgccacctggatcagcgcgccgaccatgtagtagaggctcagcttcagggaggaaagcgtgtcgggacgggtgaagacgtcgatgtagttctggaggccgacgaattggcgcgggccgatgtacttcatcttgtagaacgagtagccgatcatggatccgaatggccagtaagtgaagattacgagcagtgcgaccggaatcgcggaaaaggcgacgatgacgcccgccttacgccaatctcggggctgcttgttgaatggaatctcggccttctcggtcggttccactgctgctgcagtcatgatatccccctctttgggttgcttctctgcctaacgaaaaattgcgatggaagaggacttcggcttggttccgccgagaacgagccgaagtcctcagtgatggatgcgcgacttcacgccgtcacgcctggcgttccggaatcacttggtgtcgacgccttcggaatcaagggcgtcgttccacttctggttccactccttgacgaggtcgttgtaggactcgtctttattggccgcgtgctcgacgatgctctggacacgggagtcgccgccggtgttgatgttgagttcggaatcggagttgaggtcgttgaacagatcctcctcgccgtcaggagccggttcgtcggcgatgagcttgacgttcttgaagtcggagtagaggtccggcagcttgtcgtcgtcggccgcgatcgagacgccgccttcgttgtaggcgtagttggacttctcggtcagccacttgacgaagatcatggccgcttcctggttggtggtggaggagttcttgttgatgccgtacgcgtagtcagaagcggaggtggcgtactgcttgcccttgacggagatcgggaacggcatgtagccgacgtccttggcgttgtcgcctgcggactggatctgggagaccgcccaggagccgagcaccatggtggcgatgtcgccgctgttcagcttgttcttggaagtttcccaatcggtggtggagtaatcgtcctcggtcaggccatcggccacggcgtcatacaggatcttgtagacgttgtaggcgtgggtgccgtcacccggatccttgaacgggttcttggtgtgggtgaagacgttgttcatgtagttgggatcgccggtggccgtgccgccgatgtacgcgtcccaggcgcccatggtccaaccagccgcgtagttggtgtacagcggagtggccttggtcttctccttgatggccttcaggtcggagatgaattccttcggggtggtcggcagcttgtcgatgccggcctccttgaagatcctcttgttgtagacgatgccggaggcgttgccgaccgaagccacgccgtagaccttcttctggtaggactggttgacagcgtacttgatctccttgttcatgtctccgagggagccgtaggagatgaagtagttctgcagttcggccctgtcgaccgccggaatcatcatgatgtcgccccagtcaccgccctgcagacgggtcatggcgctgttggcatagtcgctgttggcttcgacggtgaccttgatgttcggataggtcttgttgaattcggcgatgtactgcttccaggtcgttcccggatagtcgttcttgagcatatcggtacgatggctgaacagcttcagattggccttgatgtccttgccggtctgaccaagcttgatgtccttgtactgtatgtcggtgaccttggaggagccactgccgctgccaccgcaggccgccatgctcaccgcgcagacagccgcgatgccggctgcgacgatcttcttgagattcatcttccgatccttccttgtgaatccttgtccatcacttccggagtctcggcaccgatgctccattggtgatgcctttttcatctcaggcctctctgcctgcctttgatgaactggtagttataccataaatgaaccccttaagtttgtcaagcgcttaagttgcgctccgcgccctcgccgcacagccgcagtgccgtcgcaaccctatggtcaacccgcttcaaatacagaaaacaccaatcgtttcaatacatcgaagcggtttgatgtccatcccccacaacccgcgaccgttcacgttaagagggttaatgtaaatttttttaccggagtgtcgttaagcgcttaagtatacgtatgcaaaatcctgcagcagcgaaaaacggcggaatcgcaacgaaaacggcgtgccacgccatgaatggacgcggcacgccgttcatggaacaacgcgcgacggcgatcgccggacgctcagcccttgcgggaagccaggaaatcgcggtaccacatgaagctgtccttcgggatgcgctcctgcgtggcgtagtcgacgtatgtgatgccgaatcgcttggcatagccgaaataccattcgaaattgtcaagcagcgaccacacgaaatagccggtcagcggcacgccttcgtcaatggcgcgcttcgccgcggcgaaatgacgcttgagatagtcgatgcggtccggatcatgcaccgatttcgtgccgtcctcgttcaccgtcagctggtccttgcaggccatgccgttctcggtgaccaccagatcgacctccggatagttgtcgtgcacgcgcaccagcaggtcatgcaggccgtccggatcgatgttccagcccatgtcggtgtgcgggccctcggtgggcagccagtccacgtcggacgctccaggggcggtggacgcctcggtgctttgcgggaactgcggacggtcggacatggccacccggttggtggaatagtagttgatgcccaacacgtcgatcggctggtggatgagctcgaggtctccggactggatgaagtcccagtcgcagatgcccttggtgatggagaacagttcgtccgggtaacggccgcgcagcatcgggtcgaggaaagcgcggttggagatcaggtcgaggcgatggcaggcgtcggcgtcgccacggttgaactgcagattcaacgtgaccgaacacttggccttgtcccccacttcggcgcggacggcctgcgtcatcagaccatgcgccagattcaggtggtggaccgccgggaaggcgccgggaccgaggcccaggcccggcgcgtgctccttggctccgtagctcaggtaggacgaacaccacggctcgttcagcgtggtccaggtgtcgacgcggtcgccgaggcgcttggccacgatacccgcgtagtcggcgagcgcataggcggttctgcggttcagccagccgccctcgtcgccgaggtattgcggcaaatcccagtggtacagcgtcacgaccggcttgatgccggcctccagcagggcgtccacgacgccttcgtagaagtcgaggcctttttcgttgggcacgccatcaggcgtcgatatgatgcggggcacggcgatcgagaagcggtaggcgtccacgccgaggtccttgagcagcgcgaggtcctcgcgccaacgatggtaggaatcggtggccacatcgccggtgtcgccggcgatggtggctcccggcgtatggctgaaggtgtcccagatggaggggcaacggccatcctcggtcaccgcgccttcgatctgataggccgctgtggccgtgccgaatgtgaaatcttgtggaaaagttagcgtcattgcgtgtcctttactgaagcggttaagatattgatgaggttaaccgatgtcatagattgtttgcaaacgacacgccccgttccgcggagcgggagacaccatcgattcgttccaaggaagggccatgaacaccaccacccaagcatcgcgattcattccaatcaccaatccggaccttcggttcatggggcgcatcgaccgcacccccgccgaccatcagacctgggcgttcccctacacgcaggtatcgttccgttgcaccggcaccagcatcggcgtgcgcctcgtcaaccattgggggtacggcgacgcgtatctcggcgccatcatcgacggcatgcaggtcaaggcgcgcgtgcccatcgacggcgcgcatgacggcatcagcatggaaaacggctatccaagccgcatggaaccgaccggacagcaggacgacggaccgcgccatccggtcgacgtggcaatcgccgccgatctgccgaacatcgaacatgaagtgacgatctttaaacggcaggacgagggcaacaatcgttttgacgtgtatggcattctgctggacgagggagcgaagctcatgccgacggcgacgccgctgccggagcgccgcatcgaagtgtacggcgattccgtaacgtgcggcgagcgctgcgaagcggcctgctacgtgggacaggccgatccggaggtggatctgagcccgtacagcaacgcttggtattcgtacgccgccatcaccgcacgcaatctcggcgcgcaggcgcacttggtctcgcagggcggcacgaccctgctggacggcatcggctggttccacgcgccggactacatcggcatggaaagcatctgggacaaatccgtctacaacacgcagctgggcggcacgtccccttgggatttcgcgcaatacacgccgcatgtcgtcgtggtcgcgctgggtcagaacgatgcgcatccccgcgatttcatggcggacgactatgacggcgaggaagccacgcattggcgggcccggtacgtcgatttcgtgcacgcgctgcgcggaaaatatccgcatgcgctgatcgtgctcgccaccaccgtgctcatccacgacccgtcctgggatcgcgcgatcgacgaggtgtgccatacggtcaacgacgaaggcgacgaccgcgtacgcactttcctgtactcgcgcaacgcggcggccacacccggccatccgcgcgtggcggaacagcaggcaatggccgacgagctgaccgcgtatctggagtccttcggccccgatctgtggaagtgacctcgaggcggccctcatagcggcctcggaacgactccaacaaccacaacaaccccatagcgaaaccggccgcccctcgaatcgaagggacggccggttttccatatcgtcactcggttatcatcacctggtggcgtcacgccacggcatcactcaccgtcgtcattcgacgccgtgtgatccgtcagattaagccggaacggctgggcgggcaatccatcgctgttgaacagcggagccggcccccagctgcgccatgcgtaccgcatcgacatcggttccggcacatccggacatgccagcgtgatcgtgccgatgctgcggctgttgacgggaatgccgaattcggtggcgttgtaatcgaccacgttcaccttggaattgacgaggtcgtcgatatcgcaatccacgaaaatcgccgcggtggccggatggaacacgccgtccgcgcccgcaagctcgaaaccggagctctccggcgaacgcaccagcgaaggcggctccgcatcggagccctgattcctgctgccgggcgtggtgccgtcgaaatgcaggccgtgcgcgtaacggaagaacagccgtacgcggccgttcggatcgcaacggaagcccaacaccgtcggcccgtacacgggaatgcgggacatgccgtaaacctgcttcaacgcgcaatcggcgagccgttcgcccggagtgcgcttgtcgacgggatggatgttgtcgtactcgccacaatcgatggtgcagatgacgtacacgttgtcgatggactgcgccgcgtcccattgggcctcgcgcagcaccggccacagcatcggatcgccttcggtctcgtccaccttcttgtcgatccattgcggaagctgcacgatgaggaacggcaggttctcgctccagatggcgcgccactcgccgatcagcatgcccagcagctcacggtaggacccacaatacggttcgtcctcctcgccttggtaccacaggaaaccagccagcgagtatggcgcgatgcgttccagcatggcgcggaacggtccggtcggacggtactgcgacgtcggcgtgaccggcggcggccacgggcatgcgccgtactgttcgttcagcgtatcccacgtcacgtcgggatcggcttccttggcggccgcgatattcgcgttccaagcatcgaatctcgtctgccattcgtcggtttccagcttgaactgctcctgcgtcttgccggcgatcgcacgctcgtaccgggtgagatagccacgtcctgcctcgctggaattcaacgcgtcctcgctcatccagcacgtgatcgacgtgccgccgatatagcagttcacgatgccgatcggcagatcggggtcgagttcggagcgcagcttgtgcgcgaaataataggcgacggcgctcatcacaccgctgttttccggcgatgattcctgccagctcgccgcgttctccgcattgcggttgatgacgccggttttcggcacgttgtagaaacgcagcagcggatcggcgcaattctcaagggccgcttcggcgttctcgctgttgcgcagctcaagttccatattgctttggccgccggcaagccacacctcgccgatcagcacgtcctcgaattcgaggaaatcgttgcccgcggtgacgcggagcgtgtacggaccgccctccggctgcgcgggaagcatcacgcgccacggcgaaagaccgtccttgagatccttcgaagcgtacgcgtgggcctgcgcgaccatcgacccgtcgaaatcgcgaatctgcgcgacgacttccatacctgcgcaatcggcatccaacgcaccgaacacggcgttggacttgttgcgctgcaataccatatgcgaggcgaaaatcgccgccacatgcaacacaccggccgagctacgttcctcgacctcatcggcttccgcagtcagttcagatcccggcgcgggaccagtcacagcaaccatggcatctcttcctactagaaatacgacatgcctatcctatgccattcccggccgaggatacgcgaatccatcatccagtgagcagtggattttttacggtttctcggctcactttgtggactggatacgtaccaaaacggccgctccggtaggatggaccccagtttgcaggacaaaatccatgcacgaaaccacgaatttcatctgcgaatggtagaaacccgaacgctttccaagcgttcaccccactacacaaaaggagtgccaagtacaatggctgcacaaatctggtatgagaacgacggcgatctctcggtcctcgaaggcaagaaggttgccatcatcggttacggttcccagggccacgcccatgcgctgaacctgcgcgattccggcgtcgacgtcgtcgtcggcctgcgcccgacctccaagtctgtcgagcacgccaaggagcagggtctggaagtcaagtccgttccggaagccgccgccgaggccgacatcatcatgattctggctcccgatcagtaccagcgcaccatctgggccaacgacatcgaaccgaacatcaagccgggcgccgccgtcgccttcgctcatggcttcaacatccactacggctacatcaagccgaccgaggaccacccggtcttcatggtcgccccgaagggcccgggccacatcgtgcgtcgtgagtacgccaacggccgtggcgtcccggtcgtcgtggctgtcgaacaggatccggatggcaagacctggccgctgtccctggcttacgccaaggctctgggcgcgctgcgtgcaggcgccatcaagaccaccttcaccgaggagaccgagaccgatctgttcggcgagcagaacgtgctcatgggcggcgtgaacaagctcgttgaaatgggcttcgaggtcctcactgacgctggctaccagccggagatcgcttacttcgaggtctgccacgagctgaagatgctcgtcgacctcatgaacgagggtggcctgaacaaggcccgttggtcctgctccgacaccgctcagtacggcgactacaccaacaccgtcatcaacgaagactgccgcaagcgcatgcagtaccatctgagccgcatccaggacggctccttcgccaaggagttcatcgacgatcaggacgctggcgctccgaagttcaagcagctgcaggaagaatatggcaacgtgcgcatcgagaccgtcggtccgaagctgcgcgccatgttctcttggaacaacggcaaggatgacgacgctgacatggccactttcaccggcaagatcgcccgtggctgagtaacgtctcgcattcattgcgattaatcgcattaactgcgattgaaggccgccgcccaagttgggtggcggcctttcgttatgccggaacgtacgcaaccgtcgcacgcacgacaatatgcaaaaagcgccgtccgcacgaagcgggcgacgctttctaattcgctaaatagcttatgcagctagcgaagcaatctcactgaacctgggtacgagcgatcttgccgttgaaggactcggccatatcggcatcggcgtccacctggttgttccaggagaacatggcgcgcagcttcgggccaacggtctccaggtgcgggtggctgtactcttcctgcagcttcttgaacttcggagcgccagcggcctggtcatccatgaactccttggcgaaggagccgtcctggatgcgcttgagctggtactgcatgcgcttcttggtctcctcggtgatgaccgtggaggtgtagtcgccgtactgggcggtgtcggagcaggaccaacgagccttgttcaggccaccctcgttggccaggtcgaccagcatcttcagctcgtggaacacctcgaagtaggcgatctccggctggtagccagcctcggtcagcacatcgaagcccatatcgcacaggtggttgatgccacccatgaggacgtcctgctcgccgaacagatcggtctcggtctcctcggtgaaggtggtcttgatggcgcctgcacgcagcgcgcccagagccttggcgtaagccaggcacagcggccaggtcttgccatccggatcctgctcgacggccacgacgaccgggacgccacggccagcggcgtactcacgacgcacgatgtggcccgggcccttcggggcgaccatgaagaccggatgatcctcggacggcttgatgtagccatagtggatgttgaagccatgagcgaaggccagagcagcgcccggcttcaggttcggctcgacgtccttcttgtacacggcggcctggtactggtcaggcagcaggatcatcaccacgtcggcttcggcaacggcctcggcaacaggcttgacctcaaggccctgctccttggcatactccacggacttggaggtaggacgcaggccgacgacgacgtcgacgccggaatcgcgcaggttcagcgcatgggcgtggccctgggaaccgtaaccgaggatggccaccttcttgccatcgaacacggacagatcggcgtccttttcgtaccagatagttgctgccataattggcgctcctttattgtttcttgcgattcggaacttgctttttccgaacaaactcgctattttctattcttttttcggttgttatcacggcgagtgattcctaggatgttgctccccccggattgtgtccgaggaaccactccgcctctcctgcggaactgttctagtaccgctttctttatgatgtctgttggcgttcacatagtggctatattcacgtcaaacgattttttctaaggctccgagccaccccaagcgaagcagcccggcaagccggtcggcgtcacttggtgaagtcgacgttcttcgtttccttgcagctcaacaccgcgatgaggcagcacagggccatcacaccgaggtacaggcccacggaatgcacgccccaatgatgggacagccaagtggcgatggtcggcacgaaggccgcgccgacgatggcagccaggttgtagccgatgccggagccggagtaacgcacgttcgcgtcgaacagttccggcaggaaggcgccgatcggaccgaacgcggtacccatcagagcgaagccgatgcacaggaacagcaggttggtggcgaagttgcgctgaccgacgaccgccggatcaagcaggaacgggaacagcagggcgaacgcgataaggcagcaggaggagatgatgatcacgcgcttgcggccgaacttgtcggcgttcacgcaggagatcacgatgaacgcggcgaacacgcagacggcgatcatcagcatgagcagatactcctggttggtgaagcccaggttgccgccaccctgctcgacggtcttggtgccccaagcgagggaccaggttgccagcgtgtagaacagcgtgtaggtgacggccaccaggaacgtggcctggatgacttccttccagctcttcttgaacacttcggtaagcggggacttgacgaccttcttctgctcctgggccatacggaagatcggggtctcctccatctggacgcggacgacgaggccgacgatcacgaggatggaggacagcaggaacggcacgcgccagccccaggcaagcatcgcgtcattgtcgttgaaggtctccagcaggaagtaggtgccgttcgacaggaagaagccgatcggggcgcccagctccgggaaggagccgtatagcgcgcgcttgtcttccggagcgttctcggtggccaccaacgcggcgccggaccattcgccgccaaggccgatgccctgcacgaagcggcataggcacagcacggcgacggccgcgacaccccattggttgtaggtcggcaggcagccgatcaggaaggtggcaatgcccatggtgagcagggagaccaccagcgtggtcttgcggcccatacggtcgccgaagtggccgaacaccaacgagcccagcggacgggcgatgaacgcgatggcgaaggtcagcaggctggccagcagcgcgacggtcggattggtggtgtctccgaagaacaccttcgggaaataattcgcagcggcggtgccgtatgcgtaaaagtcgtagaactcgatggcggtgccgaccatggatgctgcgatcacggttttgaccgaatcgcggaccatcgcctgcgctttgccagcggccgcttcgactgtactcattgatgtactccctgtacgtcctgttaccggttcccaacttccgccgataacgatgttgtttgtagtttttctgttttctgttgtgcgctatgccggccggcttcaaaaggttttcgctgcgtctgccttgtgggctgcgacaaaaagaccccgcatcatgcagggccatcaacgtgtgtgttacgcgcgcctcaaaccctgccttcgttggcgagggattgaagccgctatgctcgaatcagtccgccaacgaaagcggaataataattcgtgcggacagcagtacgtgtgcgaccattccgttcatcgtggcgaacctcctttcgcaaaatcttttccccgggcgggatttccgctcgaactaagccgtaaacataggcgcgtccatctcccctatccactaaaggttcactatgtggacgcgccgtttcgctttattttccaatcattggcgatctagcactgtcatagtcgccgtcattgttgcgatttcaaccgcaatgtcagcagacccgccaacagcatcgaaacagtggcgacagcgaagatcagcacggtggcaccggtcgccacaatcaccgcggcgcaggcagcgacgcccagtatcgtgccgaacgtattggccagactataagcggcaagcgatcggcccacggaacgcacatccggcagcatcgcaagatccaagctttggctggcgccatcgaacaccacgtatgcgaagccggcaagcagggcgtacagcgcaaccgccaggaaaccgtcgtccatcagcaacggcagcagcgcagcgaccatgaacaacacggcggacgcgacggccggaatacgcagatcgccaaacaggctgacgacgcggccaagcagcaacgccgcaatcaaagcaccgacaaacgtgcagatggccatgaccacaaccaccgatccggcaccggcaatgccgaacaaaccggcctcatcggtattgccgacgatattcggcgccagataccactgatatacggcgattccggctgtggccgcaacggcgaacatgcgggccgcgaatgccacagaaaacttcggcgcgttctgcggcggacggtattgcgagaagaaatcgcctttctcaacatccctacgcggcaggtagctgctggccccttcgaacggcaatatcaacagcgtaacgacggccgcgacgacaagccaacccgcgaataccagcatcgcgaaacccgtagtgccatcccaaccttcgccaccggcatgcggcgtcagcgcaacagccacggcgacgccgaccagctggccaagcgccagccccttgccgtgccacgaatcggcgcggtcgcggaacttgtcaggcacacgttcgccgaacgcggcggcgaacggtatggccgccatcgcatacgcggcctgcgtggccagccagaagaacacggcccacgggagaaaatcacatgcggaaagaatcgccatgcagatagccgccaatacgctgccgctgacgatccatggcgtacggcgcccgaaccggcagtaggaatggtcggaaccgacggcgatgcatgcgttcagcaggaacgtcatgatggcacctgcgatgacgagcatcgccaaatccgtgacgcggttgattcccgacaaacggctgacggtttgcggaatgagcaccgtgttgaacgccgccatcggagcggacagcagcattgagccaagcgcaaaacccgcaacgagccggttggcctgcattgcggtcggcttggtgccgtccggagcggtcatcgggtcgcgcaggtcgaggaaggacgattcgaggttcggcacagccacgtcaagatgcgcggccgcggttaggggcgctccaccttccgatgcgatgcgcgcggcctgggtttccggacgctcgttggacgcttccggaatacgcggatgctgctgcaccgacagccggcgcatggccgccttcgcttcgggagtcagggtcttctcataatcggggcgatcgtcgatgcccgggcggatgaacacctggccgggcagcggctgcggtttgaattcgttattctgattgtcttcggtcatatctgctgttttcttggcttatcgcgttttctgcttgtcgtgtttcatgtgcttcgatactccacgcatgcgcccgcccgctacgagcgacacatacgaaaatcgcccggacgcattgcttcagcgcattcgggcgattcttcaacgcaacttacgataccaacacgtgcggccactgccgtccgcccgacggaccgggtgcgacggaccgggtgcgacggaccgggtgcgcgaccgcaaggtggaacgcaatcgcaaggccgtacgtaatcgcaagaaaatacgtaatcgcaagaaattttccgtcaggcgacgacaggcggattggcgatcagatcatccgaacggtggtctcccgcggaatcctcccattccaacatggcgaccggcgtagtgttgtccacaccgagaccgcgcttcggctcgaacgtcagcgtggcctggctggtttcgccgcgccaggtgaagctgatggacgtgtcgtcatcggtggtgtacgagaacgtgccgtcgaacgcgtcaagctcgttgcggaacttggcgagcgcgttcagggccttaacgaccggacgcttgagattctcgtcgatttccgcggtggagtagtagtgacgattgatgtcgcggccgttattcgtcttacgcagcagctccatgtcgttcttgccggcgagcgcgccgacatagtagacctgcggcacgccgggcaggaagaactgcaccgcgcgggcggcgatgtagtgctggtcgttgcatccgagcgccgaatagtaggtgctgttgacctggtagaggtcgagattggatgcggcggcgccagtggctgcctgggactcgccgtgggtgttggcgtggatggtgttgacgagattgtcgacgtcctcatccggcacgagacccttgagcgagcggtcgagctggtcggagccgatgtcgatcacgccgatgccgtcgtgcgtatcgagcacggtgacggcgttgttcgggcggatgtcggtccagtgggcgacgggctcgacgtggccggtgctcagcgcgtgcagcagcagcggaggcagggcgaagtcgtagacgcggtccaccttggatgcgatttcgacctgcttcttgtagtaggagtgcacttcgatgaggatttccaggccgcgcttgacgccttcctcgcgcaggcgggagatcagcttgaaggtcttcggggtcatgaagcagctggtgccggcctccttggcgccgtagccgacggcgtcgaggcggatgtagctgacgtgggaagccgccatctggtcgaagatcgacatcaggtattcccaacccttgtcggaatcggtgtcgatgtccacctgctgcggggtgaaactcacccagaccaagcgcgtcttgccggcgaacttgtagtgggtgaacggcaggcccggacgcggacggtagatgccggccaggtcctcttcggtggcgccgttcgggaagacggagctcatggtgaggaacatcgggtagtactcggattcctcgcccttggccagcacgtcttggaactgcttggattcccagctcatgtggttgacgatggcgtcgaccatgatgttgtgggtcttggagagttcggcgacgtcgtcccagctgccgagacgttcgtcgaccttggtgtggtcgatcgggtcgaagcctgcgtcggcgccgtcgaacggggtgaagaacggcaggatgtgaacgccgtcgtacacgccgtcgaagcgggtgcgcagaatgtcggtcatcgacttgatggtgccgtcgccaaggcggtcggcgtaagtgatgagctgcaccttgtttttcatggagcctccttcggttccaaaaagtcgttgcgagattctttgcgggagtccttacggccattcccacggttgtgtcgaaccggttcgatattaccgcaaaatggggctcgacaccaaaaccgcaaccggtgttcgggcgtgtcgaaccggctttcggccgaatcgcggcgcatgtctccggcgcccgattcgaaagcgacggacatgcgggggcagccgcgagcgcagggccctcagccttgggcacaggacttcaactgcgggcgcagtccgtaagctggccgacctgcttaaagtagcggtcgggttcgaggccgtcgacggtcgccacgttcgtcatatgcacgccgtcgaggccgccgtattcgacaatcacgtccagcacgcgctcctgccacgtcggttcaagatacgggtcgacggcgttgctgcccaacgcgcgcatcgcacagacaagcgcgtgcgcgccccaattcgacgtgccggccaccaccagctggtcggtcggcaccatgcaggcgatgttctcgccgtggtcgaccaccccttcgatggcgtagtcctccacacggcccatgccgatctcgttgccgccgtcgcccacgccgatcgtgtgcaggccgagcagcgcgagctggctcagcggcgcggtccattcggtgatgtcgatgccgcgcatgttgtgcgggctgccgtcgcgcgccgggccgacgcgttcgatgtagacgagcgtatcgatatgttcggttttggcaaggtcgatgacgccgttgagccaggcgtcaaaaccgcccttgggattggcattcggcgcgatcagcacgtggtcgtccggcaggaaacccaatgcggacgggcgaatcaccggcgcgcagcattcgtcgctgaccagccatgcgtcgccgccaatcgcacgcaatgccatgcatacttccagcgcacccaacgggccgtccgtttccgcagcgggttgcgcggccttcggaatgtagaagccggtgaccaccagcgcgcgggcaggccgaccttccttgctgttcgacaagtggcgtgcggctcggaacaaatcgccgcgcgaatacgtcatcaacgtttcggaaccgcgtccgacgtcggctcccgccatgcgtgcgatacgcgcgattttcggataataccgccaatccagcatgctcatgttgcgttccttccgtggtctgggttttgtttttgcgattgcgatgcgttgcgcgtaaggggcgtgcggttcacccgacggccggcagccgtgtcagccggccgccgcgttaactgatggcgccgagggggtcgccgtattgcgcggtgtcgccgacctgcgccgatcggtgcagtatgccggcaacgggggcggtgatttcggtttccatcttcatcgcctcgagtacgacgatcggctcgttttcctcaacgtgcgcgccatcatcggcgagccagcggacgaccgtgccggtgatggtcgattcgataggggtgtcttgggtgcttgcgatatccgagtttgcggcgatctgcgtgcccgatcctgctggaacggacttttgataggcgttcagcagggcttggatgaccgattcgccagaatcggacgtgagggcagggtcccccgttgcgccggctccagccaatccggccagccccgcgcccagcgcggcgacggaggcgagcgaagcgggcaggcccaatcgcacgcgtttgccatcgacctcgacccagctttccaccggttcgggcgctgcggcccggcgacccggtttgccgtcggccagcgtgcgcacgtccacggaaggcaggaattcctcttcgatccagcgcgtgtagacgccgaaatcgccgtccgtcgccacgaaagctggctgttcgagcacggcctggtcgaatttgcggaccgttggcacgccggcaatcgccagctcatccaatgcgtggcgggcgcgcgtcagacaggccgaacgcgacggcgcggagacgatcagtttggcgatcatcgaatcgaactgccccggaatcgcgccgtcttgcgcaacgccggaatcgaagcggatgcccggtccggtcggcacgttcagccgctcgacgatgccggggaacggtacgaaaccaagggatggatcctccgcgttgatgcggaactcgatcgcatgcccatgcggaacgggggtgccgtgttccaagccgggaatgtcggtgacatgcgcgccttcggcgatcgccagctgtgcggccaccagatcgacgccggtcacctcttctgtgacggggtgttcgacctgaatacgcgtgttgacttccatgaacgacatcgtgccgtccggatcgaccagaaactcaacggttccagcgctttcgtagtgcgcacgggagcagatggcgacggccgcgtcttccagcgcccgggtggtttcagggggtaggaacggcgctggtgcctcttcgatgagtttctgattgcggcgctgcagcgagcagtcgcgcgtgccgacggccacaacgttgcccgcgccgtcgccgaggatctgcacttcgacgtggcgcgggcgggcgaggaatcgttcgatgaagcagtcgccgttgccgaacgccagctcggcctcgtgcgtggcggatacgaacgcctcgcgcacgtcttccagccggtgcaccactttcagacctcgaccgccacccccgtagacggctttgatggccagtggcaggccgtgttccttggcgaacgtgataacttcggcggggtcgtgcaccggttccgtggtgccgggggccatgggcgcgccgacttcggccgcgatgcggcgcgcttcgactttcgagccgagcgcgcggatggtggcgggctgcggaccgatccacgtcatgccggcgtcgatgaccgcctgcgcgaattccgcgttttcggcaaggaaaccgtacccggggtggacggcgtcgacatgcgccttgtgcgcggtttccacgatggccgcgatgttgagatacgtgctttgcgcgtcggatccgcccagtgcgtaggcctcgtcggcggcgtgcacgaacagcgcgtccgcgtcggggtcggcataggcggcgatggcgatgcggccggtgtcatggcaggcgtggatgacgcgcatggcgatttcgccacggttggcgatgaggatgcgccgtagtttcggggttgcgggcgatggcgacgacaatgatggcgacggggatgggagcgccgttgcggatggtgcagtcgatgcggatggcattatcgaacctccttggtggggtacgcaggttgcggagtagacgtggcatgggcggaaacgacgtggaagcggacgcatgcgcctggtggcaactgcccggccacgtccaacgattccggttcaagcacggcgattaccggatatccgccggttacaggctggtcgcgcagaaaaatgaccggttgtccgctggtcggcacttcgattgcgccggatggcgtggcctcgctggccagttcgcgcgtgtcggtgcgttccacgggtgccgctcccgaaagtcgcaggccaacacggttcgactgcgcggtcactgtccacgtttgcgtcaggaatgcggacaggccggctgcggtgaaccagtcgtcgcgcggtcccaatcgcacgtataaatccgtaggtctgccgggtttcggcaggtcggtcggccatggctgcggcaggccgacgccggcatcgcacgccgtggacgcggtacgtatggcgagccgctgtttggctgcgatcggacgtgggccgatgccgctcatcgtgtccgttgcagccgaaccgagggttgtcgcgacgccgaaaccgccgcgtacggccacataatcgcgcaggccgctggtcggcggggcgattgacagcacgtccccgtcacgcagcagaaccggttgttgcatggcgattgtggtgcggtcggcggcatcgttcgatgcgttcaagacggtccggccactgcatccaccgggggaatttggggtgaacgtgccgtttgagccgccttgactatcttgcgattgccggcttccggtaatcgtcacatccgccgaagcgcccgtcaccgccacgaccacactgccgatggcacgcatgcgcacgccaccaccggtgatttccaacacgggggtattagcggggttgccgaccagtgcgttggccaagtgggaagacgtgcgatcggcggcgccggaaccggtcacgcccatgttcgcggcgacacggccatcatcctggaaggtggtgagcaggcccgagcggaggacttcgagagccggagtcgaggccgagacggacatggaatctggcgcctgcgaaacttgaacggaatcggacacagaggcagaaacagaagccgaaccgccggaaacggcgtcacgcacgggcgtaaaacgcacggtgtcgccgggctgcaacagcgcgggcgggtcggcccgctcgtcccacatcggcgtttccgtgtggcccagcaactgccagccgcccgagctgacgcgcggatacacgccggaaaacgtgccggcaagccccaccgcgcccgcgggcacgctcagccgtggcactttgcggcgtggcacatcgaatatcgggtcgccgccggtcaggtatgcgaaaccgggcgcgaagccgacgaacgccacggaccaggcggcatcgcaatgccggcgcacaacctcgtcaacggagatgcccagcaggtcggctacgtccgccatatcctcgccatcgtaaatcaccggaatttcaacgattcgggaatgccgttccatgtcggcggcaacgttcagcgcgcgaatcgcggcggtcagttcgacacgcgacgaaagcagcggatcgaaggcgacgtagacggtgcgcgcagcgggaatgagttgtttcacgccggcgaaaacggaggtcgcgctcggctgtgcggcccgctcgggcgattccgcagtttgttccatggcatgtttcacggcgctctgcaacacggcgaacacccgcagggtctcgtccaaatcggtgagctccacgagtatgccgtccgcaccgcaggtcaggaatcgcatgtcgccaccgccttaatcccgcgcggccgatgcggctgcgtcgcctgcgaacgcgcgtatcgcaacgccttccgactccaagcgggcgcggacggcacgcgccatcgccacagccgagggcgaatcgccatgcacacagacggaatcggcgttgagcggcaccacggtgccatcgatcgccaccacctcatgctcgcgcaccatgcgcagcacgcgcgccgccacttcggccggatcggcgatcactgcatccggcaagcggcgcgacaccagcgtgccgtccgcgttgtacgcgcggtcggcgaacgcctcgtggaacacacgaagcccggcctgcgcggccaggcggccgaccacggcgcccggctgcgtcagtatcgccagcgatgcgtccacggcgcggatcgcgtcgaccacggcggcggcctgcgattcgtcgcggacgatccggttgtacagcgcgccatgaggtttcacgtaccgcacctgcgcgcccaccgaccgcgccatgccttccaacgcggcgatctggtacatcacgtccgccttgagctcgtcgggggactcgtccacatagcggcgcccgaatccggccaggtcgcggtacgccacatgcgccccgaccattaccccccgcgacgccgcgtatgacaacgttctcagcatgacggacgggtcgcccgcatggaagccgcacgccacgttcgcgctggaaaccacgtcgagcaatgcctcgtcatcgcccaatttccagcgtccgaagctttcgcccatatcgctgttcatatcgattcgcatagccgtctgccttccgtctgtttcctgcacagccatcgtttccattccttccgtcgcctttccgtcgttctaccgtcgcagcgttcttcagccgcgacgtcccttctgccgcagtcgccgcagcacgcatctcatgccgcgccccgcaacctgccgctcggcctcacaccatgtattccaaatcgcgtttgctggtgatgaacatgtgccccggcgcgtgcgtgatcgcgaattccggtttggacgccatcaccgcggcctgcggggtcacgccgcacgcccagaacaccggcacatcgcccggctccaacacgggggcatcgccatagtcgggatgcatgatgtcgtcgatgccgatcgcggacgggtcgcccacacatacgggggcaccgtgcacggacgggtaatagccggaaatccggcatgcgtcggccacctgcgtagacggaatgccacgcatcgacacgaccatcgtcgaatggaacgcgccggccgaacggcactcgatcgacgtgtcgtacatcggcacgttgcggcctgccgtgatgtgccgcaccggcacgcccgcctccatcagcggaaactcgaatgtgaaactgcagccaatcacaaacgtgaccaaatcggatcgccaatactcgcgaatatcgggcacttcggctaccagttcgccacgcttccacacgcggtacaacggcacgtcggtacggatgtcggcgcccggcgcggtgacgagtgcggtgacgcccggctccatcacttccagcagcggacaaggtttgggattgcgctgcgcgaacagcagaaaatcgaatgcctgctccttgggcagaatcatcagattcgcctgcgcgtagccttgcgcgatgccgcaggtcgggcggaccaggccgtcacggaacgcggcgcgcgcctgttcgggcgtgctcgccgcgccaagttcggttgttcccatatcggacatcccatccaccattgcgctcacctttcccgtcggccgccgtccggccttttccgaacgaactgccgacgaaccccgaaatccgattccgcagaaacggacgttcagagtcgctttccctcaccttggtcgccgaacgttacgggagccgcgcgattcatgacgcgtatgtttccgcattgcaaattggcggtaccaagcggaaacaaaccatggttaggttggacgccgaagacgcacgcgaacgctgacgcaacacaacagcgcaacagcaataaagcggcaatcaaaagacgcggagcgcggaagagaggttcccatgagttcgatcgttctggcagtcggtaacggcaagacgctattcggaggcgcaggcgtggcgcccgacgcggatctggttcgtttcgtcgatccggaaagccccatcatcaacgcgttcgatttgtgcgcactgcgcggcgacggcattttcgaagcgaccacggtatggaagggtttcccggtctcgttggagaaccatctgaagcgtctcgccaattccgcccgcctggtggacatgcccgagccgaacattccagcgctcacccgcgcagtccagctggtcatcgaccagtacgacgatccggaacccggcccgatgctacgcatcatcgtctcccgtggtctcgatccggacaccggcgtgggcaaggcggccgaccgcacgccgaccgtctacatcttccttgacgcgaagggcacgctgcattcgctggagccgatcaccatggcttcgatgacgcgcggctacccgtcggacatcaccgcacgcgccccgtggctgctcaacggcgcgaagacgctgagctacgcgttcaactgcgccgtgcaccgcgaatgcgcccgccgtggcgtcggcgacgcgattctgttcacggaggacggctacacgatggaatgcccgaattcgtcgatcgtggcacgctatggcgatacgttcgtcacgcccgacccgcgcatcggcattctgaatggcacatcacagcgcgaaatgttcgcctgggcgcttgaagaaggcaagaaggcggagtacaggaagctgccgatcgccgagctgcgcgaagcggacagcctgtacatgacgcacggcggatggtcgattccgatcagcgagatcgatggacgcgcgcttgccgtggatgcggcggagattcaggcgatcaacgatgcgatccattcgggccgcacgcatgaggacgcgttgaagatcggtccgaccggcgattacgagtaaggcgaaacgacctgcttagcaggtgaaacggcccgtcaaatgatgggcgatacggaccgcttagcgggtggtatcgcccagtttgagcgtcacgggaatcagcacgtccggctcgtacggcttgcgtcccgtggcgcttgtcgcatctgccttggcatccccttccttggcgatcgcacgaacgatattgccgaccgcgacctgcgcgattttgtcgaaattctgcgccaccgcggtcattttcataccggccaggtcagtcagatacgtgccgtcgtaggcgatgatctgcaggtcgcgcggaatcgaaatatgcctccacatcgcttcgcgcacgcaaagcgcggcaccgatatcggagctgatcactgcgtcgataccgtccgtcggcatacggttgagcacatcgttcaccgcgttcttatacccttggaaatcctccacattgccggcttcgacatactcgtaccgcacgccggccgccttcagctcctgctccaacgtaaggtagtagcggacggccgggaacgttgtcttgtgcaggtcgaaatcgtccgggctgtctccattgcgcgccgccaaatcgaagaactggtcgcgcgggccgccgatcatcaccacgtggtgcgcgccggtgttgaccagcctgtgcgccatgagccggccgccctgctcatggtcggagccgatcgacgcgatgccgccgcccagcacacggtcgaaggcgacgatcgggcggtggatggacgtccagtaatcgttcggatgggtggtgtgcgagcagacgatgatgccgtccatcatgtgacggcgcagcatgtccacgtattcgacctcgccgttttccgcgtcggcggtggagcacagcatggtgcgcagtccttgcgcggccagctcgcgttgcagatgcgcggtaagggtggcaaagaaggggtggcggatggtcggcacgatcacgccgaccaggttcgtgcggttcttgtacaggttgcgtgccagctcgttgggcacgtaattgagctctttcatggcggctttgacgcgcgcgcgcatgtcgtcggacacgtagcccgtcttgttgaccaccagcgaaaccgtgctcagcgagactccggcctctttcgccacgtcgcgcatgccgaccattgcccaacacctctcccccgcatcgtcgggatgtttccttacaaatcgcgatattatgtgttattttacatgcatctgtaacgtttctttgcagtcgttcgcacaatatgaactatcaattgacgaaagacgccctccccctcttcaattcccccgaaaaatccactttttcacccgtgaacgacgtatgtttcacgacgcgttccacgtatcttccacgcacgccccgcatgtactccacacgcgttccgcccgcaaaaggggcggtgcgacacttgcgatcatctcgcttgcgtcgcaccgccccttgcgttgcatggcctggccgtcagccgtcacgtccggccatcacgtcagtccgcaccacggacgaaccgaccgtcaggccgtcggcacggagccttcctgggagtggtcgaagaccggcttgttgtcggcgtcgtacttgtagacgccgatggaagccgagctcggatcatgcgcgtcgttgaacgcgccgatgccggtctggccctggtactgaatctccttgccgtccttcagcagagcaacgcaggccttgtaggaatcgcacttctcgcccttggtggatccggagacggccgccatattggcctggatggtcttgccatcggcactgccgcccttctgtgcggcgagcgcggcgaggatgatgccgtcataggtttcagcaccgtaggtggtggtgttcttcaggtcgacaccggtggattcgaggcgcttgacgaagtcgtcagacggattgacacccgggatggtgcccttcgagccttccagcaggcccgcgtcgagttcgctggaatagtcggaggtgttgccgtccacgaagtacagcttcttggtgttgactccggcggaggcgagcgccttcagcagcggtttggtctgatcgaaggcgatgacgagcgtcgcgtccggattggatgccttaattgcggttgcaattgaggagaagttcgtttcggtcgggtcgaaggtatccttttctccatagacgatattgacgccggcctcggatgcggttttgacgattgtgtcgcgcaggccggtaccgtattcgtcgttgaagaccgcgatggcgagcttctgcacgccgtcctgggcaatcaggttgcccatgaccgcgccctgcacggtatcgggggcgacggtgcggaagaagtagtcgctaaggccggagaagccggccgaggtggcgcccatcgacagcatcggaacgttttgcgaggtgatggacttgtaggtgttcttaaccacggagctggaggccgggccgatgatgaacgacgggttcttgctgaggacggattgggcggcggaggtgttctggtcggcgtggtccgcgtcggaggtgtcggcgtcgacggtggtgattttgttgccgagcacgccaccagcgtcgttgatgtctttgacggcaagtttttcggcggccagttccggcggggccaggtaggccagtgagccggtttccggccataggccaccaagcacgaacttactggttttggtgccggaggtgcttgccgaactgctggatgaactggacgagttggatgaaccgcagccggcgagcgccatgactgcggcggccaccatggcggtggctgtgatggacagtttcctcatgcccttcatgttgatcttcttcatttgaatcaccgtttcctctcttggctccgctgattgccgaacccttggtgacgattatcgagatgtgttgctcgaccatcttgaatcgcactataagtgccgaggaaaccgaatgtgtatgcgtgaagttaaccgaaggtgaagcccgaaaactgttggaaacacaaggatttgtacccattttcaagcatgccaaaaccgtcggcggagggtattccgtcgacggtaaagcggtactctatctgccttcctcttccacttcctcctcaaggttgcccaggtagagggagacgactttcggatcgttcatcaggtcgcggcccttgccggagtaggcgttgcggccttggtcgaggacgtagccgcggtcgcagatctgcaggcagcggcgggcgttctgttcgacgatgaccacggatacgccggctttgttgacttggcgcacgcggatgaaggtctcgtcctggagcattggggacaggcctgcggagggctcgtcgagcaggaggacggatggtttcatcatgagggctcgggccatggccaccatctgacgttcgccgccggaaagctggccggcgagctggttcttgcgctggccgagtttggggaagatggagcacacgtagtcgaagcgttcgttgaacagtttcggtgcttggaacgcgcccatgtgcaggttttccgcgatggtcaggctggggaagacgttttcggtctgcggcacgaagccgacgccacgggagacgagtttgtcggcgcgcaggttggtgatgtcctcgcctttcagcagcagcttgccggagtggatgtgtaccaggccgaacaatgatttgagcagggtggatttgcctgcgccgttcgggccgatgatgccgacgatctcgccttcatgcagggtcagggatgcgccgttcaggatgttcacgccgggaatgtatccggccaccaaatcgaccgcgtcgagcaacggttcgccttcgggctcgcccatgtggatctgcgcgcgggtcagcggctcgtcggccacgcttgcgatgtcgctcatttcaggcctccttcaggtcttccagcacggaatcgtcgcccaggtccacgttcgcgtgggcgcccaggtatgcgtcgatcacggccggatcgttcatcacgctcttcggttggccttcggccacgatcttgccttccgccatcacggtgacccagtcggcgatgtgtctcaccatgttgatgtcgtgttcgacgaacagcactgtggtgccttcctcgcgcaacgccatgatgtggtcgagcagcgactgtttcagcgcggggttcacgccggccatcggctcgtccagcatgaccagtttcgggtcggacatcagcgctcgtgccatttccagcagcttgcgttggccgccggaaagcgcgccggcgtaatcgtccttctttttgatcagcaggaagcgttccagcagcgcttccgctttttcgatgttcgcctgctcctgctttttccacatgccagggaacagtgcacggaacatgccttcgcccggctgtacgggggcgccgaggagcatgttgtcgagcacggtcagacggctcatgaccttggtcagctggaaggtgcggaccatgcccatgcgcgccactttttcgggctgcacgtgggccatgtccttgccgtcgaactgccaggtgccggtgttcggcgtatcgaagccggtcatcaggttgaagaacgtggttttgccggcgccgttcggtccgatcagcgcggtgatgccgtgccgttcgatttcgaagtggctcacgtccacggcggtcatgccgccgaatttgcgggtcacgttgtcggccacgaggatcgggtcgggcttgtgcacgcccggcttgttttcgacgaatttcagatcgtcggtgactttgtcgcgataggcggtggagatgagggtctcgccttccggagctttggtggcccatttggtgaggtcctggaatggtacgccgggctgcacaccggatacgggttgcacgccggttgcgggttgcgtggccggctgcacgccagtggtcggagaattcgttggttcaggcatggaaagccaactcctttcggtcgcccaacagaccttgtggtctgaagatcaccaggcacatcagcgcgacgccgacgatcacccagccgagagcttcgatctggttggaagagatgagggtttcgggaacggtgttgcgcatgacctccttgacgaaggtgagcagcacccacagcacgcaggagccaagcaccgggccgagaatcgtggccgcgccgcccagcagcagaatcgtccacacgtagaaggtgacggtgcggccgagcgaatcgggctgtacggaacgcggcaggacgaagatgatgccggcgatcgcgccgaacaggccgcccagaatcagcgattccatcttgtatcgcgtcaccggcttgccgagcgaacggatcgcattctcgtcctcgcggatgcccttgagcatgcggccccacggcgagtggaaccagcgccagcacagcagcgccgcgatcaccaccaaaacccatgccacgatgcgcagccaccaggagttggcgatgttgttgctgtacgtccacagcaggaacgtggtcgaaccgtccggcagcggcgaaagcgattcgaatttctcggtgaagtcctgcggcgagatgcccgcggaaccgccggtgaagttcgtcatgaccgtcgatctgccgatgatgcggatgatttccgcggcggccaatgtgaccatggccagatagtcgggtccgagcttcagcgtcggaatgcccagcagcagcgcgtagatgaccgcgagcgcgagcgccgcgcatacggaggcgaacaggttgcagcccatcgactgcgtgatggcgaatccgtatgcgccgaggagcatgaaaccggcctggcccatgttcatcaggcccgtcatgccgaagtgaatgttcaaaccgattgcggcgagtacgtacgccgctgtggtcggggcgatcagttcgcccgccgcgttggagatgattgtcatgatgtccatggatcagcccatcctttgctgcttgccgaagatgccctgcgggcgcaccagcagaacgatgatgaggattgccagcgcgctggcgtaacgcatatcgttggggatgacgagcgagctcatgtccgccacgatgccgatgaccagcgagccgatcaacgcgccattagcggtgccgaggccgccgagcgtcaccgcggcgaacatcagcaggatcagggtcgcgccggtgttccaggagatgccgttcaggtagacgccgagcagcacgccggacagggctgccatcgcgcacgagaggatccagaccacgcggaccacctggtccacgttgatgccggatgccgcggcgagtgccgcgttgtcggacacggctcgtgtggcgcggccgagtcgcgtcttgtaaaggaacagggtgacgccgacgatcacgcagatggcgatgagcgcggagaccagcgtcggcatgtcggtggtgatcggtccgagctggaagctgtccggcaccgatttgacgatgcctttgatgtcgccaccgaagaagaactggaacgtgtactgcaacgccatggacaggccgatggtgacgatcatctgctgcatggtgccgacgtggcgtctgcgtagcggcccccaaacgatttcgttttggatgaagccggtcagcgcgccgatgacgatggcgaagatggcggaggcgatgagcggcatgtgcagcatctgcgtgccgacgtatgccatgaggccgccgagcgtcacctgttcgccgtgtgagaacgactgcaggccggtggtgccgtagacgaggttcatgccgacggacatgaggcccagcatcaggccgaagataatgccggaatacagttgctgccagatgcgtttgccgacattggagccgtcttttttgactggcgattgcgtggccgccgtcgatccggatgtgccggtcgcgcctttcgtgccgtttgccgagccggacgatccggatgtgccggacgtgccgctgccggcggaatcgcccgcctggtcgaatcggacaacgccgcgctgcttgtcgaagctggctttcctgattgtcaccgttgcgctgcttgccttcaggccgtgctctttcgcaacggacgcgtcgatggtgacggtgtaatcgccgtcatcggcaacggagaaggcccatttgccgtccgccgcggttttggtttccgcggttgccttgccggacagcgtgatggtgacgtcggcgatcggcttcttgtcggcgtcctgcaggatgccgttgacgcagccgttgctggcggtcggattgcattcatcgacggcctgcgcgccggaatcggctgcggacgcgatggcgggagggagtacgaaaagcatcgagagaacggcgacaatcgaacagagtatgacgattcccggtcgacgatgccgtgtgagatacgttacggctgtcataggtttttcctctcttgttgttttcacaacgtaggagaggaaacagctcgcgcggttgcgctcagatttcctgaacgttacccgatgaccgcccgtgtaacgtgaaaattacgcgcggccgagccggtgacagctatgcgtggccgcccagcatggcgatgccgaatccgagcgccacgcaggcgagcggcaccgcgaccgtggcagcgccatagcccagggccatggcgaaacggcgtttgcgaatcagcgacagcacctcgttgatcgccgacgagaatgttgagaatccgccgaggaaccccacaacgaacgtcattaccgtgcccatatcaaccgactgcgcatagtacgacatcatggcgatgccggcgcacagggaggcgacgccgttgatgacgagcgtggccagggggaagctgtggttgccgtcacggttccagctgcgttggatcgacacgtcaagcacataacgggccatggcgccgatgccgccgaacaggcagatcatccaggtcatcagcgcacctcccctgtggtcgggtcggcgacgagcgggatttccgcggtgaccggcttgggttcgaagctgggcagaggtgcgacgggttgcgatgactgcggctgcgattcgattttcggcacctgcccggtctgcgcgacctgctgggcgacctgggccgcctgctgtgccgcctgcgcggcctccaacgcggcctgcgcggccgaatgcgccgcatccgccaccttcacgtggcgcacgccctgcgcgtccggcacgttgttctgcacattttgcgcggccggcacgtccgattcgcccgaatcggccatggggaccgtctgcgtaacactctgcgtagccgatactgcagtgtcggtcatctggacgtcctgcacgatgccgtacgcgtccgaatcgcccgaatcggacattgaggatacggaagccgtggaggcatcggcgatcgcgttacggacccgcttgcgtgtgccgcgcgccagcaacgcctgcatcagcgccacgccaaccgcggccgcgatcagaccgccagcgaaacttcccgcaagatagccgagcgcgctgccgaaacgctgctcgcgcatgccttccatggtttccaacatcacgccggacatcgtcgacagtccgccaagcaaaccaagcccgacgccacggctgacgacctgccgcaccctgcggcgcagccacgacgcggtcgccatgtattcggtcagcatcgcaaacaggaagcaggcgagcatattcgacacgaacgtgcccaccacgaacggcgaaccgttcaccgacggcagcagcaggtccgtggcgcgacggaaaccgacgccgacgaagccgccgacgaacaccacgagatacatcagaccatcggcaagagggttgaatcgcgcctgcatgcgtttcatcggcgcgagcggaatctgcggcggatgcttggatgcggcggcaccggacgggcgcacatccgcgcgcgccacttcggcgacgtcgatcgactgtgtggcgggattcggctcatcacccgcgtttggcgagtctgccgcccgttgttcttgcgattccatcacgttccccttgtacttggctttccgcggacagcgtcgttccaccccagccatacggcaacgagctggccgcaggtgccgtcttcctaaccttgtacgagtctacacgtgcattgcaaccaaacatcgaacatgtccgattcggtggataactgtggataacttcgggtggccctagacgtctacgaatggttatggaagacagtaaggccgcgtcagacggacacgtcgcacaaccgccgcatcgcatgccgtgcgtcgctttcgtcctcgccgctgaacaacacgaccagatagtcgccggcgcgcagccgcgtatcgccatgcggcacgatctgccgttctccgcgacgcaggccgatcaccagacagccgtacggccagcgcacgtcacgcatcagcttgccgtccgcggtcgcacccatttccacaggcagttccatgatgccgttgtcgatgcgattggcgattgccgtcgtgcctccttgcgcgcgcatgtaccgttccagcagctcgccgtagatcggtttcgtacgcagcaggtcggagacgagcaatgcgatgaacgcgacggcggcgaccggcagcatgtgcgtcaacgtgccggacatttccacggccagcagaatcgacgtgatcggtgttttcacggacgcggccagcgtgcccgtcatcacgcataccgagaaaatcgccacggaatcggacggcaggttgccgaactggcgcaacgtctcgccgcagataccgccggcgagtgagccaaccgcgagaatcggcatgaaaatgccgccgggagcgcctgaaccgaagctggtggaggtgaacagcactttcgccacgaacagcacgcacagcatgcccaagccgacgcgcgcatgctcggccatggcgatcaggttcgagccgccgccgagcacgtcaggcagccaaatgccgattggcagcgcgagtgcgatcgcgatcaaagggcggctccatgcgggaagcttgccgtacagcgtttggaagccgagcagcgaacggttcatcagcgaaccaaccaaaccggccaccaatcccagcggaatcagccacccgtattcgccgagcggcagttggccgatggtgccgaagtcaagcaccggacgcaggccgaaacagtatttcgatacgaaatcggcggtcagggacgcggcggtggcgcccatcagaatcgcgggcgaaaaactgcgatgcaccccttccaaagcgaacatcatgccggacagcggtgcgctgaacgcggcggacaggccggccgcggcaccggcggtgaccagataatgctcctgcatgtcctcacgtttcttgccgcgcagccggtgcgataggaactgcgcgcccgatgcgccgatttggatggacggtccttcgcggccgagcgagaggccgaagagcgatccgagcaggcctccgatgaagcgaaccggcagaatcgtctgccatcgcattttcaggccgcagatcaccacgccgttggtttgcggaatgccgctgccgccggccatcggctcttttttgaccatccatgcgatggcgagcgcggctgcgattgcggcgaccgcccacggtgcgaccagccacggggtttcgcggatgcgcgcgtagatccagcgcgcggtgtcggtgccgtattcgatgccgagacggtagaggacgacgaggaagccggaaatcaggccgacgagaatgccggcagcggccatcttccatttcaggtggtcgaatcgcgggaccagtttgctgaacctgtcaaacctgtcgaacctgtcgttaggcggcattgcagtcatcgcactccccttttccgttcctccgccgcgcaccccgtcggtgtgtatgcggtgtgcgtcatacgcgaacgccatcgcacgcaccatacgcaaagtgccggcaggcacaggcccaccggcacttgtcattgacgttcgttgccgacgttcatatcgacgaatcagccgaatcagcttcagtcgatcagcgagttgatctggatgatgtggtcgcgctgcgggccggtgccgatcacggaaatgcggcagccggacagttcctcaagacgcttgacgtaatcctggcaggtcttcggcagatcgttgaagtcgtggacctgggaaatgtcctcgtcccagcccggcatggactcgtaaatcggcttcgcggcggcgaattcggcctggtcggtcggcatatcgtcgcgacgctcgccgttgacgtcgtacgccacgcacagcgggatttccttgaggccggtgagcacgtcgagcttggtgagcacgatgtcggtcaggccgttgacctgggccgcgtaacggttgacgaccgcgtcgaaccaaccgcagcgacgcggacggccggtggtcacgccgtactcgtggccttgggcgcgcagccattcgccgtcctcgccgaacagttcggtcgggaacgggccttcgcccacgcgggtcacatacgccttggagacgccgatcacgcgggtgatcttggtcgggccaacgccggtgccggtgcaggcgccgccggcggtcgggttggaggaagtcacgaacgggtaggtgccgtggtccacgtcgagcatggtggcctggccgccttcgaacagcacggtcttgccctcgtcgagcgccttgttgagcaccagggaggtgttggccacgtacggcttcaggcgttcgccgagcttgagcagctcgtcggtggtctcgtccacgtcgatcgggcgacggttgtacagcttgacgagcatctggttcttctgatgcaggctggcctcgaccttgtcatgcaggtgctccgcgttgaacaggtcgtgcacgcggatgcccacgcggttgatcttgtcggcgtatgccgggccgatgccacggccggtggtgccgatcttgtgcttgccgaggaagcgttcggtcaccttgtcgagcacgcggtggtacggggcgatgatgtgcgcgctttcgctcaccagcagtcgggagcagtccacgccacggctttcaaggccgtcgatctcctggaacagcacttccggatcgacgacgacgccgttgccgatgacgggggtggtgttggggctgatgatgccggacggcagcaggtgcagtgcgtacgattcgtcgccgacgaccacagtatggccagcgttattgccgccgttgaaacgggcgacgtagtcgaccttcgtgccgatcagatccgttgccttacctttgccctcgtctccccactgggcaccgatcaaaacaattccaggcatgttgttgcacctccgtgcgtacgcgattctgccttaagccttgcgcctaaagccttacaaaggttactcttcaccctctaccgggtctgagggatgctcacggctccggaccgaccgtaatcggattgcaaccggtccgaaaaacagaccagaaaacgcccgaaaacagttcgaaagaccgttggctagttcagcgcgcgcccggcactgccgagctgcttgcatgcttcgaccacacgcgcggccatcgcggattcagcttcacgaccccaggatcgcggatcgtacagcttcttgttgcccacctcaccgtcgattttgagcaccgaatcatagttggagaacatgtgaccggccaccgcacggctgaatgcgtactgcgtatcggtgtcgatgttcatcttcaccacgccgtagctcacggcctgcgcgatctcctccggcgcggagccggaaccgccgtggaacaccagggcgaacggcttaccgggagcgacatccagcgagtgcgcggggtcgggcatttcgccggccttgatcgcgagcgcgaccgtggtctggatttcgtcgagcagttcggggcgcagtttcaccacgcccggcttgtatgcgccgtgcacgttgccgaaggtgaaggcggccatgtagcgtccgcgctcgccgaggccgagtcgttgcgcgacggtgatgccttgcgcgggcgtggaatacagtttgtcattgatttcggcgctgtgcccgtcttcttcgccaccgaccgcgccgatttcgatttccagcacggtgtgcgcggcttgggatttgtcgagcagttcttctgcgatgtcgaggttttcatccagcggcactgtggaaccgtcccacatgtgtgactggaaggtcggttcctgaccgtgcttcacctgttcgacttcatggtcgagcaagaggcgcacccattcgtccaaatactgtttggcgcagtggtcggtgtgcagggcgatggtgatgttggggtatttcgccgcgacttcgtgcgcgaaggctgcgaaggcaagcgagccggtgacgcggtcgttgacgcgttgcccggagaagtaggcggcgccgcctacggagacttggatgatgccatcggattccgcctcggcgaaaccctggagtgcggcgttcagggtctgcgtgctggtcacattgatcgcgggataggcgtaaccgccgcggcgtgcggcgtccagcatttgcgcataacgttccggcgttgcaatagtcatgcctccattatcgcccaaccctatcccacttgtcatgtgacaacattcgccatctttcctttccgttttcccgaccgtccgctccatatccaggtcgcccgccccactagagccatatgccgagcgttttcgtctcatatcccgacacttgcgggaccgaccaataaacatggcgaaaccattgcgatcgttccatcggaagtcatagaatgtccaccagatcgcgcgacgaagagcccaaccgggtgttccccgcacgggcatgccgccgcacgtagatgttgcgaccaatacccgcgaggaggcttgatgcaccaggttttcgccatcttccttcgagacgtgaaacgcattctgaagaaccccgtggcgctcgtcgtcacgctgggtgtggccatcatcccatcactgtacgcatggtgcaatatcctcgccaactgggacccgtacgcgaacacgggcaacatccaagtcgctgtggcgaacgaggataagggcacaacctccacgctggtcggccatctcgacgctggccagcagaccgtcaaccagcttaagaagaaccatcagctcggctggcgtttcgttcccaagcagcaagccatcgaaggcgtggaatccggcaaatactatgcggcgatcgtactgccggaagacttcagctccagactaatcggtaccgtcaccggtaaaggcgaccgaccgtcgatcacgtactacatcaacgaaaagctgaacgcgatcgcgccgaaaatcaccgatacgggcgcgaccacgatcgacgagcagatcaacaccactttcgtttccagcgtggccgacgccgtggcaaaggaagtgaaggaggcagcgggagaaaccaccggcagcgtgaaaagcgcgcaaagcgacgtcgtcaacgatctgaccgacaccatcaaccagctcgaaaccgtccaacagcagctgcgcgacacccgctccacgctcgacaaggccctcaccaccatcgattcggccaaacagtccaacatcgcgctcgcctcggaactcaccaactcgcttgacaccgtcggcaaggcgtccgacttgctgagcgagacgcgcacacaaaccgaacgattctcgaacacactggtcggagcgctcgacaacggcagcacgcaactgtccggcctgcaggtcaacgtgagcaatgccaccggcaccgtgctcagcggactgaacaccacgcaggacgcgctcgaccaagtgtccagcaccatgcatcacgtcaacgccaccaccggcaatgtgctcgacggcgtggagaaggcgttgcaggccagccagctggatccgaacagccaaacgtataaggatctttccgcgcagctcgccgaagcccgcaaacagctgacgttccagcagcagcgcatcgacgccttcgatcaggacaccacggctgcgatcaacgcggggaagaacaccgcgaacgggttcaacgacgatgtcaccacgctggcgaagaacggcacggcgtcgatggcgagcgcacacacgaccatcaccggcacggtcatgccgaatctcaacaccgggctcgatacactcagcctggccaatgggtcgctgtccggcacgcttaccacgctgcaaagcacgctggaacagggcaacgggctgctcgaccagttgtcgcgcaccgtgacccaaacgaacaccaccattgctggcacgcagacacagctcgccaatctcgccaaacagctcaacaccacgcgcaccgatgtggccgcgttgagcagttcggcgatgttccagcagctttcccaagcgctcggacttgacgcgagcgaggtcggctcgttcgtgggcgagccggtgcatttggacgaacaggtcctctacccggtcaaaaactatggttccgcggtcacgccgttctacacgaatcttgcgctgtgggtcggcggattcgtgctcgtcgcgatctacaagcttgaagtggaccgcgatgagaagatccgcatgtacacgccacgccaaggctatatgggccgttggctgctgttcgtcacggtcggattcctgcaggcgatcatcgccacgatcggcgatctcgcgctgggcatccaatgcgagcatccgttcctgttcatcctcgccggcattttcgcctcgttcgtctacgtgaacatcatttacgcgctcgccgtggcgttccggcatatcggcaaggccgtcgccgtgattctggtgatcatccagattccgggcgcggcaggcctctaccccatcgagatgatgccggaattcttccgccgtctgaaaccgttcctaccgttcacctacggcatcaacgcgatgcgcgggccgatcggcggcatgtatgccaaccattattggatcgacatgctctcgctgttctggtatctgcctgtggcgctgttcatcggcttggtggtccgcaagctggcgttgaacctcaaccgcctgttcgacaaccgtctggcggacactgatctgatgatcaccgaacataacgaaggcacggtggaaccgttgcggctcaccgagaccgcgcagcagatcgccgaggagttccccgaactcgcccgcagacgggcgattcatttcttccgcctgtacccgcgcctggtgcgttggggattcctcgcgctggcggtactgccgttcgtgttcctgctattgctattcatcacgcgcatgaagctcgccatgctgctcggttggatcatttcgatcatcgccatcgacacgtatctcatcgtggtggagtatctgcgcgaacggtatgcgaattatctgggcgaggaagcgatgagtgcggaagagttccgcagcgcgatcctgcacgagaacctgctgttccggccgggcatgcattacaagccgatgcatgccgtacgtacgaggctgtatgaggctgcacatggtggttcggccggacatgcgactgaacatgcggctgagtatgcggctggaaacacggacggaaatgctggcaggagtctgcgtgaggaggggaacgaacagtgaaaataatctggggcatcttcaagcgggacatgtgccatgccacccgcaacgtgatcgccgtgatcgtctcgatgggcctggtggtggtgccggcgctgtacgcctggttcaacatcgcggccagctgggacccctacggcaacaccaaggcattgaaggtcgccgtggccaataacgacaagggttacaagtcggatctcataccggtgcgcgtcaacgtgggcgaaaccatcatcagcacactgcacgccaacgaccagctggactggcagttcgtgaaaagcgacaaggcaatcgacggggtgaaatccggcgaatactatgcggcgatcgtaattccgaaaggtttcagcgccgacatgatgacgctgttctcccccgacatcaaacacgcgcagctcaagtactatctgaacgagaaaatcaacccgatcgccccgcatatcaccgatcagggcgcgacaaccgtggtcaacacgatcgacaaaaccttcgccaaaacgattgcgcaagtcggactcgacctggcctcaagcatcctacactattcgcaaagcccgcaaatggccgaatacatgcgcaacctcaacggcaatctcaccaccatggcggatacgctgagcggcgcatcgcagcaggtgacgtcgtattcgcagctgctcggctcggcgaacgacatcgtggattccacgggcaaactgctcgcctcggcgaccaaggcgggcaaacaggcccagaacgcgttgaagcaaggcaaatcaggtgccacgtcactcacttctgcaggtgcgaacgtcacctcctcggtgaacaccgcgctcgaccaggtgtcaggcgcgttcgaccaagtagctgccaaggtgaacaaggcgttcgacgcgatcggcaaggactcagacaccgcagccagccagttggcaacgttgagcgaacaaatctccagcggcgaatcgctgtacgacacgtacatcacaagcctcaaccacatgcgcgaatcggtggaacaactaccggacagtgattccgcgaaacaggcgctgctggaagccatcgaccgggagatcacgctgctggaagccgccaaaggcgattcgcagaagctcgcgcagcagctgaaagacgcttccacgcaggtcacgcaagataccgcagccgcggaacgctcccgcaaggagatcctgaaccgcatcacctccgcgaagcagtcgatcagcaatgtgcgcgacgattacgccacgaacgtcaagccgaaaatcgacgcgctcgcctccacagtcagcacgctgatctcccaaaccgacagcatgatcacccagctgagcggcaccgccgacgatctggacgatgtgacgggcgatgcggggacgaatgtgacgtccatccgttccacgctcggcgcgatcgcgaagaaactcgactcgtcggcagcgacggtgaaggagctgatcacgaagctggagacgggcgggaacgccggtgacggcaacagcgatggtggcgacggtgacaacgacgccgattcgggcgaatcggacgaactacgtgcactggccaccgccaacgcgtccacactgtccacgctgatttccgcgcccgtcgcactgcatcgcgtctcggtgtacccgatcgcgaactacggttcggccatggcgccgttctatacgatcctgtcaatctgggtgggtgcgatcatcctgtgcgccatgctgaaagtgacaatttcggaccgcgagaaggcgcatgtgctgggcttgggcgacacgctgccgcgcatcgccggcccgtccggcccggggaacgcctcacgttggggactgcgtctcgaccacgagtatttcggacggtacgcgatcttcgcgctgctcgcgttgctgcagggcacactggtttgcctgggtgacatgtatttccttggcgtgcaggcgaatcatgcgctgcagttccttgccgtggggtggcttgccgcgctcgtgttctcgaatatcgtgtatacgctgaccgtgtcgttcggcgatatcggcaaggctgtggccgtggtgctgctggtgatgcaggtcgccggttcgggcggtacgttccctatcgagacgctgccgaagttcttccaaatgctctacccgttcctaccgttcccgcacgccatcgatgccatgcacgccgcgatggccggatcgtacggcaatgagtacctgcttgatatggtgtatctcgccttgttcctgattccttcgctgctgctgggattggtgttgcgcaagccggtgatccggttgaacaactgggtgagccgcaatctggagtccaccaaggtgatgtgacgaggcggatttgaacgggctggtttgagccggtttagatcggtttcggctggtacacgtgaacgcgctgcccgccatcatcgacgacctgaaaacccaaagccacgaattcgtcaccatcgaccagccggcaaaaacctaagctagcgtggaggcgtagggcattgtcctgcccagtcacttcccttacgtaccgctgcgccatcccggcgctcctctgcgccgccactaccccacatgtcgcctcctcacgcaccaacaagtgtccgaccccccgaatcagctacccacgcgtcatccggtcaccccaggttgtccgattcgggagaaacggacactcaggggcaccgtgcaaaccacacgttgatcagagaaccggcaaccaccagcacaacaccgatccagaacggcatgcccagcgccacgcccaacagaagcgtgctagaagccgtggaaaacagcggagtcgcgtacgaaccaatcgcaagcgtttccatactgccgtgcaacatgccgtatccccagcacgcgtagccgcccgaaatcgaagcggcgcacgcaatcagcgcagcatatccaccgatgccgggcgccgtgtccggcaaaccgtctcccgaaacgaaatggatggtccacagtacaacggccacacagcagaagaaaatcgtcgtgccgtcgtaaccgccggacaacgacggcgtaaaagtcgcataaatcgcccaaataaaggcgccaacaaacgcgagcacatacggtagggggttactggcgatattgtggaccgcttcctgcatatcaaggctttctccgccaaccgccatcgccacaccgatggttgcgatcaccgcgccaggaatcgctttggcgaccgcaccacgtttgtgcgataccgctgcggtcatcagcaccagcagcgtcggccacaagtagttgacaaggctgacttccacggattgcgcgttcgttgtggccaggccgatcgacagcgagattgacgcctcgtatgcgatgaacatgagtccgcctgcgatgaggtacttgcatggcgcttcgcggattggtttcggacggcgcacaatgaacagcatgacaccaccgacggtgtagatgagcgccgaaccgagcgtggcgccgaacgattcggagaccagtcgcacgaggccggccatgaagccccacaggacgattgcgaacaggccgatgagtgtcgccgcgtgtgatgtggcatggccgagtagcggattgcaggagttgccggtggggtggtttgcgccggaatcggagggggacttctggttcgtgttcacgggctccagcctacccatcgccctccacgagtgtccgattctgcagaatcggacactcctgcaacctgcgatgccgcgaacccgattacccccggaaccgcaccaacagcagagtcaaccaccccatccgacgctgccacaccagccgtatcggcagccaagtccatgcgtcccgcatccacacagccccacgcgtcccgcacctccacggcccgccgacgcgcacacgtcgcccatgaccaaatcatccaacgtcacaccgaacatgtcgcaaagcatcagcagcttgtcacaaacgtcgcgttccacgccaccatcttgcggttgcattgcgattcgcaaccaaattttgcgacgcaaccgacagttgcgcgacgcgaagttggcttcacgggtcttttacgacaatagaaaaacccttgaaattccaacgattccaagggttttgagtggagcggatgacgggagtcgaacccgcctttaaagcttgggaagctttcgttctaccgatgaactacatccgcaaggtgtgccttttgggcacgagccattagtctagcacgcaacggatgcgtatgcggacacagaccgacatgcgataccaattttccgcaatatcacggagactcaaccacgcggccgctgcgaatagtcgcgagaatatctgccagccgagccgcccgaatcatgcgcgaatccatactgcgttccaaattgcggcccaccggcaccagccatcgcagaacgtccgccttgccgaatatccgccgccgcaacgccgctcgtggcatagccaccggccaaatatccggactgcacgccctgctgacgcatctcctgccccatctgcatcagccgcgcaatgcgatccgaggtcggcgggtgcgtagaaaacagcttggagaagccctccgcggagaacggactggcgatcatcatcgcagccaccgactgcgtgccggcggtcttctccatcggcatcgcggctgcgccgccggaaatcttgctcaacgcggaagcgagcgcttccggatcctccgtcaacttggaaccgtcttcgtcggcgtcgtattcgcgtgtgcgggagattgccatctgtatcagcgacgctgcgatcggcgccagaatcgtgctcagcagcacacccagcaatcccaagccgccggacgccgaatcgtcgcggtcgtcacgcgaacggccgccgccgaaatacatgagcgagtagccgaggtacgagatgacggtggccatggcggaggcgattgcggacgtcagaatgtcgtggttgtagacgtgcatgagttcgtgtccgagcacgccgcgaatctcacgttcgttaagcgtctgtaggatgccttgcgtgcagcagaccgccgcgtgtcgttcgttgcgccccgtcgcgaacgcgttggggctcatggtgggggcgatgtagatgcgcggcatcggcttacctgccttcgccgatagctcgcggacgatcttgtatagtacgggggcttcctgctcgctcacctgtcgagcgtgcatgctggcgatcgccagtttgtcggaaaaccaataggagacgaacgtggagcccaggccgatgagaatgtagtagccgagcgtgctttgactggcgccggtcgcccaccagatgagcatgatgacgccccacatcaacgcgaacaaaagcgttgttttcaagccattgcaatggccgtgcacctgcaatttgccgttcatggccaccagcctaggaattcagactgggattttgctgtatacaagctgaagggtggatttgcaacatctagaaacatgccacgcaacgacgctacagcatcggccatagacctatctgcggcacggcgagagtcaccccaacttgaaacgtattaccctcgcatatcccccgaatgcactgcgtcgagcgtgccgatcaggctggtcagcaaatcgttgcggccgcacgcgttcgtcagcaccgccagcacgtacgtgcccgactgcgacatcaccagtccggcatcgttcagcgcgtacaaatcgccttcgccgttgatccatccggccttcgtgtacacggtgtccgcatcgccaagggccgcgtggatgcaggagttcagcgaattcgtcatgtctccggacagccattgcagcgattcgggcgtgatgttctgcacccccgccgtttgcccggcgaacaggaaaccgtatccggcggtccacagtttggccatgtcgcgcgcggaggtgaacaggtacccgccgcgatcacccattctggaagccgcgcccgcctgttcggcccacgtgttgaagcagtcgaggccatacgttttgtacagccagtcgtaagacgcgttgtcggaattgcgcaggacggcgtcgaccttctggtggacggtggcggactgcgcgtcagcggattgggccacgctgttcaggtcgacggtgcccgttgagaacagcgatatcaggtatggcgccttcgccgacgaggccgaatagatctgtgcatcggcgttgtatgcgatcgtgcggccggtcgtgatgtcggcgagcacgaatgatgcggtatatccgtcggcttcgaaagtggcgatttgagactgcacggcggcctgcgaatcggcgcttagcgcgaagccctgcgttgtgatcgtggcgctgccctcgactgcggaaatgccgtccagcgcgacctgcgtcggcgacgagacggcttgtgtctgcgattgcggcgcgctgtttttcttaagcgcgcccgacgtggaggacgtttccgaagacgttcccgaggacgccgctgcgtgggcttcctcttcgagatgcacatcgacaagacccacgcccatggcgaagccgatcaggcaggcgatcagcaggcccacgacggacacggaacagcagtacagtgccttgcgcttgacgtgttttccaaagttcatgccgacttcacaaccttagatttcaatgcccgcatccgtttgcgatgatattgcgcaccgcgtttcactggggtcagcctagcgcatggacccgaacttcgggggtaataggtcaaaacgaccgcgtatatccgattctggagaaacgggcggttgtgcgatcgaaaatgcacgctacgcgaccagtccgccgaaaatcgaccgctaaagcggcaaaaactaacgccctgcacgtccgattcagaggaatcggacgtgcagggcgttactagattgcgttaaaaggcttggagttagggtgtcaggaagtcagcactcccaccctaattccagccggcccgattcaggcatgcgccagcgcgcgcatctgctccgggtcgatgaccttcttgtgctcgcggccttccttcgcgccttcggcacgttcgaacgcatcgaccttcttccaaccggcgaagtcaatcggcttgactccacgggaggccagcagacggtcgatggattccggatcgcggtcagcggccacgcgaccgccttcggcggccttggacaggtcctccagcatgttggtgacgatgagcagcgcgtcggacttggtggagccgatcaggccgaccggaccacgcttggcccaaccggtggcgtacagacgctcacgcacctgcgcgccctcaccggaggcctccgtggtgatgcggccgtcgccgttcgcgttggccaggtgcgcgcgacgctcgtcgtacgcgatgcccggcgcggtggccggcttgtagccgattgcgtgatacacggcctgcaccgggtactcttcgaattcgccggtgcgagtcatcttgccgtccgcggaagtcgtcgtcttctccacgcgaatcgccttgaccttgccgtccgcgcccagcacttcgaccggagcggaattgaagtggatgtagtacttgcgatccgccgggttgccttcgaaatcggtgtcgccgtcgtcttccatgtcctcggccatctcgcggatggcgaacagctcctcgaccatctgacgggtcagcttgtccttgccggcctcctcgatggtgtcgtcgtccagatcgaagtcgtcctcgttgatgatcagctgcacacccggcagcttctccatctcgcgcagctcctgcacggagaacttggcctgggccacgccacggcggatgaacaggtgcagggtcttcgccttgttggccttgatgccctcgtacacgttgtccggaatgtcggtgcgttccttcaggtcgtcggcgttgcgcatcagctcgcgcgccacgtccatggccacgttgccgccgccgatcacagcgacttcctctgcatcgagcggccattcgcgggcgccggtcgggtaaccgtcgtaccattccacgaacttggcggcaccgtacacgccgtccaagtcggcgcccggcaggccgagcggcttgtcttcgacggcaccagtggcgaacagcaccgcgtcgtaacgttccagcagctcgtcaagcgtcacgtccttgccgaattccacgtcgcagtacaggtggatgtccgggttgtcgagcgtcttctcgagagcggatgcgatgaatttgatggaagggtggtcgggggccacgccgtagcgcaccaggccgaacggcaccggcagcttttcgaacaggtcgatgcgggccttggtgcccagtcccagctcttcgccgagcttgcccagctggcgcaggaaaatatcggaagagtagacgcctgcggggccggcgccgattacagcaatacgaagttcgttggtttcgctcatatgttccagcctaatatattccctgcatttccaacagggggcatacggcactttcttgcgattcccttacttgcctcgcaacgcgcagcccggcccatgtgccggcgcaggagaacgtacaatcgcagaagatcacaatcggtccctcactaaagaaggtccttatcgtaagagggtgggcatatgcgcattcacatcacgtataccggcggcaccatcggtatggtcgagtcaccgaacggtctggttccgggcgccgatatgcgcggctggctgcgccggctgattgaggacgcgcatctggacccgagcttgttctcgttcaccgagctggacccgctgatcgattcgtcgaacgcgacgcccgacaattggcagacgatggcggacgacctgcgcgcgcaccgcgatgacgccgacgcatttgtggtgttgcacggcaccgatacgatgagctattcgagcgccgcgctgtcttacgcgctgaccggtttcggcaagcctgtgattttcacggggtcgcagcatccgctcggcaaaatcgaatcggacgccaccgcgaacgtcacgggtgcgctgaacgccgcgatgagcggacgttttcatggcgtcggtctgttcttcggccatcatctgttcgccggcaaccgtgtgagcaaatcgtcaagctgggcgttcgaagggttttcggcgccgtccaccggcccgctggcacgtaccggcacgccgtggcattggtatgcgggcgattcggccggctccggttgcggttgggcgtcgccgctgccctactcccgtcacgatgtggccgtgatcgacatggctcccggcatttccgccgcgcgattggccgcgatgctcgaccctcgtccggaagcggtgctgttgcgcgcgtacggcgttggcaatgtgccgagcgacgagccaggactgaccgacgtgatcgccgacgtgctgcatgacggcgtgcctgtcgtcatcgcatcgcaatgccagcaggcggaagtgctgctcggccattacgagacgggcgacgcgatcgcccgcgccggcgcgatcggatcgggcgacatgacgctggaagccgcatacgcgaagatcatgttcctgctgtcgcagggcgtggacgcggccgatttcggcacgtggatacgccggaacatcgccggcgaaatctcgcccagctcgatgtagcacggcgcaacgcggttcagcctccgcacggctcgtcgccgcaaccggcgctactcgcggtcgagcagggcggtgagcgcccacaggatgctgaccacgtcgatcgcctcctgcatgaacgcgccgacgaccaccggaatgaggttgaacgcggccgcgaccatgccgataatcgccaatccaaggccgaccagcaccgcctgcagcatcactttcttcgtgcggctggcgatggcgatggcgcgcggcacggaggcgatgtcgtcgttcatgatgaccacctgcgccgattcggacgcggcggtggacgtgccgtcggtcatggccatgccgatgtccgcaaccgccagtacaggggcatcgttcacgccgtcgccgaccatcatcgtcacctgtcgggtcatggattcgccgaccacgcgctgtacgaccttgtcccacgccggctggttttggtgcgcgtcttccgtggcgttcttgacggccgcgaccttgccttcggggaagagttcggattgcacgtcgtcgatgccgacctcgcccgcgatgatgcgtgcggaagcctccttgtcgccggtgagcatggacagtttcttcacgccgagccggtgcagtttttcaagggacgatttcgcattttcgcgcggcacgtcacgcagcacgatgcgcgcggcgagcttgccgtcgatcgccacgtatgcggccatttcgtccggttcgagaggtgcgaacagcgagttcacctccggcttcttggaagcgccggcagcggtaccggtcgccgaatcgccaaccgcgctatcggccacagcaccagccgcagtaccggccgccacccctgcgcccagcacatgcgtgaagccggcctcgtcggccgtcacgtacgcgaaacgacccacgcgcacggcatgcccgttcacctcgccggacacacccttgcccgactgttcctcgatgttcttcaccacggggtaatcgcgtccatgccccggcagatcgcgttcggcgcacagccgctgcccgttctcatagcgcgcgtacagctcctgcatggccttctgcccggccgccgcgatgcccttcgacagaatgtgcaccgagtagccttccaccacgccggccatcatcagaatgtggttctcgtcgtacggcgagctgttttcgaacggcttctcgacgcgcacgacctgcggctgcttgacggtaagcgtgccggttttgtcgaagaagatatgcgatacgcggcccaggttttccagcacatcctgcgctttgataagaatgcccgccttggcaaggcgaccggtgccggccacgtacgcgacgggcgcggcgatcagcagcgggcagggcgtggccaaaaccagcacctgcgcgaatcgcaatggcgtgcctgcgacggcccacgcgatgccggcgatcgccagcgaaagaatggtgaacggcaccgccagcacatcggcggttttgacgacggtcgggcgcgattgctgcgccgaagacaccagttcgaggatcttctgatactgcgaatcctgcgccaattgcgtggcacgcatcgtcagcgcggtcgatccgttgaccgcacccgacagcacgcgcgcgcccgcatacacttcgcgcggcaccggctcgccgttgatattgctcagatccaacgtggcgacgcccgacagcagttcgccgtcgaccggcaccgtttcgcccggcagcacgaggatcacgtcgccaagcttgacctggtcgaccggaacggtttcgaaatgctcgccggccgcgtcgtaaggcttggtaccaggtttgtccgattcaccagaaacggacacataagcagcggaaccgccaacaccggaatcaccagccccggcaaccttgcggaacccaccctccgtcacgtccgccgcatgctcgccaccggtcgtatgcacatgaccgcgcacgcccggcaaggtcaccacatgagcggtccgcggtgctgcatcaaccagcgcggtcaggttgctttccgccttcgactgtgcgaattcctcaatcgcctcgccggaggaaatcatcagcaccacggcccacgcagcccagtattcctgcaccgccaccgtcgacgcgatcgcaataaccgcaagcagatccacaccgacgtgaccgtgccgcaaatcgtcaatcatgccgatcaccgtcaccacaatcgtgtacacgaccagcgcgatcacgatccactgtccgacgcccggattgaacggtccgaaagtcagcgagacgccagcggcctcccacggacgccacgaacccagcaatgccaacggaatcgcggcaatgatggcgatcggcagcagcggaacttctttgcaaatggaaatgattctacgcatgagaatctccttacgctcgtatcggacgccttgttaacccatcggcgtcccgcctgcgcggaccatcgatacacggcgtaaaaagatatttccagcataacagagcattgcgattgccgcggccgtttgcgtgtgcttccgttcgtcgcgcgcgttccgcgcatacgaaaagggccgtgcgattgctcgcacagcccttgttttccgccgtttttcggcttgttcagcgttttccgcgattacgcggattgcggttgcgacttcgccgtcagcctatcgggtggcagccacccgtatcgctgtcggcatgaacgccgcacaccgtacgttgccgtacgatgccgcgcatccggctttaccacagaccgaacggatcgaacaggccaccgccgtcgccgttgttgccgttaccgccattctggccgttctggctgccgccattctggccgttgccgttatcgtcgttgccgttgttctgctgacgctgttcctgcttgttggaggagttcgtcttggtctcttcctggtcgagcgtcacttcgagatccatggtgttgccgccgcgcacaacggtcagcttcaccttgtctcccatggcggaggcgcgcacgtaaccgagcagcgagtagttgttgttcactgcctttccgttgaacgccacgatggagtcgccggccttcacgccggccttggacgccgggccaccgtcggtcacggcctgcacctgggcgcagccgcgggtcacaccgtccgcttccaccgaggagctcttgatggtgatgccaagcaccacatgcttcacggaaccgttgtcgatgatctcgttggtcacgcgcttgacgaggttcgacggaatggcgaagccgatgccgatggaacctgccgtgccggacgagcttgcggtggaggcgatggacgagttgatgccgatcacctggccggccgcattaaaggtcgggccgccggagttgcccgggttgatggccgcgtcgatctgtacggcgttggtgacgatggcgttgttgtcgtcatcggtcacggtcaccgggcggttgagcgcggacacgatgccggtggtggcggtgtcgtcgtagccgagcggattgccgatcgccatgacggcctcgccgacggcgagattgtcggaatcggcgaattccgcgactttcagatcgctcggcggattgtcgagcttgatcacggccaaatcggtggtggtgtcggtgccgaccaccttcgcggaatagacggcgccgctggcgagcgtcacctgaatctgctgcgcgccggaaatcacgtggttattggtggcgatatagcccttgtcgctgatcaccacgccggagcccttggcttcgccgtcgctggtcgccacgtcgatggccaccacggaatcggacacttccttggccaccgcggtccaatcgaccgccgtaccggacttcgccttggcggaaccggaaccggacgtgttggacttgacgtcggacagcgagctggaggtcggcgcatgcacccaaccgttggtgatcgcggtgaagccgacgccgaggcacagcgcgccggacaccagtgcggccacaacggcggtgaccacatggctggtcatgccggacttctgcttggtgacgaccggcgtctggttcggctggttcgggaagccctgccccggagcgccgaacggattgcggttgcccggtcccgcagggggcatgttcgcgccgtactgcggctgctgctgattgttctgctgcgcgccgttctgcgcggacgagccgccaaacggattgccgaacggattgccattgttccgctgattgccggtcgtatacgggttgccgaaagcgccgaagaacgacggacggttgtcctgcggctggccctgctgctgcgcgccgtactgcggttgctggacggtctggccgctggcatcgccagccggcggcgtcggcaccggaccgtacgcgccgtattcgggcgccggacggtactgttcggtcggcgcatcctgcgtcgcgttgttgatcaccgtgcgttcaccggcagcggaagcataatccggcgtatcgtcagcggtattgcctgccgtgccatccgccgcgtccacggtaggaagggcggtggtgggctgctcacccgcgttcggcactgcaatcggttcggtaacggaagtctgtgcttcgtcggcgacgttctcgctcggcgtctgcggcgcggtctgctgcgtgccatcctgcggctgggcgatgttctgatcgctattatcttcagccattgttgctccttattcgtctcgcggcattcaacatggtcagcaatcgtgccgctcgaactgctatctaagagtaaagatacctgctctggaagtttcctgaatgtttgttgaaagtagcaatcgaatcgcttggcagtttgctccatacgatgccaccgtcgaccgccgatggcgccaccgcggcaatcggcgctatcgcatacagttgagagcatgacaagcttgaacgaaccacagaccggcgcggtggcgcacgagacctcagcggccaacgcggcagcccgcgcaacgcacgacgcagcaggcaacacgaccagcgcggcatcgaccgaaaaccttattgagcatccccgcggcgcggaacccggcaagcccggccgccgcgacgcattttactttgagcagaaaacccgcctgccagatgcggctgacggtaagggacgcggcggcgcacgatacggccgcaccggcatcatccacaccccccacggcgacatccacaccccggcgttcgtgccggtggccacgcaggccgcgatgaaagccgtgctgcctgaaaccatgaaggatctcggcgcacaatgcttgctgtccaacgcgtttcacctgtatgaacgtcccggtgaacaagtgctcgacgaagccggcggccttgccaaattcatgaattggaacggtccgaccttcaccgattccggcggtttccaagtgctttcgctcggcgcgggcttcaagaagacgctcgccatggatgtgaccggcatgaaatcagacgacgtgatcgccgaaggcaaggagcgcctcgcgttcgtggacgaggacggcgtaacgttcaaatcgccgctcaacggctcactgcaccgtttttccgccgaaatttcaatgggaatccagcataagatcggcgccgacatcatgttcgcgttcgacgagctgaccacactgatgaacacgcgcggctaccaggaacgttccgtggaacgcacctaccgttgggcgcaacgttgcgttgccgagcataagaggcttaccgaggagcgtctcggcaagccgtaccaggcgctgtatggcgtggtgcagggcgcgaattatgaggatctgcgcagacatgccgccgagcagatcgcttcgcttgatttcgacggcgtcggcatcggcggcgcgatcgaaaaacgcatcatcggcgacacctgcgcctggatctgcgacgcgatgccggaaagccgaccacgccacgtgctcggcatcgccgcggtcgacgacatcttcgcctgcgtggagaacggcggcgatacgttcgactgtgtggccccggcccgctgcggccgcaacggcgcgattttcacgcgccacggccgttacaacatcaagcgcgcgcagttcaagcacgatttcagtccgcttgaagagggttgcgattgctacacctgcacgcactacacgcgcgcctacgtggaccatgcgttgcgcgcccgcgaattcaacggtttcacgttggccacgattcacaacgagcacttcttcgtgaagctgctcgacgatatccgcgaatcaatcgacggtggctatttcaacgaattccgtgacgagacactcgcgaagttctacgagaacggttcgaagggctgagtgtgaaccaacgcgacgccgccgctgattcatcagacgttccttccagctcgtacccataaaccatgcatagaccatgccagccccacgtgcggaccgcgcgtcccgtgcacctcacgcataccccacggatgtccgattcgggagaatcggacacgtaaagcgcattccgcgctgatgatctccgataaatggaaggtgctgatcctgcgtgatctgttggacggcaccaaacgattcagcgaattgcgccgttcggtcggcagtgtgtcgcagaaggtgctgacggcgaatctgcgtcagatggagcgcgatggattggtgcatcgcgaggtgtatccggaagtgccgccgcgcgtggagtattcgctgacggaaaccgggcggacgctgcaaccgattatcgaggcgatgaaggactggggcacgcagtacaaggctgaacatgccgcctaatccggcctcttcactcccatttgccaatcgcgacacgccgatttgttacttaggatgaagcggtgtaaatttgtcgattgtctgcgagcgtggcggaatggtagacgcgctgtcttcaggtggcagtgagtgtatgctcgtgggggttcaactccccccgctcgcacgggccgaaaagggctggaatccaacgattccagcccttttgctttatccaaaacgtatgaaatgtgacaaaaaagtactaaaaatgcgccgaaagcccagctatctcagcagaaacagacaaacggacatccaaacccaaaaccagcaccacaaatgtccgattctccagaaaacacaatccgaataaccaattcggcagaatcgaacacatagccacccaaaaccacacttcacgtgaccggttggaaaaacagatacgtaacgcattgcagaccaatcccatgcgtccgattctgaagaaaaacgaaattcgccgtacgacttttccgcgcacgcaatcgcaagcatttcccggtatttcactgtgagcataaccgcggaatgagcaggacacggaagagttgggtgaagtgaaaggtcaaggtcaggagcccgggagggttccggatgcggcaacgaacccggtcgccgatctcgctggatggtgacgccgcagcgataatcgcacggccggctgccaagccgcattactccgcgcacagaacgcgcatttgcttaaggagtaccgattatggcaatgtttccggctttgatgaatgacacgatgttctccgatctgttcgacgatccgttcttcgagggttggcgcaacatggaccgcgcagccgcatgcgatccgaacatgtccgcaggcatgatgagcaccgatgtgcgtgagaccgacaagggctacatggtcgacatcgacatgcctggcttcaagaaggacgacatttcgctggacctgcagaacggctatctgaccgtttccgcgcatcgcaacagctcgcacgaggacaaggacgacaacggccgctggctgcgtcgcgaacgctacgccggctcttgctctcgtagcttctacgttggcgaggacgtgaaggattccgacattcacgccagctacaaggacggcaccctgtgcctggaaatgccgaagcccgaagcgcagcagcaggttgagaccaagcatcagattgcgattgaaggctgattttccagctgccgtacgtcatattcgcacgtcgtaagtcacggtaatcgctaagcaaagcgaagccggacgcccgtaagtggatgtccggcttttttgtttgtccgcacgccgccgcccgaaaagcaacgcccgtcacggcacttaacgcaccaaaaacaccatgatgagaatcatcacgaatccaaccaaatcggtcggttcgaacaccgcgtccgtccatgccaccgcggaaatcgtggccatcaccggttcgctggtgccgagcatggtggcacgcatcgaaccgacgcgcaccacgccggccatgtacagccagaacgcgccgaatgtgccgccgatcacggtgaacgccatcagccccacacccagccaatccaactgcggcgccgtagcccacggccgcacgaacggcagcagcacaagcccggaaatcaggaacgcgatgccattgacggtgaagttgccccaacgttcgatgagcttgaccggaagaaacaccatggccgccgtggacgccgcgttgatagcgccccaaatcaggccgaccaacggcagtttcagcgtggtgaagtcgccgccggtcgcaatcagcacggttcccgcgaaggcgagcgccacgccgatgccttcccgtacgccgggcagtcgccgcccgcgcaggcatacgacccccaagacgaacagcaggttcaggctttgcagcacggtcgcggtgccggagttggtccagttgatcgattcgaggtaggcgacctgcaccagcagcacgcatatgatggcggtggccagcagccgcggatatgatttgcgatcgcgtagcgcgccggtaagcagtttcggcgtcatgatggccgagcaggtgaggaaaagcacgccggctgccagttcgcgcacgcatgcgatccacagcggcgaggcatgatacgtgcccatgaggattttggagacggtggcgttgacgccccacagcacgccgccgcacagggtcattgcgatgccgataatcaggtctttcggcgtgcgttcgaacgttttttccgccactgcggctccttccccttcactgttcgctcatcgcacaccgtacacgccgcatgtgtcttgcagtggcagccgctcacagactgtccgcgggcgcgctgaggaagtcgagaatcttgttcacatacggtccgaccaccgtgttcggcatggagaagatctcgtgcaacgacttgccgtaccgtattttttcgattgatccgccgccttcgcgcacgcgttccacgaaatcgtcctgcggaccgttcaggacccagacgtcacggcccgcttggaacagcagcgtcggagtttcgatcgcaccgcacatgtccggtttgagtacggctcgagacaatgccatcgcctgatgcgcccattcgaaggtggccgcgttggtctggcatgccacgtcgtcgacgcgctgcttgtggaaccagcgaacgcgcgcctcggacgcgcccttatgctcgtcgagatcgagttcgggggaaaaatcggtgtgaccgaatacgcgcgctttgccgaatcccaagccgcacaacgcgcctgtagcgatgcgtgcgatccatgtcggcatgccgacgacgggggcgatcatgggtgcggacagcacggccttgtcgaacaggctcggatagtgttccataacggccgcgccgatgccgccgcccatcgaatggcagtacaggttcagtggctcgccgcacgcgtattcgcggcccacagtgtcggcgaaggctgcgaaatcggccacgtaccgacgccaatcgtcgatccacaccaggctgggattgctcacgtcgtgtgcggaatggccgtgcccgcggtgttcgaggatgcatacggaatagccggacagcagaaaataccatgccatctcgctgtattttcgcgcgaattcggtgaatccatgcgagatgaccaccacgccacggaacacgcccgaagcgccgtcctcacgcagcgcatcgaatttggccgcgtcgtaacagcaatagtgcaaccggccgggttcgtccagtttgggcagcgcgtcgccgttccagtcaacggtggctggatccatccatccttccgtcatgcaggcgtccagcgcgggcagcaccttgctttccatttcggcgtcgtaattcgcctcgtcgagcagcctaagagtcatgctttcatcatacgaatcccacatgaacagccttcagagccccacgcttcggctccacggatcgaacgcgcctcctcactcgtggacgcgctcccccgtacaatgtcggtatgaaaatcatgtcattgtgtgtgtcattcgtcatgctctgcaccatgcagccagccggaacgatggccccttccaacgggaaggctgccatcttcgtcgacgcggcgagaggaaccgcatccgccatcatcgactgcccgccgccgctttactggctgtgtggaaaatgagccatgcgatgaatcccacgaaatccgcagcttccataccaaaaatccaccgtgtagcgctggtcgacaacgatccgcgcgcgttggaatcgctgagccttctcatcgaagcgaaggtccccacggcctacgtggtgtggacggccacttccggcgacgaagcgatcgaacgttgccagaggaacgacgacaatctcaacctgcttgtattggacatgtccatggagggcttgcaggggccggccatctgccatcggatccgtctcatggacaggcatctgccgattctgggcatcaccagcttctccatcaacagctaccgtagcaggctgatggaagccggagcgcagggactgatcggcaaggaggattccgatcagctggcgaaggccatcgagcggctctgtggaggcaacgttatggagggattcgaacctcccgccctggccaacgtgcgcatcagacgcgaggaggagacctcaccgcggctcaccgtgcgcgaggagcaaatcatctccctgtgcgccgacggcatgctggacagggagatcgccgaacaactggacatctccgaaaacaccgtgcgcaagcatatgcagggcattctcaagaagctgaactgcaagacggcacgccaagcagtggcattgtgggtaagatcgcatgcacgctgaacccacaaaacccagacccgtaagcgccttccgctcctggcacaaccatatgcgtgccgaccatccgaaactctggcatccgatccgcataaccatcgtggtcatcaccgtatggtggatcctgttctgcctgctgctcgccccgaccgacaatcccgcggcgatcgtctggaccatcatcgaaatcgcggtgctgctgctgtcaccgttcttttcgaaatcgatgtcgctgctgtttctgatcatgagccagtcgggaccttggctcatacccggagccgacgtcaactcgctgccgggaatcctctacacgttcggcatgctcgcctacgaaaccaacaaccttgtggcgctgctgctgctcgcttattccataggcgaccagctgttccgtcaactggtcctcggcacgagcaacagcaatcccgtggccatcatcgccatggtcagcctggtactgatgctcggatgcggtttgcgatggaacgcgaccatgaccgccagccgcgcggaggcggagcaggcgaagacgcgattacgggagatggaaagccgcaaccacatcgcggaagccatacacgacgccgtgacgggagatctgtccgccgcggctttcgtcgcgcaacgtcgcatcgatgcattgtccggcggagacgatggcgatggcagcgcctcgacggatggtgacgacggcaagaacgcggacgaaagacgcgatgagctcgacaaatggacgcaggtcaacgattacatcctgtccgccctgaccaacgtgcatcgcgtcatcgacgaactggatatggacgtcaccgtccttgaggaggatgcggacggcaaggccttctccgacctgctcaaagccacgatggccgacggcgactggcgtctacgcgcgctcggcttcgacatcacctcgatcctccatgtggcgggcggtgcgccaagcgcctccccgagcctggccggaatcgccaatgatctgcttcgcgagacctacgccaacatcgcgcgtcatgcccagtccggcagcaaagccgacctgtcggtgatactcaagccgaacgccgtcgaaatcacgcagatcaaccaggaaagagccttcccgacggagggcatgcgtccaggaggccacggcctcgcgtatttcggcaaacagctcgaatcgcatggcggcaaactcgaaacgacgcttcacgacggcgaatggacgctgttcgcctatctgccgattccggtgcccgaaaccctgccaccccttgccggacaccccgaatcgtgaccggctccgacggtcgcgagaaacgaaagggtacttcaaagggtgctacacagatgtggtacacccttacttgcagaggtgcccgtcaccgtcctatcttccctaatgagaagggatatgcgtctccctgtgacacgacggatacttggcagtccgtcgaatcgcagggggacgcgttcttttttttcttcggctttatcggaacgatggttttaccaggacggtggcttcaccggaacgccgtcaggccagcgcgtcggcgaggaagtcgcgctgcagcagcaacaggttgcgcgccaccgtctcgtcgttggtcatgtgcgtgatgccgttgagcggcaggaacgtgtgcttcctgccggccgccatcagcgcctggctcaatcgcaggctattggcgatcgtcacattgtcgtcggcgaaaccgtggatgagcataagcgggcgactgagtttcggcgcgtccgcgacgatgctgttacgttcgtacgtggccgggtcgagtcccaggtagcgctcggtgtaatgcgtgtcgtacagcgtccagtcggtcggcggggcgccggcgcaggccgcggcgaatgcgtcgggcgcgtccagcacggcgagcgcggataggaagccgccgtacgaccagccgatcatcgccaccttgtccaggtcgggtttcggcatggagacaccggtttcggcggcgagcgaggcgatcgcgtccggcagcgcatgcacggcgtcgacttggtcctcaagcgtcacggctttcatgttttcgtagatcgcgcgatcccacttcggtccgcggccggtggtgccgcgaccgtcggcggtgaccacgatgtagccttggtcggcccaccactgcgcgtcccagtagaacgactggctttccacgacctgctggaaaccggggccgccgtaaggcttcataaggaccggcaactggtcggcatgcgcgtatgcgctgtcggccgacggcaggatgacagccgcgtacaggccacgttcgccgagtcgggtgaatcgcacgttcggtgtgaaaccggggatttcagagtggttttcgattggcgagaccaccatcgacatcatttccgcgccgtccgcaacaccgtccgcaacgtcgccttccgtcgtgcgcacgttcatgcaatgctgcatctgcgaccgcgcgtcgtccatgccgcgcccggtcaccacgcaaccgtcgccggaacgggacatcgtccattggccgggcgtgcaggtgagcggctcccagtcgccgtcgtaacggatcgagaccacgtcgaagctgcgggcgtcgtgatcgtccgcgttggactgccacaggaacggcagatcggcggccggcagcagttccggcgtgcgctgcaccacgcacagcacgtcgttgtcggtcacgtcgagcacttcgcgcacctgcaggcccttgggtgtgaatggcgtgccgtccacggtcagacggttcgtgtcggcgtccatgtcgttcatcgcgcacacgagacggccgtcaggcgtgtatgcgggggtgccggcgatcaggtcgagccagcagtcgttgctatgttcctcaagcacgcgcgtggtgccgggttcttcgccgggcgcgtattcggggatggcgatggagaaggtctccacttcgctgccgtcctcgtcggtgaagccgttttccggcgcgctcatggtcacgataggctcgcccacgtggacggcgagcacctggtcgtgctgctgaagccggtcctgcacaagtagcagcggctcgtggccttcggtccagctgacggcggccaggtattcgtacgattcgcggtcccattccacgttgtgtgcgatgccgccgtagtagcagccgtccgtatcgtagccgagttccagcagcgtcagatgcacgtcggcgttggccgtcatcgcctgcggatagcggcgggcctgcgcgggtttcgtcggatcggccgggtcggcgatgtaccaggtctgctcgtgggatgcgtcgaaggtttcgaagagcacatacttggaatcaggcgaccaccagaagccgtcgtaacggtccatttcctcacctgcggcgaattcggcgagaccgattttccattcgcctgcttgcgattcggccgcgtcgctttgcgcgtcatcttgcgtgccgtcctgcgtatcggcaacgtcgtcagcgtcgtcttgcggaacggacgcgacgatggacaccgcatcgcccgcgtcttcggctgcgtccgtcgtgtccgacacgtccgcaagatcgacgtccaccaaatacgtgccggtcgtatacatgatatgtcgtccgtcggggctgatgcgcgggttcagcaccggcttgaattccggttcgtcgatggcgatgccgcgcgtcacgccggccgcgatatccgtcaggaacagctggccgttgatggtgaacgccacgcggttgccggccgcatcgaccgaatagccgacgatgccggaaccaccttcacgcgcacgttcgcggcgcgccttttcctcagccggcacatcctcggcgtcggcgtcagccagcagcgtacgcggatcggcaagcagaatctcgtcggtatcgccatcgctgccgatcacgctcatccacagggaggtgacggtgtcctccggaccgtccgaacgcaggaacagcgcacgcgaaccgtcgccgatcgcgcgggcggaacgtggcgcgccgcaggtgaatcgcaaggtacgggccttcagcccaggaaactcatcaatcgcatcattcataccttccaatctaccgaccatcacgcaccactcgccgccaataccccggacgcaacccccttcacatgaaatttttgcaagcaagtagccttcgaattggcgctcggcaggctacagcgtaggatagtcaaggacagaaagggacaagtatgagtgttctcgaccgatttgagaagagcgtggaaggcgccgtcaacggggttttcgcgaagttcgggtctaaagacctgaagcccgtcgacctttccagcgctctggaacgcgagatcgacaaagaagccatgcccgtcacgcgcgatcgcaccgtagccccgaacgagtaccgtttcaagctcagcactccggatttcaacaacatcgtcgagtggggcgccgaaacgctcgccaatgaacttgccgacaacctcacccagtatgcgaagagccagaactacgcgttcgtcggcccggtcgtggtgatcttcgaagaggatcttgaactttccaagggcgattaccggctttccagcgaatccgtgcagggcaacaccgtgccggtcacgaccgacgcgcagaccgaggattgcccgatgctggagatcggcgagcaccagtatctgctcaccgaggaaaagaccatcatcggccgcggttccgattgcgacatcgtcatcgacgaccccggcatctcccgtcgtcacatggagatcgacgtcaccgacaacggcaacaccgtcatcgcccgcgacctgaactccaccaacggcatgtacgtcgaaggccatcatgttgaggcggcaacgctgctcgacggcaacacgatcaccatcggccgaacccgcatcctgtactgggcctcctcgcaggagcaggagtaatcagccccaacccggagagccgccttttatgctcactgaattaacgtttgcgatcctcaagtacgggtttctcgtactgctttggatcttcgtggcctgtacggtacgttcgctgtacagggatatcgaaacgctcagcccgcgcaagtcgcgggctcatcgtcgtaaggagcgtgccgcgcgcaaggccgtcgaatcgcctgcgcccgtagccgccgcagccccttcggcaagcgccgcaaccaatgccaaaccaactctgctggtcattatcgatggcccccttgccggcagttccgtccctctggccggcaacaccatcacacttggccgttccgcttcgaacaccgtggtgctggatgatgaattcgtttcctcccaccatgcgcgcgtctacaccgatcccgccaccggccgttgggccatcgaggatctgggatccaccaacggcaccgtcgtcaatcatcagcgtctgaacgcgccgatgattcttggcgcgcgcgtgcctgtgcgcatcggtgcgaccaccttcgaattgaggtgacgtttttgccgacttccaccgcttcgcaacaattgttcatgtattccaccgtcgtctccgacgtgggcaccgtgcgttccaacaaccaggattccgcgttcgccggcgagcatctcatcgccatctgcgacggcatgggcgggcatgccggcggcgacaccgcctccaccatcgccatccggtcgctggcgcatatcgaacaggacaatgttgacggcgacgtgcaggtcgtctcccatatgatggcgacttccgtcatggccgcgcacgacgcgatcgtcggcaaagccaagcgtgagcgtcgtcttgccggcatgggcaccaccgtcacgtccgtggcgctggtcgccggctgctgggtattggcgcatatcggcgattcccgcgcgtatctgctgcacgacggccatctggtccgcatgaccagcgaccacagctacgtgcagcatctcatcgacaccggccgtatcagcgaggccgaggcgcgcaaccatccgcaacgcaatgtggtgatgcgcgtgctgggcgatttcgacatcgattcgcgccctgacatcgccatccgcaaggcgcatccgggcgaccgttggctgctgtgctccgacggcctgtgcggcgtgctggaggattccacgcttgaagaagtgctgtccacctgcgccgatcaggaggagtgcgcgcagcggctcgtatcgatggcgttgcgtgcgggcagcaccgacaacgtcaccgcggtgatcgccgacgcgacgctcgcgctcgacgcggacgcgttcgacctgccgcatcagacgccgctggtcggcggcgcggccagcgcaagcttggaaaccatcgcggacatcgtcaacgaaccggtcgcttccgccccgcctctgcgcgaaggcaaacagtcgccggcggcgcgtgccgcggccctgcgcagcggcaaggatcccaacgaggagccgaaacagccggaacagcgcgtcgcgcagccgtcgtcggtccgcgaagacaatggcgaccgtgtcaataccgataccggggaaattccgattgtgcagaagcgcaacgggcgtatttccgccgatccgaacgatccggaagtcgccaaggcgattcgcaacgaacatatcgaggaacgtaagacgaaacggtcgcgcaaattccgcaaccgcatcatcaccatactcatcatcattctggtgctgcttggcgttgccggcgtgggcgtgggcacctaccgttggagccaaaccaagtactacatcggcgacaacaacggcaaagtggcgattttccaaggcgtgccgacgagcatcttcggtgccaaactgtcacatgccgtcaccgacaccaatatgaagaccagcgatctgccgccaagctggcgcgaacagcttgaccagggcatctccttcgacacgtacggcgaagcgaaaagccatacccgtctgatcaaaaagcagctgaacgatgcgaagcgcaagcaagaggcgaggcagcaggagaaggccgaagccgagcagaaggcgaaggacgaagcggcgaaaaaggccgccgatcaggccgcgcagaccaacaagtcgggcggtgacaagtcatgatcgcaacacgcttgagacagcttggcatgctgctgttcagcatgctgctgtgcgcggtggcgttcttccagatgtttgaacgcaccacgaacggcttcccgcaaaactatgtgtggatgctcgcgttcgtaagcgcgctgttcctgaccacctggggtctgctgctgcgattccagccgcacgccgaccaatcggtcatgtgctgcgtgctggtattgacgggcatcggcgtcacgatgatcgcacgcctcgaccaagacaccaaaaccacagtggcgttccgacagttgctttggttggcgatcgcactggtgtttgccaacctgctggtggtgttcatgagggattaccgcgtattgcggcgattctcgtacgtcagcatggtgatcggcatcgtgctgttgctgtcgccaatgctgccggtggtcggttccgaacagtacggcgcacgcatctgggtgaagattcccggcttgggatcgttccagccgagcgaattcgccaaactgttcctggcgttcttcttcgcttcgtatctgttcgaccatcgcgaccagcttgccgtcggcggaaagaagattctcggcatccaactgccacgcatcaaggatatgggaccgatcatcgtggtgtggatcgtctccatgggcgttctggtcctgcagcatgatctgggcacgtcactgatgttcttcgccatgttcgtgtccatgctgtacgtggccaccgggcgtaaaagctggatcgtcatcggattcatcgccttcgccgccggcgcggtggcggcggcaagcatcttcagccacgtcggctcgcgtgtggacgcctggctccacccgttctccgcggctcaatacaacaaggaatacggcggctcataccagctcgtcaccggcattttcggcttggcttccggcggtctgatgggcaccggcctcggtcagggccacccgtcgatcaccccgatcgcaaattccgactacatttacgcggcattgggcgaggagctgggattgaccggcctgatggccattctcatgctgtatctgctgatcatcgcagccggcatgatcaccgcgatgaaaatcaaggacggcttcggcaagctgcttgcgtccggcttggtgttcaccatggccttccaggtgttcaccgtggtcggcggtatcacgctggtcattccgctgaccggtctgacgcttccctacatggcagccggcggttcgtcgctgatcgcaaactacatgctggccgcgctgctgatcgtcatctccaattccgcgaacaggccggaatccgagatcgacagcgacacattccagcaggaagccgtcagggtgttgcgcgaacgcgagcggaaccgtcgtaccgaaatcgccggcaatacgcgttcgggtgcggcgaaggcttcggccatcccggccgtgcgggcaagccatgcgggcgcagccgggcaagcaggtcatgccgtgcccgccaatcgaaccagccaagccggccacaccagccaagccggccacaccagccaagccggccagaccgatcaatccaatccgacgattccgataaccggagtcctgccgacgatcgaccagcaaggagcatcgcatgaataagtcgctccgccagctgttcaccatcgtggtggccttattcgtcattctgggcatgtccaccaccatcatcatggccatccgagccaaccagctcaccaacgacgcacgtaacgtccgcgcgctgtaccacgaatacggcgcaccgcgcgggtccattctcgccgcggacggatcggtcatcgcaaaatccgatccttccaacgattcgttctcgtaccagcgttcctattccgccggcgaactgtatgcgccggtcaccggattcttctccatcagccagcgtggctggagcggcgtcgaagcgtcccgcagctcgctgctgtcgggccagtcggagcagctgctctggcagcggttcaagtcgctgttcaccgggcaggagaacaagggcgccaatatcgaaacgtccatcgatccgaagattcagcaggccgcatacaacagcctcggcagcacggatggcgccgcagtggccatcgagccgaaaaccggccgtatcctcgccatggtcagcacgcccagctacgacccgaaccagctggccagccatgacatgagccaggcgaacagcaactacggcgtgctgtcccaggacgccaccaatccgatgctcaaccgagccacttcgcagctgtatcctccggggtccacgttcaaaacggtggtggccgccgcggctttggaaaccggccaataccagccggatacgcagattccggcaggagcaagctacacgcttcccggcaccgtcacgcaactgaccaacgccgtaccgcaggccgacggcgctgacggcaagatctccatggaggacgcgctggcatattcgtcgaacaccgcgttcgcccaattgggcgtgtcgttgggcgacaacgccgtctcgtccatggccaagaaacttggttttgacagcccgatcaccgtggacggttccgattacaccggaaccccgtgggtgtcggtcacgtcgaagttccccaccgacatcaacgacgacaagctcgcattggcgtctatcggccagggagacaccgtggtgacaccgttgcagaatgctatggtggccgccgccatagccaatgatggcaagcttatgcagcccacgctggtcgaccgcgtgcgttccgccgacttgtcggtcatttcgcagaccaagcccacggtcatgtcccatgcgttcagtgcggatacggccaacaagctcacccagatgatggaggccgtggtcaccaaggagaacacgaatctggccatcaacggcgtgcaggtggccgtcaagacgggtaccgcgcagattggaaacggcaatacgtccatcgacggctgggtgatcggattcgcaccggcggacgatccgaagatcgcggtggcggtcgtggtgcataacgtggacctgtacggctcgttcgcggcaggaccgattatgaaagcaatgatgcaggaggcgctggcagaatgaaactggttgaaggacagctcatccaccgacgctacaggttggattcccgcctggcccaaggtggtatgggtgaagtgtggaaaggctatgacatccaacttggacgtccggtggccatcaaggcgctacgtggcgatttgggcgtcacccaggaggccaaactgcttcgtctgcgcgcggaagctcataattccgccaatcttgcgcatccgaacatcgctgcgctgttcgaatattacgagcatgacggcatcggattcctcatcatggaatacgtgccgagcaagtcgcttgcagacctgtaccacgagcagaacggcccgatggacccgatcaagctgctgccgattctcattcagaccgcacgcggcctgttcgtcgcgcattcccatggcgtgatccaccgtgacgtgaagccggcgaacatcatggtgtccgattccggcgaggtgaagatcaccgacttcggcgtctcctactccaccaaccaggagcagatcacgcaggacggcatggtcgtgggcaccgcgcagtacatttccccggagcaggcgcagggcaagcatgccacgccgcaatccgatatctattcgcttggcgtcgtcgcctatgagggcctgtgcggacaccgtccgttcacgggcgccacaccggtcgacatcgccgcagcacatgtcaataatccggttccgccgctgcccgacaccgtcgatgtgcagttgcgtgaattcgtcatgtcgatgttggccaaggacccgctggaccgtccgaaggacgcgctggtggtgtcacgcaccctgtcccgcatcgaacgccgtctgctcgaccagcagacgcagctggccgacacgatggtcgtctcttcgggaggaaggcttccccgacgtgtggtcagcaaaccccatatctccgtgagcaatgattggaaggaacagggatgaacatcaacatgcctacctctctggccgggggccgttatcagctcggccaactcgtcggccgtggcggcatggccgaagtgcatgtggcgaccgacacgcgtctggggcgtaccgtcgccgtcaagatcatgcgcgccgatttcgccactgacagcatcttccttgagcgtttccgccgtgaagcccattccgtcgcgcagatgaacaacccgaacatcgtgaacatctacgattcgggcgaggaaaccgtcaccacggaaaccggcgagatcgagcatctgccgtatctggtgatggagtacgtcaagggtcagaccctgcgtgacatcctcaaggtgaatggcgcgctgagccagcgcgacgccgagcaggtgatgatgggcgtgctcaacgcgctcgaatactcgcaccgcatgggcatcatccaccgcgacatcaagcccggcaacatcatgatttccgagcagggcgtggtcaaggtcatggacttcggcatcgcccgcgcgatcgacgattccgcggccacgatgacgcagtcgcagggcgtcgtcggcaccgcgcaatacctgtctccggagcaggcgcgcggcgaaagcgtcgacatgcgttccgacctgtattccgccggctgcgtgctgtacgaaatgctcaccggccggccgccgttcaccggcgattcggcggtggcgatcgcctaccagcatgtgtcggaagtcgccactcccccaagcacgatcgtgccgggcctgccgaagatgtgggattcgatctgcgcgaaggcgatggccaaggatcggcagaaccgttacgccaccgcttccgagttcaagaacgatctgctgacgttcatgaacggcggtgtgccgatggctgccgcgttcaacccgttgaccgacctgaccaacatgaaggcccgcaagcaggccgaaatggatgccgccaccgtgcccatggcgccggcgacggatgcgccgacgcaggcgttcaacccggtcaccggccagttcgaggccgtgccgaatccgaatggcggagtcgaaacgaagacccgtgcggaacagcgtgccaaggccgcgcaggagcgtaagaagaagcagatcatcatcgcttccgtggtcggcagcatcgttgttttgctggccgtcatcggtattttcttcgcgttgaacgggcataagaacactgcggatctggtgtccgtgccggacttcaccgacacgtcgaacatttcccaggcgcgtgtggaagaacagcttaaggcccttggtctgaagcttgacgcccgtgacgatgccacgtccagccagccgaagggcaccatcaccaagcagaacccgaagggcggtaagaaggtggcgaagggctccaccgtctccgtatggttctccaccggcccgcaggcggtcagcgtgcccgacgtgtccggcaagacgcaggaggaagcgaagggcattcttgaggcggcaggcttcaagatcggcaatgtcatgaccgtggacagtgcctccatcgagaaagacaaggtggtgaacaccaatccggccgcgaattcgaagcagaccaagggcaccatcatcacgctgtacatttcgtccggcatgaccaagattccggatggtctggtaggccaggccaaggattcggtcatcgcgcagctcaagcaggctggtctgacgcagatcaccatcgaaagcgagtattccgattcggtgcagtccggtgcagtcacccgcatcgatccgggttccggcagcaccgtcgaggcgggaacggccgtgaccatctgggtgtccaccggcaagcagcaggtgagcgtgccgttcgttgccaactccacacttgccgaagcaaagagcattttggaggccgccggattccaggtaagcgtcaacgggccacaggacgacgatgcgaccgtcgtgtcgatgtctccgaatggcggcagccaggccgacagcggatcgaccatcacgctgaccaccaagaagtcatccagcgacacccccagcaccgacacaagtaacggcaacaacagcaacaaccaacaaggcaactaacaaaatcaggggagggagcggctcaaagccgctccctcccctttctctttccctcaaaaaacaaaagcagccgaaggcagctccataaagccaaaggagctttgcttcccgcaggtcctgttcacgaccgtaagcttggccgaacggccttgagtgtgtcgtgaacaggacctgcgggaagcaaagcggcgccgcaagcaagcaacgctgcgagccaaacagcagccatcacccatcactcattcatcgcaaaaatcgcaattcagcaagctcaaaaaaagaaaactactcgctcaccttaggctgcaatccaatcgacttctcaaccgcggaatcctgcccgcacaccttcagccagttggccagcagacggtagccgtcctgcgtcatcacggactccggatggaactgcaccgcgtacatcggcttgtcgcgatgcttgatgccctgcacgatatgatcgtcctgcgtccacgcggtcaccaccagctcgtccggcacggaatccggttcgacagccagggaatggtaccgtgtggcgaccatcgggttggcgacgccttcgaaaatctcatcgtcgatatgctccaccaaactggtcttgccgtgcatgatggtcggcgcgtggctcactgtggcaccgaacacttcggccaatgcctgcatgccgaggcacacgccgaacatcggcttgttctgtgccgcgcacaggcggatcatgtcctcgctggcgccggattcggccggagcgccggggccgggagaaatcagcacgccgtcgtattcgtcgatcacgcccggggtggacgggtcgatcgcatcgttacgtaccacggtcactgtggcaccaagcgtcttcacatagccgacaatcgtgtaaacgaacgaatcgtagttgtccacgaccagaatacgtgcggaatcggtcatcatgctccaatcaacgtttgaacagcagtgtacgtgcgttccgtgccgcagcaacgtccgcgtctcacgcagcggcagcctttagatggccgtgtagttcgacatctcctgcaacatcggaatagtcgacgcggcccacgggaacagccattcgaagcacgatgcggccgctgcgaaaaccagcagcagcaccagcagcagacggatcggcagcacgcccggctgcagtcgcaccaggctgccgtacaggctgaaatcggccttctttcgtcttcctgcgcgcacgtcggcgagatacggccatcgccaggcgacggcggcggaaataaatatgatcacgtatgcggcgagcgcgccgaagatccacggtttcagcgtatcgatcgacgacaggaacgacgactgttcgttgttgacgaatttgactgtgccgttggcgttttgggaggccagttcctgtgggatgccgtcggagaccttcgcccagtaggagaattcggcgtagctgatccagcggtgcgtcggcgtggagtatttcggttcgcaggtggtcatggtcagcatgcgtttggtcggtgttgcgccggggttttcggggttggccgccaccacttcggtctgtgtcggcagcacgattttgtagctggtgtagtggtacacgtaccagtaatcctgcgtgcggacgatgatcgggtcgccttcctgcagtttgtcgacgtcgccgagcggctgcccgtagccgttgcgatggccggcgaaggcgaagttgccgatttgtccgggcatctgcgaatccgtgtaatggcccaatccgtgcttgttgagctgtgtcaggtccgtgccttccaccaggttgcgctgccattggctgccgaatcgcggtatgtagatttgggcgatgagttcgccttccgtggcgctttgcggctgtacaggcgggtcaccctgctgtgccttcgccacggtgacgttgccggactttcctggatcggaccaagatacggattggcgggtttcgatctggttatgctccgactgcacgcccgtccaccacatctgccatgcgatgtacagcgcgcagatggcggcggcggtcagcatgagttcggcgaggatgccgagtatcgtccacagcgcgcttttggtgcgtccgccacggcttgccacatgtttcatcgattgttatttcccctcttgcgagtcgccgttcttgtcgttttcgagcgctttcgcatactgcaacggctgctgcaacgcgtcggtcgcgtcgaaatgcagtttcgttttctcgtcgacctgccatcccaggccgaacgcgctcacgtactgcttgtagatggacacttcctcggaatcgtcgagcgcttttctcatgccctccactggtccgatcgccgagattttgaacggcggcgaatacttcttgccttgcagcagcagcacgttgccggagcagcgtacggcggagttgaacaatacgcgctggtccatgatctgcatggattcggcgcctcccgcccacagcgcgttgaccacggcttcgatgtcctgctggtgcaccacgtaatcgttgatgttggcgctggatccgttggcgtcgaccatgttctcccatagcggcgaatcgtcgagcgtcaccaccagtcccgggccttccacggcggggagcatggtgccgttgccggcgctttcgctgtcttgcgatccgtcggcgttctggctgtcgagtgttttgctcagatcgttgactctggtgctcagcgcatcgatttcggaccgtagcgagttcacttttttcacgcgctgttccacgagttcggcggtatcgttgctcaccaccacggaacggttgacgcgcaggttggtggacagcaggaatccggagaacagcagcacgaggaacgccgcgacgccggccgccttcgaccgtttcgcgctgtgctttccggtatgcttcgccatacgcgcctttccaaacctgcctgaatccgccgggtttcactgaacaattgtcctgattttgaacagttttacgccgtgagttcgccgctttcgagtctacccactattatgacttttagcctattaaaggagactatgctgatggctgacgaagagctgcacgaaaccaccgcggatgaccagaaggatctgcagtccgccgacgacaccgctgccgtcgaggaaaccaccgaagatgtcgtcgacaagacttccgttgacgaggaccagtccgacgatgacgatctcgatattcctatggaccgtgtcgaagcggtgctgaacgccaccgttgataaggattcgctgtcaccgcagatgcaacgcatgatgaaccgtcaggcggagaacacccgccgtgtggaggaaagcatcaagggcaccaagtccaacccgcgctggttcgtgccgctgttctgcgcgctgatgatcatcggtctggtgtgggccgtggtctactacctgaccaccgattatccgattccgcacatcggcgcttggaacctggccatcgcgttcgcaatcatcatggtcggtttcattatgaccatgtggtggcgctgagtcggttttctccgtttcgcctattccatcgaggcttattcaaaagacgccgggtccattgcgatccggcgtctcttttatccgcttcaaccactttacttaccgcgtctgcatcgccccgcttcagctttaggaaaagcggtttcctgtcgagtggacagccgccgcttacccgccgattatctgctgattttcgccgtccgaatcagcacgtggtcgccgccttgcatggtggtgccgaacagataggcgtcgccgccgtcggcgagcttgagtttcttgcgcaattgcggcgcggtgagtgggaaattacgcacggcgatgttggcacggtccaagccggacagcaatcgcttcagctccttcttacccataccgccgatcgtttcgatcgcaaaaccgcgccccggaaaaccatcgaccggctcgtccgatacgaacaggtggctgctcgggccgatctgcaccgccccgaatcgcgcttccaccacgtcgaagcagccggccttcatgatcgacgcgttcggctcgtacaggtagcgcagctcgtgcggcagcggcgcgtccccgatgcgcaggccgcgcgtataggcggccgcatcgtagtcgagccgctgatcgtcgttcacgcagtacacgtgcggcgcacgcgtgtctgccgctgcggcatcggacgttgccccggcagccttgccgtccagcaccagaagcagttccttgcattcgttgccggtggagacgatgtgcacttcggccacagtgcccgcgaaatcgtcgaccgccttgcgccagtcaagcatcggcgacagtttgatcatcacatatcgcgccttagccagcagcagatcgcgcagcgccagcgcgtcgggcgtgcagtcctcgatcgcgtaggtgcgggcgccgtgctcgtcgcggcgggccgggtcgatgtagatcagctgcgccggctccatcgcacgtaggtattcgacgccgtcgccgcacaccacctgtgcttgcgtgaggcccagcgccgccatattgtgcgcggccagttcgcacaggtgcgattggcgttccacgtacgtggcgtgaccgaatccgcgggcgagatatgagaaatcgacgccgaatccgcctgtcaggtccgtcatggtcgcgtcgttggccgtctgtcccgccgattgcggcagagatcgcaacagacgccgggcgatttcggccttgtattgcgctgtgaactgcgatgagcactgttccatggaaatatgcgcgggatagacgatatccgcgcaggcggcccattgcggcagtttgttgcgggcgatttgccagcccgcgatctggtcgagcgcggccggcaggtcgaggtccgccgtccgcttggttttgagcgccaggtcacgcacgtcttcattgcgatgcgcctcggcgaaggcgcgcgtcacgtcgttgagcagtggtccgtcactcatggttcctctccccttcttcgcaagtatctgccatgtcgcacgcatatcgtcgcacgcgtatcctgcgtccgtggcgcatcggtattgcgtccttgtcgattgccttcgtcatcttatctttcctgtggataacaagtggacaaatgtggatgaatgtggataacgcccatattttgtgcctgagtcaacgtcgcaccacgaaataccggcggcgattttccccatttttgtggggtgtggatatcggttatccacaattttcacataggaaattccttatgttccgccattttgtgaatatccttgtggataatccaccacgttatccccgacttacccacaggtttgacctcacttatccacaaagttatccacggatgtggaaaactacatgtgtgtagttcccgcattactggtacagaagtgacatatgcatcagcggattgccggcgttgcatcccacgatgatcgccacgaccaccacgaacaccgtgatgccgtacaccgtggtgcgccacgtcaggcttttgccgcggaacgcatgcaggccggtgaccagcagccacgcaagcacgccgccgacgatgaatccgccgacatgcgcctgccatgcaatgcccggcgtgatcaccggcatcaggaagttgatcagcatccaaatcagcatcgaacgaatatcgatgcctattctcctgtacaccaccagaatcgcggcgaacaggccgaacagcgcgccggacgcgccatacgcggcggtcatccatcccgacggcgagcacacggcccacaccatcagtccggcaccgccgcccaatccggacagcacgtacagcgcgaggtacggccaatgccccatcatgcgttccagcacgggccccacgcaccacaaagtaagcatgttgaacaggatgtgccacagcgaggtcggctggtgcaggaacatcgaggtgatgaaggtccacgggtgccggacggccgtggcgggcagcagcatgccggcgttcacgaacgcgttgccgccttcgggccagacgaggaagagaaccgcttcgatggcccacaccacgatgcagatcgccatgatggcggtggtgatgaccgggtcgccgttgcgccaccggtatcgcagcgatcgggcggagaacagatccttgaacgatggggaatcgggaaacagactgaatcgttggtatgccatagctcaacactaccggcacatgcggtattttccggcgcgtaaatccacccaatcgacacattccacgaattaagatagggaacagagctggcttgaacgagcaggtcagccagtgtttggaaaccttgaaaggagccgtcatggagaacaagtcttctaacggttggaagttcttcgcactgctcttcggagctttgcttgctggcgtcgtcggtctgtacatctacaagcagcagaatcccgactatgacccgtgggaggaaccgtgggagaacagctcctcgccggtcgacctgggcctgaccaaggacgccgagccggaggccgacgccactgccgccgctcctgccgctgagccggaagccgcctgatttcgcctttcccggcacacctatgccgcgttgggtttgttgcttcgccctgtatcttgcgatacagggtttttcttttgctttttcgattgcgattggcttgcggccttccgtcgtactgtcgctgtattgccacgtacgtccggcacgtacgttcggacactaccggcatacgcaatcggacatgcgaaaaacatacgaaaaggcccttggaaaatcccaagggccttcgtcgtcatcacttatccgcccattgcgaaacggacggagcggaagcgatcatgcgtgcgtcggcgatgccggcgacgtttcatgaccgctccataatcacttgagcggaccggtgtgccagatgcgctcgaggtaatcctcgatggagcggtcggagctgaagtagccggagttggccacgttgagcacggccatgcggctccacttcatcggatcgcggtaggtttcctcgatctgggcctggatgtccatgtacgcgcggaagtcggcgagcgtcatgaagtaatccttgttcagccaatcgttgacgaggtccttgtaggtgtccttgtcgccgtcggagaaggtgccgtcggcaaccatatcgatggcggccttgagctgcgggtccttctcgtagtactcgcgggacagacccttggtgtcgtagcccttggcgtacagcgcggagacttccggctcggtcatgccgaacaggaagaagttctcggcgcccacgcgctcacggatctcgacgttggcgccatcgagggtgccgacggtcagagcgccgttgagggcgaacttcatgttgccggtgccggaggcttccttgccggcctgggagatctgctcgtcgaggtcggtggccgggatgaggttcatggccagctcgatgttgtagttccacgggaagtagacgttcagcttgcccttgacgtccgggtcgttgttgatgacgcgggcgacgttgttgatcagctggatggtctgcttggccaggtagtagcccggagcggccttggcgccgaacacgatggtgcgcggcatgatgtcgtcggcggagaccttgccggacttgatgtcggcgtagtcggcgatgacggacaggatcttcagggcctggcgcttgtactcgtgcagacgcttgaccatggtgttgatcatggtgttcgggtcgatgtcgaagccgtacttgcgcttggcgaagttggagaagtcgaccttgttggcctgcttgacggcggcgaacttcttgacgaactcgtcatcgtcggccagcgggatgaggcccttgagcagctcgaggtcggacagccacttgtcggtgccgaggccttcggtgatgacgtcggacagacgcgggttggccagcttgatgaagcggcgaggggtcacgccgttggtcacgttggtgaacttgtccgggtagacgtcggagaagttcttcagggtgacgtccttgagcagctgggagtgcagctcggccacgccgttgacgtgggagccgccgtaggaggccaggaacgccatgcgcacggagtcgccggtgtagatggccatgtccttgatggtggcctcgtcaacgcccttggccttgagctcggcctcgaactggtcgttgatcctctcgatgatctcgaggtgacgcggcagcagttcgccgatgagcttggacggccacacttccagggcttccggaagcagggtgtggcaggtgtagttgaaggtcttgttggtgatcttccaagcggtgtcccaatcgtagccgtactcgtccatgaggacgcgcatgagctccgggatgccgatgaccgggtgggtgtcgttgagctggaaggtgatcttgtccgcgaaggtggtcagatccggcttgtcctggcccgggtagaagacgcggatggcgtcgtggatggaggcggacacgaagaagtactgctgctcgaggcgcagagccttgccctgcggggtggagtcttccggatacaggatcttggagatgttctcagcctcgacctgcggcttgacggcgtccagatactcggacttgttgaaggtgagcagatcgaactcgtcgtagctcttggcggtccacagacgcagggtgttcacacggccggaggcgtagcccggaaccatgtagtcgaccgggacggcgcgcacggaccaagccggcttccagaccttcttgccgttctcttcgacgacttcgccgccgaaggagaccttctggtcgcggttgtaatcgatgtggccccacggctcttcgttggccagccagtaatccggagtctcgatctgcttgccgttctcgtcgaattcctgcttgaagatgccgtacttgtactggatgccgtaaccgaacgccggcacgccaagggaggcgagggagtcgatgaagcaggcggccagacgacccagaccaccattgccgaggcccggctcgtattcggcgtcgatgatttcctgggcggagaatccgaggtccttgacggccttgttgaactggtcggtcagtccggcgttgagcagcgcgttctcgagctgcttgcccatgaggaactcagcggacaggtagcccacggccttggtgttgccgttgaccatgtcggcctgggtcttcatccaggaatccacgagatggcgacgcactgcggcggacgcggcaacgtacacgtcggccggcttggcctgctcgacggtgacgccctgggtgtacttcagctgctcacgaatctcgtcagcgaactgttccgcggtgaccgcggacttcggtgcggtaatttcagtcattgattgactccctttgacggatactctccaggaacattatgccttacttcagcgtccttgcatttgcggccgcatgaacactaagtaacatcatgcatacgttctcatgtacagcatactacgtaatcataaaaagacgaaactcccagcaatcgtaagccggcattcgtttgcaaaaaacattgcaaaaactgcaacgcaacgtatggcgcccattaagcgagggcaccataatcgcaggaaaatcgcccctcaaacccctatttagttacgactacatcgtttgcaaagtcccatcatagtcgtttgcgggctgcacaataccggtatggctgtcatacgagaacaagacttgggcaaaggacgcgccgccttcgaacagtggcaggacgcggcgcacaacattttcagcgagcagctgccggccgatgacgacgccgctttcgatttccggctcaacttctctccgcgtctgccgcgccagctgtgggcgatggcggtgcgctactcgctatacctgctggaaaagaaggctccgggcgaaggcgtggaggtgcgcgtggcaccgtggggcgccatcaagatcctcgacgggccggcgtccgatccgcacaatctcacgccgccggacgtcatcgaactggaccccgacgtgtggatgaggctcgccaccggcatcaccagctggggcgaggaaaaggacaccgggcgcatcaccgccgtcggcgaacgcgacgatctgagcgggttgctgccgctggcataggaataggtcgcggcgcggcgcgacctgcgatggttggcgggacgagcacgacaatcgcccgacaatcgaaatcgaaataataaaaaatggctcgtggttgaaaccacgagccattcgttgaaaaaatctgtgcagtcagtcctgcttcttcggcttcagcgcgctgggcaccggcatcgggatgggcttgtgaggcttcggcgcggcctttgccgccggaaactcgccactcgtggccttcgccgcggcttccgcggcccacttggcgtattcgtcaaggtcatcggcggaatcggaagacgtttgaccgtccccaacggtctcatcttcggcgtccacatcgtgagaatacttggcttcgatatcggcaaacgggtcgaaggaaccagaaccgggctcctgcgcaccgagctccttggcaagctcatcgtaatcggtgtcggtggtcaggtacttgagctttcgggctattttctgctgtttggctttctgacgtccgcggcccatctgaccccctgaaattactgtgctatcaattcatcaaacaagagagtaccacttattgcgcattatttcgttgtcggctcagacttttacgataaaatcgttgattttcttaagaaaaggacacgtatgacggacgaaacccaggagcagcagatcactgctgtcggcaatgaaatgagcgcgagcttcctcgccgcaaagaagcgttccgatgaaatcctcgccgcaatcgaaaagaatccgggcaagttcaccatgctcaccggcgaccgtccgaccggccgtctgcacctcggccactacttcggctccatccgcgagcgcgtggccatgcagaaccgtggcgtgaactcgaacatcatcatcgccgactaccaggtgatcaccgaccgcgacaccaccgagcacatcgaggacaatgtgctcaacctggtgctcgactacatggccgccggcatcgacccgaacaagaccatgatctttacccattccgccgttccggccgagaaccagctcatgctgccgttcctatccctggtcacggaggccgagctgcaccgcaacccgaccgtgaagtccgaaatggaggcttccggccatgcgctgaccggcctgctgctcacctacccggtgcatcaggcttgcgacatcctgttctgcaaggccaacgtggtgccgatcggcaaggacaacctgccgcacgtcgaaatcacccgcaccatcgcacgccgcttcaacgagcgctacgcgaagaagaacccggtgttcccggagccgagcgccatcctgtccgaagcgccggagatcccgggtcttgacggccgcaagatgagcaagtcctacggcaactccatcatgctgggcgccaccgcggaggagaccgccaagctcatcaagaagagcccgaccgattccgagcgccgcatcaccttcgacccgattgcccgcccgcaggtctccgcgctactgaccaccgccggtctggtgaccggccgcgatccgaaggacatcgccgaggaaatcggcgactccggtgcaggcgcgctgaagaagtacgtgatcgaatccgtgaacgagttcctggccccgcaccgcgagcgccgcgccgaattggccaaggatatggattccatccgcgacatcctgcatgacggcaacaagcgcgcgaacgaaatcgccaatgagacgctgcagcaggtgcgcgacgccatgggcatgcgctactaagtttgcaatcggcatcctgacgcgttagcggattggccgtgttcctccgggagcacggccaatccgcttattcatggcagattcagaggctaccgttctgctaggtggcttatttgtggcatggaaaacgggaaaccccgtgtatgtccgtcggaattccaatggacatacacggggtttcctgaatcaggtgccacaaacaggccacttgacatttccctgttgtcggaatctgccataaacaagcgacatggcaccaaaggccgaccttcggcgttgcaggaggtgcaacacccaccgcggggcgattcagatctgcgagcgcttctcccctgcggcgatttctgcggccacaaggtcgtcgtccacgtggcggtcgtccggatcgtcgagatagtggtcgaattcgtgcagcacttccgcgcttggcgcaggcgtgagcagcgagatcaccacgatgaacagcagcgagacgatgaacgccggcagcagctcgtagatggcgaagatgccaccgagcggcttgacgaggttgtgccagatgagcacggtggccgtgccggacagcatgcccgcgatcgcgccgtacttgttggtgcgcctccagtacagcgaggtgagcatcagcggtccgaaggatgcgccgaggccggcccacgcgtacgagaccacttggaagatcgaggagttctggtcgaacgccaccacgatgccgaagatgaacatgacgagcagcgtgatgcgcgccaccatcatcacctggcggtcggtggccttgcggtgcagcagtccgcggaagatgttctcgccgacggccgaggcgccgatgatcatgtacgaggacgaggagctcatggacgcggcgaagatgccggacacgacgatgccgcacatgaagctcggcagcagcgcctgcgacaccacgatgaagatgttctccgcggccgcctgcgtggcgaactgcgtcggcatcatggcacggccgaccaagccgatgcacacgccgcacgccagcgagatcacgcaccacgtggtggcgatgatgcgggatttcttgatttcctcggaactgcggatggacaggaaccgcacgagcacctgcggcatgccgaagtagcccaggccccacgcgagcatggagatgatggtgatgatgccgtagtcggcgggcgcgccgaacatggcctgtccggccttgacgatctgctcgccggcgtcgttgaggatcggcgtggccacatgcgtgccgtcgaggaatcccggaatgcccttgaggaaggcgacggtgttgtcgatgccgccggcggacgccacggagccgatgaacaccacggccagcgcgaagaacatgagcaggccctggatgaagtcggtcacgaccacggacagatagccgccgatgatggtgtacgcgaacacgatggcggcgccgatcaccatggtcaggtggtagtcccagccgaacagcgtggagaagagtttgccgacggtcacgaagcagctgccgacgtacacgcagaagaatacgaggatgatgagcgcagcgatggtggatacgatattgcgatcgtcatggaagcgcttggagaagaagtcgggaatggtgatcgcgtcgccggccaccacggagtagcggcgcagacggcgtgcgacgagtttccagttgaggtaagtaccaagcgccagaccgatggccgtccacatcgggtcggccgcgccggtgaagtaggcgacgcccggcaggcccataagcagccagccgctcatgtcggaggcttccgcgctcaatgccgtcagccacggtccgacgccacgcccacccgcgaaatactgtttggtggaggaattggacctcttggagtagacgaagccgatggtcagcatggccgcgaagtacaagaccatggccagcagcacccagaaatctttggttaccaagtgtttttacccttctgcaggttattaaatgtcgtagcgccaggatttatcggtcactactcgtgccatcgccaggccgatcggcaggcagatgatcaccatgaacgcacggaacgcccaatcgagcgcgttcagcgtatcgaactggccgaggtggaacatggcctggtacatatacaaaccgggcaccatgatcacaatagacggaaccgtcaggcagatgcgcggatatcccaaatgcggagcaagcaggccgtgacgcaccgccgaacgccatgcggaggcgagcaggccggcaaggaacgcgccgatgaacgcgccggcttccgcgggcacgcccaagtcgacgatttccaatcgcaaagtatcagtgatggcgccgatggtggcggcgacgaggcacatgcgctgcggggaattgaacatcacggagaagccccacacaccgatgaacgcgaacagcatgcgcagcaggcagttgatgacggggttcagtccaagcggctcgaatccttgcggattcaggtgcacgatcgaagcgaccatccagcctgccaacgtggccatcagaatgatgcacagcacgtaggtgagtcgttgcacgcctgatgggaagtcgattttcgccatgtcaagtccgccggttatcagcgggaatccggggatgacgaacagcatcgcgccgatatacgcggtgtcgtgctgcaaggcgatcggatcgaacaggccaatcagtcgcagcatgccggtgcatgccagcgcggcgacggccacgcagacgaacgtcacgaagaattggttgagatggtgggcgaacaggcggcgacgcagccagtggccgaggccggcgccgacgaacgcgccgatcatgtcgtacgggccgccgccgagcaggaacacgaaggatgcacaggcgcaggcggacgcgagtcccgcgaaggccggcgaatacagcggtttgcgacgttcgatcatgtcgagtcgctcgtgcgcctgccgtacggtgacgccttgcgattcgcccgcggctttcccgatatggtcgaaatgctcggcatattccttcggcggtttgcagttgcggttcttacgcggcttttccgcgaccgaatcgccattgctacgtccggccgcggccgccgcctcgatatcgcgcatgtgcagcggacgtgcggtggaatcgccttcctgcgcgcgttccgtgaccatttccagcgcgtcgagcacgggatcgtcggaaccttcctggttctgctcggccttctgccgttccttgagctgcttggacagttcggccgacacctgcgaggcgtcgcgcttgtcgagatgctgcatcagcccttcggaaacgtcggattggctgtggtacatagagcctttgccgaggttgacgttgaaccagtcggcgaagtgctcgagcagccagatgcgttcggtgttgacgccagttgtgggtaggtcgacgacttcggtgatgcggtccttgccgtccgtgcaggatgcctcgatgtcggtgaggttcacgtcggcgcgcacgtgcacgcctaacggataggcgatgcggtgcatcatttcgcggacgcggaagcttcccgttccggcgccaaggtcgagcatgccgacacggacgatcacgctggctttcgctgcgattcccgcttcggtgaccggcttgtcccaatcgcgctcgatgtcttccatatcgagcggaatggagtgggtgtggaatttgctgaccgccttcgcgctgctgtcaacgcgttcggcgttctcatcatgttcatgtagtgcgctcacactattcaggtctaacgtgtgggctggtcggatattttccgaacattcccacatgcccattttccggacattcaatgtccacgatgcgaaccattccggcgtttccgtaaccaaactgtcgatttgccgcgcctacaatggtcgagcatttacccaccaagcttagggctgtgggctcgcaacagacggccaaaacaatcgcggaggtgccgcgaaggaccgacagaccgagcaacccgatggtttggagaaggaggtctgatgacaactgaaaacgaacagatcacgcctgcggacgcggctatcgtctcgtccggcaccggcaccaagggccctgaggagcgtgatcttcccgcatccctcaaagaggaaatggatctgtgtctgcagattcttcgcgaggtgctcggtgagttcgatgaaaacctgctggccaagttcgatgaagtgcgcgaacacgcgctgaaggccagtgacgaacgtttctccggcattctttcggatacgaatcccgaccaggacgacctgcagaaggtggtcgacatcgtcgacaagatggatgtccacgacgcccaactgctggctcgcgccttcaccacctacttccatctggccaacctgtgcgaggagaactaccgcgtctccgtactgcacagccgtgaggccgccgtggatgaggatcaggccgtcgatccggtgaacgaaatgacctgcgcctaccaccagctcatcaacgagatgggtccggccagggccaaggagctgctcgaccagctcgagttccatccggtgttcaccgcgcatccgaccgaagcccgccgtaaggccgtggaaggcaagatccgccgtatctcccagctgctcgaagcgcataagctgctcggcggctcggacaagaaggaaaactcccgtcgactcttcaacgagatcgacgcgctgttccgcacctccccgatcgcgctgaagaagccgactccggttgaggaagccgacaccattcttgatatcttcgacaacacgctgttctacaccattccgcaggtctaccgtcgtttcgacgactgggtcctcggagacaaggccggcctcgtgccgccggtgtgcccggcgttcttccatccgggaagctggatcggttccgaccgtgacggcaacccgaacgtcaccgccaaggtgagccgtcaggtggcccgcaagttcagcgaccatgtgctgggcgcgctggagatcgaaacccgccgcgtcggcaagaacctgacgatggaggccgagaccaccccgccgagcgccgagctcaagtccctgtggaaccaccagaaggaaatgagcgagcgtctgaccgacaaggccgcgctgatctccaccaaggagctgcaccgcgccgtcatgctggtcatggcagaccgtctgaaggccaccatcgaccgcgacgccgacctcatgtaccactcctgcgaggactacatcgccgatctgaagaccgtgcagcgctccctcgccgaagccaacgccaagcgttccgcctacggtccgctgcaggacctcatctggcaggccgagaccttcggcttccacatggtcgagatggagttccgtcagcattccgtcgtgcattcccgcgctctggaggacatccgcgagcatggcctgcacggtgagcgtggcgagctgcagccgatgacccacgaggtgctcgacaccttccgcgcgctcggttccatccagaagcgcaatggcatcaaggccgcccgccgttacatcatctccttcaccaagagcgcccagaacatcaaggacgtgtacgaactgaaccgtctggcgttctcccaccccgaggatgttccgaccatcgacgtgatcccgctgttcgagcagcttgaggatctgcagaactcggtggacgtgctcgaggaaatgatcaagatcccggaggtccaggctcgtctgaaggccaccggcggcaagatggaagtcatgctcggctactccgactcctcgaaggacgccggcccgacctccgccacccttgccctgcactccgcgcaggagcgcatcgccaagtgggccgaatcgcacgacatcgacctgaccctgttccatggccgcggcggcgccgtcggtcgtggcggcggcccggccaaccgcgccgtgctcgcacagccggtcggctccgtgaagtgccgtttcaagctcaccgagcagggcgaggtcatcttcgcccgctacggcaacccggtgctggcaatccgccacgtggagtccgtcgcagccgcaacgctgctgcagtccgctccgagcgtggagaagcgcaacacggatatgaccaagaagtacgccgacatggccagcaagctcgacgaggccgcgcacaaccgcttcctcgacctgctgaacaccgacggcttcgcaccgtggttctccaccgtcacgccgctgaccgaaatcggcctgctgccgatcggctcccgtccggcgaagcgtggtctgggcgccaagtccctcgacgatctgcgcaccattccgtggatcttctcctgggcccaggcccgcatcaacctggccgcatggtacggcctcggcaccgcgtgcgagcagttcggcgacctgaacaccttgcgtcaggcgtacgaggagtggccgctgttctccacgttcatcgacaacatcgaaatgtcgctggccaagaccgacgagcgcatcgccaagatgtacctcgccctcggcgaccgtgaggacctcaacaagaaggtcctcgacgagatggagctcacccgcaagtgggtgctcaagatcgtcggcgacgaatggccgctgcagcaccgccacgtgctcggccaggccatccgcatccgctcgccgtacgtggacgcactgtccgtcacccaggtgctcgccctcggctcgctgcgcaagcgcgtggacaaggaagagctcacacacggccagaaggagaactacacctatctgatcctgtgcaccgtttcgggcgtcgccgcaggcctgcagaacacgggctgatcttcggatgaccgattgacaaaagcgagcggggaggttccgtgccgatcgacggcgcgggcctccccgttcgcgtcgcacggccctagactggccggcgacggcgcgcatagaacgggcgcgctggccgagtgacagactcggatgatcggaggggacatggacaagccatcgaatgagcgcgggagcaccgggccgacggacggcatcaaggcggagggcgatgccggaaacgaacgccacatttgcaaagcgaatccggctatgatcgatgacattgggaaaaaacacggcctggaagatacgtcagaaaatttttccggcaagaaatatgctttggcaccgaaagcagctaccaaattccttaaggcgagtagatgctatgtggctttgggcaaagccagacgcgtgctatggtggctgggattactgctgctttcaccagcacttattttgtgggcggaatggggcgccaatggcgatgatgatactataatctgcagagtcttaacgttctcttcctcttcgtgcatgaatttaactacggcaactgagtatgtacgtagacttaccttagtattgattatgggggtagtctgctggattgcggcgcttgtcatctttggcgtgcgttcatatatgcgatctgtatatccggaacttcgtgatcattcctcttccgcctcgcatgtccttgtgggaatcatatcgtttctcgtgctggtcatggtctttcccgttcttgtgataacgctactttccgctctaatgactctatgacgttttaccagaggcgcattgcgtggaatggctgaatcattccacgcagtgcgatcacaatcatgattgattaacggggtagtgcccgaaggtttgcgcacttagggtcgtgcccgtccatgggacgatgatttcaacatctcaacgaagaacaaaaccgaaagtgcgcaggaattcggacgttatccaccaccatcgccgtgttccacaacgtcaaagcgcgccgttgttcatcacgcagccttggccaatcgcaatcgggttccaaagtatagttcggcaattgggcgaatatgaatggtagttccggacgcttgagtagcgcacgccactcctggatcagcgacatcaacagctgcacatagccataagacgcatgggcgttggactccctctgactccgccataatgaaggacctccgagcgaatcggaggtcctttttgttttcaacgctttcgttcgtcaaaaggccatcgtcagcaaaccatcaacgcgccaatcgttccgcggcagaggcgatcgccgcatcactggccgtagccgagaatcgcaggtattccggcgctccgtagaactcgccggggctggcgacgatgccgatttcggcaagctggcgcagatcctcccagcagtcgccggacttggctttcacccacacgtacaacgcgccttgcggcatgtcggtgcagtatccgtatgcgcgcagagcactcaccagcatgcccagacgctcctggtaacgggaatgctgggtcttgaccgcgtcgaagtcacgcagcccggcggccatcgcagcctgcaccggtccgggaatgatctgcccgatctgtttgcggtatgccgccatcggcccgatcagcgattgatcgccagcgataagcgccgtacgatacccggccatgttgctttgcttactcagcgaatacagcaccaatacgccttcggcggacccgccacacacatcggcgcgcaaggcgcacggcgtggaggcaagcgtatccgcatccgcttccgcaacgtcgtcttcccattgcatcaacgcatagcattcatcggacagcaccacggcaccaatcgcgcgcgcggcacgcacaataccggccatctgttccgcggacagcacctcaccggtcggattgcacggcgaattgacccaaacggccttgacgcccggcacatccttccaggaatccgcatccgccacgtcgtcgaccttcagcgtttgcgcgccggccaactgcgtgccgatctcgtacgtcggatacgacaccttcggctgcacgacgacatcgccctcgccgaaatgcagcagcgacgccatcaacgcgacgccttccttggaaccgaccgtcggcaccgcatcggcgccgatcgcacgcaaatcgacattgcgggcggccgcgaaccactcgtgaatggcgtcacgcaaatcggcagtacctgccgtaacgggatatccgtacgcgttcgggtcgttcgacgagatggcgagcgccttgcgcaccgaatcgggcacggggtcgacgggagatccgacggacaggtcgatcatgccgccgaacgcggccttcgccgtgcgcttgtaggatgcgatgcgcgaccaatcgtacggtgacgagaactcatgaaagcccatccgtaagtctccttttccaacgggaatctcaaaccatgctccagcatacggcaatcggcccgacggcatggtcgtccgtccatacgaaaaaccggttcgccttcggcgcatggaaacgtcgaagtcgaaccggtccagaaaacgaatcggccgtccaaatccgctcgacgagcaaaatggacggcacgacggttcaacaagccatgctcactggttctgcggcggcagggccgcgacctgctccgggtccttgccgatcggaccggctgcggaagcgccacccaaatcgccgacttcggcgaagaagctgacggcggcgtccttgtaccaagcccactcctccggcaggtcatcctcgtagaagatggcttcggtcgggcacaccggctcgcatgcgccgcaatccacgcattcgttcggattgatgtacagggaacgggagccttcgtagatgcaatcgaccgggcactcgtccacacaggccttgtctttgacgtccacacacggctgggcaacaacgtacggcatgcttacctcctcaacaacaacgtgtactgttccagattactcttgcgcggcaacttcgagttcgccggcaccgagacgggcatgacggtagccatagccgaagtagatggcgaagccgacgatgagccagaccacgaaacggatccaggtgagcacgctcaggttgaccatcagccacaggttggcaagcgcaatcagaatcggcacccacgggttgcccggaatcttgaaggagcgttccaggtcggggcgcttcttgcgcatgatcggaatggaaatcgccaccagcgtgaacgccgaaagcgtgccgatgttcaccatgtcggacaggatgccgacgttgcagcaggccgcgatcagcgccatgaccacgccgacgatgatctgcaggcgcaccggagtgccatgcttgccggtatggctcagaccgcgaggcagcagaccgtcacggctcatggcgaacaccactcgcgtcagacccagcagcagcaccatgaccacggtggccatgccgatgacgatgccgaggctgatgatcttcgcggcccagtcggcgccgaccatcttgaacgcgacggccagtgacggatcggactgtttggcaaggtccttataggagaccatgcccgtggtgacgatggccacgagggtgtacagcacgatgatcaggccgaggcccacgccgatgcccagcggcacgttcttcttggggttgatggtctcttcggaagcggtggccacgacgtcgaagccgaggaaagcgaagaacacgagtgccgcgccggagatgatgccggtcacgccataaatgctgggggccatgccggtggcccactgccacagcggctgttccatgaccgcggagacgccggagccgtcggtggatgctgcgggttcgctcggcggaatgaacggggtgaagttttcggccttgatgtagaagaagccgacgaccacgatgaacacgacgatggcgatcttcaaaatggtgagcgcgccgtccacgcgggcgccgatcttggtgcccatcaccagcagcgcggtgaagaaggcgacgatgatgaccggagccaggtcgaagttgaacgagccgatggcgatgttggtgttgatgttccagccgatcagctcgaagaactggttgaggtacacgccccagtatttggagacgaccgaaccggccatgagcatttcaaggatcagatcccagccaatcacccatgccacgatctcgccgacggtggtgtaggtgaaggtgtaggcggaacccgccactggaatcatggaggcgaattcggcgtagcacatcacggcggcgccgcacacgacgcctgcgatcaggaagctcagcaccaccgccggaccggcatggaaggcagccgcctgcgcgccgatggagaagatgcctgcgcccacggcaacggccacacccatgatggcaagatcccaccaggtcagatcgcgtttgagcgcatggccggactcacctgtttcagccagcgtctgttcgacggatttcttgcgaaatacgttcatgtctcgtccttctcttctttccgcccgcgcggtttcacgctccaccttctagagcacaaggcgcaagtataagtcgttttcgtcacattgacggcgtgcgtgacgctatttaagattcatgccgatgacgaccggctcgggcaccagtcggatgccgaacgcggcctcgacgccgtcctgcacggctttggcgaggcgggcgatatcttcggctgatgctcccccacgattggtcaacgccaacgtatgcagcgtggacaggccagccggagcgttttcgttgattttgaaccccttatggaagccggcatggtcgatgagccaggccgcggaagtcttgacgccctgcccgccgcccggcaatgccgcgtcgaagcgcggcgcgtcttcgggaagcgtctcggcctgctgtggcgtgagaatcgggttcatgaagaagctgccgcagctatggcggttgaagtccggaccgtcatcgccgttctgcttggattgcgattcaagagcgacatcgaccagattcgtcttcttggtgccctgcatggccggcgacgcatagcgatgcgcgtcttccagcatgcctttagccgcacgcaccttcagcaccgcgttgcggatgtccgcggtgttcatgcgatcgcccacggcgacatccaacgccttggcgagctgaccgtaaccgaccacgcccgtatcgctgtgccgcaacgcgaacgtgacggacagcaccacgtatcgcggcgtcgggaaaaattccgcggccggagtcgccggagcgctgtacatgctggctttcagcgcgctcatgcggtagccgaaggcgagctgatcgttgcgcaacgcctttaccgcacgttccttgcggtcccaaacctcgacgctgtcgacgctggtggcgacctcctgaccgtacgcgccgatgttctgcacgaccgacgcgccaacggtgccggggatgccggacaagccttcgacgccttccagtccaagtcggacgcagtaatcgacgaaatcatcccagttgcagccggcttcggcgttcacgtggacgacacgcccatcatcctcgaccggagccgcctcatccaacacgccgatggagcgtctcgcatcgcggaccaccacgccttcgaacggcgtgtcggatacgagcatgttggatccgccgccgatcacgcacaatggcagtccttgggaatcggcttcctcaacggcctcgatgacgccgacgcgcgtggtcggctccaggaaagtggcgataggaccgcccacgccgatggtggtgagatctgcaaaacttgtcataacgctccagagtaacaaaaaacccgaccaaattggtcgggtttcgaaagcttgattccgctcagcgggtctcgcgatgcacggtctgcttgccgcagcgggagcagaacttcttgagctcaagacgatccggcgtgttacggcggttcttcgtcgtgatgtagttacgctccttgcactcggtgcatgccagcgtgatgcccggacgaatgtcggcgctcttgcttgccatttagttcacctcttgtggttcgttgctataccgacattccgtcggcctttgtagcgagaaagagactcgaactcttgaccttacgattatgagtcgtacgctctagccagctgagctatcccgccatgagagcctcgagtgagaatcggactcacgacctcttccttaccaaggaagtgctctaccactgagctatcgaggcgtggcggatagtggattcgaaccactgaagcacgaggcgactgatttacagtcagttccctttgaccgcttgggaaatccgccgtgctgcctgtttggttgaaccccaaccggcaacccgtttagtatgccacagaccggccgacttatgcaaatacggcgtgtcgcgacagccaaaaacggcccaaatcgttgaaattccaacgttttacgcaaatcggcgccgaacaacgcagaaaccccgcctcccgagccttgcgaaccgcaatatacgggaaacggggtttcgacagctacgcgctagtctcagccgaggatggccaggatgtcacgagcggagacgataaggtaatcctcgccctggtagtgcacctcggtgccgccgtacttggagtacagcaccttgtcgccgaccttgacgtcgaccgggatacgctcgccggcgtcgttacgacggcccgggccgacagccaggacttcaccctgctgcggcttctccttggcattgtccggaatgaacagaccggaagcggtctgggtctcggcttccgcctgcttgacgatgatcttgtcttccaacggtgtgagtgagatcgacactgtggacctcctctttctaaagagaaatcgatacttaccgcgccgggacccgctagcaagaggctgacgatcacttacggcgtcgtcctttcgcgctgtgacttatcctagcgcgattattagcactctgccaactcgagtgctaacgctctgagagaaattatcaaaaaagcctgaaaccatgcggttccagactttgtaaaaaacggttcaagcgtttcgtcaggcgctacgacgggccagaatggcctccaggccggtgcctagggagtccgaagtcacatccggagcctccacatcggcacgtacttcggcatcgtggaatcccggaacgtcgacctctctgaggtgcacgccctcatccacgcgggcggcggcctcatcggcatccatgctgcccattgcgtcgcttggcggaatcaacggctcagcctcgtcggaaggcgtttcgacgggcacggccttggccacttgtttggtggatttgatctccatgctttccggagcatccacctcaacgtcggcaccgtcgcgaggcgcacccaacgagaaggaaatcaagtcctgcgtggacttgacggcaacggttttggcttcttcggccatattgtctcgctcatcgtggatggacagtcccacttccttgacgtcagcgggcgcggcatccgcacgttcggttgtctggtcgacggccttctcggcagtctgcgtctcttccttggaagacatctcttccttgcgccgtttcaccgcggcgtcccgatcggccttgccgcgggcgatcgcctggcgaatctccccctcgggaacgacatcggtcttcaactgctcgtcggcgaccttgcgggcctcggccagctcctgcgcgcgcagtctggcacgttccgcctgctccgcctgcgcacgtttgcgttcggcggcggcacgcttcttcaccttggcatggtatctggcgaccttccgctcccacgccacggcctgcttggacgcacgcacacccaacgcgagcaccgcggccagcaacgcggccggaatgagcgcgaacagcggactgaagtgcagtgcgaacgcacagaccagcacaacgaccgtgattgtcagcaatgagacggcgatggcgcgcctcctgcggaccgcggcgtgacgaagggcgcgaatttccgcgatccgttcttcggatgttgcgcctttgtgcgcctctgtggactgcatcagtacccctttcgctgccgcgacggtctcatcggaaaatcgcgttccgctgtcggcatccaccagatgcaacgacggtgaaaagcggtcctcgcgatgttcgatcaccctcttcatgcctttaatcgtccgtctgggcaaccaaatgagcatcaggatgacaacgatcgcaagcacgaccaccgtgcttaacgattcataacccatatgtcataagaataggtgacattccgacattcgaggcgagtcctccccggcgtgtcgaatcaggagggtgaattccctgtcatcagacgcgcggtgaaaccgtttggcgcgtcctcggccatcaatacgtagctttcatgatcgcgccattggccgttgacgtacatatacgcgcgccgcaccccctccaacgttgctccgaccttgcgtgcgacggcacgggaccgcttgttttccggcaaaatgtcgatttccatgcgatgcagtcgaggtccggtcgggtcgaacatggcccaatccgccaacagcgccaccgccatcggcgcgtagccacgcccggcgcaacgctcgtccacccaatagccgaccacgccggaacgcatcgcgccgtagcagatcgcgcccaacgagatctgcccgacgatacggccatgctgttcgatggcgaacacggcaccggtaccggcccgttcgttgcgccgcagttgtttcatccattccttgtaggtgatgggggcgccgtgcagcggatcgccggattcccacggcttgagccaggcatcgttgcgccagcgaacctcgttccactcgtcatagtcggcacccgtcaacgggcgcagactcaccgggacgcgcatgctatgcgattggatgaattccggcatttcaaaggaattattccccggacgacgcatcatgtcgctcaaggattgcaaaatcgtcacccttccattgtgccccacccataccccatgttccgttttccacgcaatcgaaccgtggtacaacgaacgatatggacatgtatgagcaacaacgcgagctgaaacggcattggcgcgcggctgcgatcgaacgacgaaagcggacgtccgccgaccagcggcgcgaagcgggacgactgcttgccgaacacgcattggaagcgtcgttgattcgaccgcgatcaaccgtcgcggccttcgcctcgatgggcagtgaaatatcgatgatgccgttgctcgaagcgatgttcgacacggattgccgtgttttggtgccgcgtctgggtgctggcatggaagtcggctggagtgagctgaacggtcttgacgatctgcgcgaccagcgcaatgctgatggttccatcaacacacatcgcccgcaggagccggaaaacgcagcggaaggaccggaagttctcacttcggccgagctgatcattgtgccagcgttcgctgtggacgaacatggtttccgattggggcgcggcggcggttggtacgaccgcgctttggagcatcgtagcagcaccgcgcgcgtggtcgccgtttgctggccttgggagccgaccgacgagaccgtgccgcatgagccgcatgatattcccgtcgacggcgtgctcacgccggatggttatgccgatgtccgaggataggacggttgcggggccgtctcagggaacgtactaggatatgtcccgttaagaaatttgggattgtgcgtaaagcgaggatatcgtgcctacttaccattaccgttgcaagaactgcaactacgacttcaccgagcagcagtcgttcaccgacgatccgatcaccgtatgcccggaatgcggcgaggagcaggtccgcaaggtttattccgcggtgccgatcgagttcaaggggtccggcttctaccgcaccgacaaatccaagtgacccacaggcgcggaatccaacgcgacacgccggagattgtggataactcccattctccgaccacaaccccggattccgcttgccgtggtcataacaatcaggtcatcatgcatgcatgatgaccttttttcattccttgatggaccgccggccacattcgagtttgcgcacatcgacggcttcggaaggacggaccgcgcgcacgacgcgtctgcaacgagaccgtcatggttcgactgccgcatcgttggaagccagacgaagcaacgcacgcctgcatcggttcctcgccgcattgtgcgctggcctgacggtattcgccacgctgcaatgcgtacgcgcagccatcgccacgcagcctattgtggtcgcggtgcggaatgtcgccaaaggcacggccatcacacgcgaagacgtggagttacgtgaggcgccgagcgatggctcgctgagcaacgccttccatacgcttgacgacgccgtcggcttgatcgcacaggtgggcatcggcgcgcacgatgtgcttatgtcgggcatggcccgtgcgtcccccgttgtgccgcagggccatacgagtatcgaagtgcgtttggcaagtgtggccggcggtttgattcccggagacaaggtgacactttccagcgccaccatgacagatgctgagatgcagtccggcacaccgaatgtcgcggatatgccgaacggtacggaaacgccgtccggcatggctaatgatatgccggacggtggtgtggatgcgcagttacacacgatctgcgccgaagcgctgctgaccggcaaaccggctaaggatgcgcaaggcaataccatcgcggtgttcgccatgccgcccaatgaggcggccgtcgtgttgcgggttcaggaatacagtgcggtcatcgccaccatcaattaatggctgataatcctaatcgatagctggcacccggctggacgtatcagcggccgcgttcggagaagaccgcccaatgtggcggaagctcgtttaggatgcgcttgtcgtcatccgcctcgcgttggcgcttggtgagcacgtccgaaggttcgagtttgacgccatcggcatcgaacagttccgtaccttggcggaccacgcgcttatgcttgcgtgcggtccgccgcgtggcggaataactgggtatggagtgtgtctcggactgggtctgcgaatcgtcatgctccatgacgttttcgatatgctcggcgctcaccgttcctcccggtacaggcttcccagtcgtgccacgatgcggtcaacttccttatcggggttcacgaacgcgccgacgctccataccgtcatcaccgaccagccaagcgattcgatgtcctgcagcagcacgcgatggcgttccctggtggattgcagtcccatgaactgcgcgtcatcggtgagcacggccaaagcgaacggctcgcctttcagaccaaccaccaacggcagtttgagtccgtcatcgaaaccgtaatcgacggccacgtccaagccgcgttcgcggatcctctcggcgagatcgttgaagagcacgttctctccggactccttgatcgccgggcggaccatgctgtcatcaagctgttcggcccaacgcagcacggttttgagcgccttcggaccatcctgatgcagtcgctcgtcgtccatatcgtcggatgcgaaggacgagacaatgtcgagatgacggtccggtaccgccaaagcgtccagcagcatgcctcggccgccgtcggattccagcgcgccgaactgctgcagcagcctgccgtgcgaggtcttggcgtagcacatcgcaagaatcgcgtcggtggcgtgggcgccggccacatcgacgatgtccacgatgcgcacgtggcgcaggaacatgcccatggccttgtctttgttggcaagcgacttgagctcggcacccagacggatgcggaacgtgtgcgtgagcgccaccacggtaagcacatacgatgcgggaacgatggtgaaaccggccgcgcgcttgcggatgatattcaccacttcgtcgatctcctgctggcttgattcgaccaggccggaattgatgaccggcacaccgttggcgtccggcacgaaatggtacgcgacttcgccttggtatccttcacgcgccacatcgcacggcacggagccgtatccttccgattcgaggaaggcgttgagcttcggcgcacggcgaaccggcctgtcggttatcttcacgcttggcagcagtgcgatcagtcgctgcaggccatcggatgtgacggtcttgcggtgcgcgatcaccacgacctgcttcgcgcgggcgatgatgctgagcagctcgatggacggaatatgcgcggccgtatcgatgatgacggtatcggcaagcggcgccgggtcggtgatggcagcgagcgtggctggcgttgccaccagaatcggctttgccgcggccaaaatctgcggatgctccctacgcagcctgttcaacggcacgtttcgggaaccggcaagcgtggtatgcagcagattggcttcctgcgtgcgggagaaaagcatgtcgcacagacggcgtacggactcttgggcgaccatcggtccgatggaacgcacgtgttcgacatccacctgggtgaatcggtcggcggcgctttgcatggcggagccatcctggttggaaatgatggcggaggacttcacgatgtcttcgaaagctgtggtccaccacgccagctgcagttctccggccacggcgtcgttcggcacgccgcggttgctcaggtccgccacaagctcatccagaccggccgaatggaactcacgttccagacgggcgcgttccggcagcgtatccaacgcctgcttgtcgtcatacagggccttcagacgctcttccacctggttgaggtcgacggtgtccagattgccgccctgcggtgtggtggcgagcgccacgttcaacgcggtcatatcgttcgtcagctggtcctgcgtgttgatgatgtcgtcgagtttggcgggcagcaccggccatccgccgtgaggaacgaacatgtgccactgttcggcctgcttggccaccacgagcagcgcctcatgcaggttctccacctgcgcgccgacgcgcagcatcgacttggcctccttgatatggcggcgacgttcccagaatcccatggagctgccttcggccttgcgctgggccttgggcttggtggcctcgatcatggaatcgatgtcgcgttcgaagatttccggctggaagacgtcgagcacgcggcgcaggttcttgagcaccatgacctggcgtccccactcctgcgcggtggtgggaatcgggaagccgcaggtctgcacggtgctggacacctgtttgcgggtggcgggcagcaccttgcgcagcagctcgaccacacgctggtatgcgctgaccgcttcctcttcggaatacagggaggctttgtaccaggcggtgtcctgcgcgccgatggtgtattcgccgagttctcccgcgcgatacagcttctgagcccattcctccatcttgtccgcgatggaatgggcggactgcttggccagacgcacatgcgtggtcggatgcgtgggcaggacggcgatttgtgcgaggttctggatggtctggtatgcggacacgccccattcctggctgacgccgtgcaggtcgcccagatagcgggccaggcgggaacgcacacccaccagctcatccgaaatctggtcgaaacgcgaagtcgcgacgccggattggaaaccgactgcggctatcagctgacggtcgattgccgcattggcgccgtcatcggcgatgtccagcaattggccgctcatctcgttggccgcgatcgtctgcatgaaacggcgcttttggtcggtgacgcacggcacgtacagcacgctgtgtccgcccatcacgcaacgggaggcgattgccgcggcctgttcggccgtgttgccgctgatcgcgctgtccacgaaaatcgaatgcccggatgcggccagctgcgccgcgtatcggacggtgttgtcaacgtcgccaatctcgtattcgccatggggatcggcgtcgaacggactgtattcgggaatctgcgcgtctttcagcgcgtccgcggcttccttgttcccggcgagcgcgtccaggacggtgttgcctgtcgggccttgggacagctggttgatgatctggcgactttccaccagcatctgcgaggacgggtccatgaagcagccgaggatgatgtgacgttcgatttcgaaatcggggaaaacgctggacgcgcgcgctgtgatggccgcgaacaccgcggacgtttcgggggtgccgctttcgtaattcgaaccatcgaagagcttggtctcgtccaatgtcacgttgttttcacgcatcacggcggcgaaggccgcgttcagacgcactcgtccggtgaacgcgatgacggtgccgttctcgatgttgcggccttccttgcgcacttcgaccggatacatgagcaccggcatctggttgcctttccaaatggccacgccgaccaccaaggagagttcgccgacgccgctgacacggcttttcgcgtcacggtcgtcgagcacgcgttccacacgcctgcccgcggcgcgcagcatgccgttgtctcggaacaacgagtccaaggtgacgtgtcctttggcgaacagctgcgcgatgcccgatgggtgcgcatgcgtcaggtcaagctgggcgctcagttgcgtcacatcctcaagcggggatggtgccagaccaaggcgatactcctcacgccatccgcggatacggtccaacgcggtggccgtctcttcgttttcgctcatataccgactcacttccctactgccttgcggtattcctcatatcccggattgtgtgccaaagccgcatcgatgtcttggttgcccaatgcgcccaaccacgcgtacaggtcatcgtatagggatgggttcatggcgaggaacggcaacagttccggatgacgcgccatctggaactgcactgtgaaatcatccgtgcgtttggcgtcatcggaggtcaggccgtcgacctcgatggtctgctcctgcttggcgaggccgcctttggacacacggtcgaataccgatcccggttcgaagatcggcttgaatgcggcggtttcgtccggcgcgggctgcgattggctgttttgcgggcggaaccgctcgtcgtcgtcttccgcggccaccgttcccggctgttccgtctgcggctgcgtagcgtgcatcggcttcgactgctgttcggcgggctgctgttcggcagtttccgatgtgggctgttccgccatctgcgattgttcggcggactgcgtctgttcctgggcggacgcgtcagccgcattgtcagccttgtcaacgttgcctgtgttatcgccagtgtcgttcctgtcgagcagagcgacggcgattggcgtgttggggcgcgcgctgaacagcttgtccaccggaatcaggttgttcttgttaccgtcatgggatgcttccaagggccgagcggctgtctcggttgagacggcagccacctcggcatcggtcgcagccgcatcagcggaatcggccgcatcggcctcgatctcagcttcagcctcggcctgcgctgcggcgtcggcgaacaggtcgcggggcttgtccgcggccacgacggtttcctgaaccaaggagaccgaggggaatgcatcttcgagttccggcttgtcggcatgctccggcgtgaaggtctgacgttccgcctggtgcagagcatcggcacggtcggtgacattgcgcgcgtggaagaacgtcgtcggctcgccggcacgcagattgaggatgtcgtccacggacatgtcggctgcatccggttcctgcggagcctcgtcggagaccgcgtattcgaacaggttcgaaaccggctggcttgtatcatccgagacaccggaggtggcgtcgtcatcctcgtcatcgtgttcgaatgcggattcgagcgtaagacgcacgtcgccgaactgcagggtcatcgagtcgatgggcagcttgatgtcctcgcctgcgggcaggcgcatcagttggccgttgttcgtcaccacgaacgagccgttggtggaatgcagatctcgtacggagcaattgccctgcttgtcgacggagaggaccgcatgtcttttcgacatggacttgcccggatccatgatgtcgagacgagcgaacccgtcatccgacagcgggcgcaacggtttgcgcccgatttccacgctttcgccgtcatgaagcgttttcacgttgtttccgtcaactttgacggtccactgccgcgtcattcgtcgatcctcgctcaccgttgtcggccttcctttcgcactacactatctgccattgtgtcatgattcatcgcgaaagtaaggattccgaaccgataaattgacaactttcgcctaattcccccattttagaacatgcctgagtcatgctccatatgcggaaaaccccgctgccttacggcaaacggggtttccactacagcttggtgattgcggcttgaagccgcgcgaatcacttgagctcgacggtggcgccggcttcttcgagctgggacttggccttctcggcgtcttccttcttggccttctccaggacagccttcggagcgccgtcgacgagagccttggcctcagccaggcccaggttggtgatagcgcggacggccttgatgacctggatcttcttgtcgccaacggcggagaggatgacgtcgaactcgtccttctcttcctcagcagcagcgccagcagccggagcggcggcaacagcggcgaccggggcagcagcctcgacgtcgaacttctcttcgaaggccttgacgaactcggagagctcaaccagggtcatctcaccgaaagcttcgagcagctcatcgttggtgtacttagccataatggcttcctttcattcttggcgacggactgaattgaagaggtggccgtcacctaaaacaattgttttttcttttttgtggttgcttcattcatgcggcgagccgcagcgaaatcaggcagccttttcctgcttctcgcgcagcgcatcgatcgtacgcacggccttggtcggcagagcgttgaacaggtacgcggccttggacatcgtagccttgatgtcgccggcgaactcggcgagcagctgcgggcgagacttgaggtctgccagcttcttggcgccttcagcatcgtagacggtgccatcagcgaagccgcccttgatgatcagtgccttgttggtcttggcgaagtcacgcagggtcttcgcagcttcgatgaagtcacccttcacgaaggtcacagcggtcgggccggcgagaagttcatcaagaccttcgatgccagcttccttggctgcaatgcgaacgagcgtgttctttgccacagtgtaggaagtatcgcggcctagcttttcgcgcagttcagagatctgcggaacggtaagcccgcggtactcggtcaggtagatagcgtcggcgtcacggaacttgtccgtaagctgagcgaccaccgcttccttttcgggcctcttcatggcgttccttccttagtcaaccgttgactgtgagattcggaacacctcgcagggcaataaaaaaagccctgcacgcaggcagagcaacattcgaccgctaagcggaaagcccttggtgggcgtatgttcttcaacctgcgctggcttggcgaaccaaacttcgtgagcgcttgcacgctccaaccaacggtctgtggtttacaagtgggtaatttactgacccgtttggactaatccagaccggcgtgtcgcgccgccgcaaaagcaaccccttaccaatcgcacgaaatttccatgacttacataggtgctacgtttgctttgttcagggacgcatgtcccaggcgagtcgcgattctcgccggcgcacgccaccatatggcacgcgcctaccaacccaagaaagatgagaaaagagaaaatggagaaattcttccatctcaaggagaacggcaccaccgtctccacggagatcatggccggcctgaccacgttcttcgccatgtcctacatcatcatcgtcaacccgcagatcctgtcttcgaccggtatgccgtggggcggcgtgttcctcgccaccatcatcgcggccatcatcggcacgctcgtgatgggcctgttcgccaacgttccgtacgcgcaggccgccggcatgggcctcaacgcgttcttcacctacaccgtgtgcttcggcctcggcttcaagtggcaggaaaccctgtgcatggtgttcctgtgcggtttgatcaacatcatcatcaccgtcaccaagattcgtaagatgatcatccaagccattccggaagtgctgcagaacgccatcggcggcggcatcggcctgttcgtggcctacgtcggcttcctcaacgtcggtttcttcaccttcaccaccaagtccgcggccaagagcggcgacaccgtgcaggccaccccgggtcttgccgtcatgaacaatccgaccatctggctgttcatcatcggcctggtgctggccatcgtgctcaccgtgctcaaggtgcgcggcggcatgctgatcgccatcgccgtcaccgcggtcgtcggcattccgatgggccagaccaccatggccaactccgtgtccatcgccgacaccttcgcccagctgccgcagaccttcggcgtgatcttcaccaaggatggcttcccggcgctgttctccgacgtgtcgaagctgccgatcatcctgctgaccatcttcgcgttctccatgtccgacaccttcgacaccatcggcaccttcatcggcaccggccgtcgtaccggcatcttctccgccgaggacgagaaggctcttgagaacggttccggcttctcctccaagatggacaaggccctgttcgccgactccatcgccacctccatcggcgccatctgcggcacctcgaacaccaccacctacgtggagtcctccgcgggtatcgccgccggcggccgcaccggcctgacctccgtggtcgtggcgatctgcttcgcgctgtccgccttcctctccccggtcatctccgccgtgccgtccgccgcgaccgcaggcgtgctggtcgtggtcggctgcatgatggcttcctccttgaaggaaatcgagtggggcgacatctccgaagccattccggcgttcttcgcgtccgtgttcatggcgttcagctactccatctcctacggcatcgccggcggcttcatcacctactgcatcgtcaagacctgcaagaagcaggccaaggacgtgcatccggtgatctgggtcgtggccgtgctgttcattctggacttcatcatcaccgcagtgctgtaacagtccttttcatacggaaaatgggcggttccttcagtggaatcgcccattttttatatcgactttcgtatcggtttggcgcagatccgcattagatggcttgagagaacgcgtcgacgagcgcggccatccagtccgtcagggaatcgtactgctccggcatctgctcggtcagctccacgattggaatattggacgatttggcggcggtgacgatcttgccggtcagctcggtctcctcctgaatgttgaccaccagcaggccgaccttgccggcttccagcatgtcggtgaactgtttgatgtcggtcggcgttggctcgctttcgttggccgtggcacgcgtgtagccggtcggcgtcgcatctttgaggcccaggtccccggccagatattcggcgaccgattccgtggcggcataggcttcgccatccgccttgcgtttggtctccgtgatttttcgggcgatctcgtcttccttggaacgccattgctggttcagcttgtcgaaatcggccttgccgtcgggccttgtgccctcgtatgccctggtgatggcctgtgcgaccgctttgcgcaccgccgccgagaaccagacgtgcgggttgccgccatccttgacgccaccgatctccgccgcgttgatgacttgcgatttggcggattgcgcggctttgacggcccatgagtcgtacccggcgccgttgacgatgacgattcgtgccttctgcagtttggcgatgtcggacgtggtcggctcatagtcgtgcgcgtccacgttggtggagttgatgatgctggtcacctgcacgccgcttccgccgagctgctcggcgagggtgccccattggttgatggaggagacgacggaaatcgcgccatgcgcggaaccggcaccgttctgcgacgttccgcaggcagacgcggaagtgagaaggccgacggaagcgagtacggcaatcgcaattcttgcataacggttcacgatggttcctccattttcatacgcttcatgcttcggtgaatccatcataaccgtaactgagaatgattctcaacagcgcgtgtcgcttccacaagaaaaacaacgaaccgacgccgagagcaatctcaacgtcggtttgcggggaaaaggagctgccgatcagccaaaacgtacaattacagagtctcgcacagcgaagcgctattaactggccagctgaagctgactcgcaccaacccaccgggttggcactacgttttggcgaatcggccttatcgatcagccaaaacgtccggagacgtagcgttcggcttcttcgttctgcgggttgttgaacatcgtggtggtgtcggtgaagtactcgaggtgacccggctggccgacggccttcaggttgaagaaggcggtgtagtcggcgatacgggcggcctgctgcatgttgtgcgtcacgatcacgatggtgtactcgttcttcagctcgttgatcagatcctccacggccagggtggagatcgggtcgagggcggagcacggttcgtccatgagcagcacctgcgggtgcacggccacggcgcgtgcgatgcacagacgctgctgctggccgccggacaggccgatgcccggattgtccagacgatccttgacctcgttccacaggttggcgccacgcagggcccactcgaccagatcatccgcgtcggacttggagatcttgcggttgttgagcttcacaccggccagcacgttctcgcggatggacatggtcgggaacgggttcggacgctggaacaccatgccgacgtcacgacggacggcgaccggatccacatccttgtcgtacaggttcttgccttccagcagcacctcgccttcgcagtgggcgcccggaatgatctcgtgcatgcgatcgagggtgcgcagcacggtggacttgccacagccggaaggtccgatgaacgcggtgaccttgttggcttcgatgttgatgttcacatcctccacggccaggaagtcgccgtagaagatgttcagatggttgacatcaatacgttgtcccatttgttttccttattgttcttatgttttcgactattcgaccgcgctcagcgttccgacttgacggcgaagatcttcgccacgagacggccgatgaggttgaggatcagcacgatgaggatcagcacaagggctgcggcccaggcgcgttccatcgggatggtggtgacgcaggccgcggaagcgttggccgggcagttcgcgttgagcttggaatactcctggtagacgtacaccggaagcgtggtcatctggccggagaagaggttgacgttcgtggaggcgatgtagcctgcggtcatcagcaacggagcggtttcaccgatcacgcgggcgacggcgagaatcgcacccgaaacgatgcccggcagggcggtgcgcagcacgatcttcgtgatcgtgcgctgcttcgtgacgcccagggcgtacgaggcctcgcgcaaatcgtgcggcacgatcttgagcatttcctcggacgacttgaccacggtcggcagcatcagcagggaaagtgcgacggagccttcgaaaccgttgatggtgccggggccgatcagaatcgtgaacatcgagaaggcgaacaggcctgcgacgatggacgggatgccgctcatcacgtcgaccagcagggtgatgacctgtgccagcttgccacggttggaatattccaccaggtacacggcgcacatcaggccgatcgggatggagatgagcatggcgccgaaggtgatttccagcgtgccgatgatggcgtgcaggatgccgccgtagccgccggacggggtcgggttgccgccgaccacgccggtcatgttgtagctcaggaagttgaggttcagcctcttgacgccgttgatgatggtggtgagcagcaccgagaacagcgggatcaacgccacgatgaacgcgcacgagatgagcgccttcatggcgaagtccttgcgcttgcgcgctgaggtgaaggaacgggtcggcttgaacttgtcgaagtcgatgacgggagcgccgtccatcggcgaagcgtcgttatttgcggcggtcatcacacactcgctttctcggtgagcttacgagcgatgaagttcaccacgaaggtaatcaggaacaggaccaggccggtgccgatcagcacggaaacacccagatcgttggcttccggatactgcgcggcgatgttcgcggcgatggtctggttctgcgaggcctgcagcagcttgacggagtagttgaggcccggagacaggatcatgagcacggccatcgtctcgccgagcgcacgaccgaggccgagcatggaggcggacacgacgccggacttgccgaacggcaggaccgcgagcttgaccatttcccacttcgtggcgccgagggccagagccgcctcttcctgaaggcgaggggtctgcaggaagatgtcgcgggacatggaggtgatgatcggcaggatcatgacggccagcaccacggacacggtggccacggtacgggagggattggcggcgggaccggcgaaaatcggaatccagccaaggtatttggccacccaattccagaacgggtagatggcgggcaccagcaccagaccgccccacagaccgtagataacggacgggatggcggcgagcagatcgaccacatagctcagggcggtggcgagcttcttcggcgcgtaatgcgagatgaacagtgcgatgccgaccgacacgaagaaggaaatcagcagtgccagggcggaaatcagcacggtaccgaacagcagcggtccgacgtagccccagaagctggaagccttgccgccggtgaagttgctgatggtcgcgctgttggccttctggtcaccgccgatcaacggccacgcgcggaacagcaggaacagcgcgaccgcggcgagcacgacgaggatcaggatgccgcaggcgtaggccacgcccttgaacaccttatccgcgttcttgccgctcaccggctgctgtgccgttttgctttgcgaactcacgggttctccttttggtttgcttgcgattgctttcgatttttctggttttgcgtatcgtccgtaggtatcgtttcaggccgcagccgttttttacgcggctgcggcctgaaacctacggtcagtcaccgatcacagaaagcgatcgccccactgtgatgggctcacttggttttgatggcgtcgatggacttgacgaccttctgacgcagggtgttggacatcggagcggagccggctgcggaagcggcggtctgctggccttcgtcgctggtcacgtaggtgagccaggacttgacgaacttggcggtgttggcgtccttgtatgccaggcaggcgacgtcgtaggagaccagcacgatcgggtaggcgcccttctcggtggtgttgtggtcgagcttgacgaccacgcggttgtcacccttggcggaatcgtcgagcggggaggcgtccacgaccttggcggcggcttcagcggagaacgggacgtaatcgtcgccgaccttcacggccacggtgcccagatcgccggcctgggaggcatcggcgtaaccgatggtgccgtcagcctgctgcacggtggagatcacgccggaagtgcccttggcgccctggccgacctcgttcggccagttctcgccgaggtcgtagctccatgcgtcgccagcggcgtccttgacgtagctcaggaagttcttggtggtgccggacttgtcggaacggtgcaccacggtgatgtcgaggccaggcagatcgaccttcgggttctgcttcttgatggcgtcatcgttccacttggtgatcttgccgtcgaagatcttggcgatggtctcggcgtccatgttcagggtcttgcccttgccggacacgccctgcaggttgaagacgacggcgatcggggaaatgtagaccgggatgtcgaaggcggtgccggaagcgcacacgctcttggactgctcgacctcgttatcggcgagagcagcgtcggagccggcccatgcggttgcaccggtcaggaaggtggacacgccagcgccggaaccggacgggttgtaagcgaccttggcgtccgggttggtgccctggaagccggcgatccaagcttcgacggcggcctgctgggaagaagcgccagcgccggagaagttgccggaaacggtttcggtcttggtatcggacttggccgaagaatcggtggaagcggtggtgttgtcaccgcaagccgcgacggaagccagcatcacaatgccggacacagcggcgatggagcgtacgagaatggagttacgcattattcttttccctctgtcaacgttcagatggcgtgtgtttctgatttttcgattttctgttgtcgccatcgttcttcatgacaatctccagcctattgggcgtttcactcgccccaaaccaaaaacggtgaacggaagatgaacagtctacgacaccttcgccgttcgacgttccttccgttcaccgttctttgcaagcacgatgcgaatgcgcgctataccaagcctttcatcatcattcgcttggcgtatcgatcttgtatccgaggccgcgcacggtggtcagatacttgggatggcccgggtcctcctcgattttggcgcgcacgcgcttgacatgcacgtccagcgtcttggtgtcgccgacatagtcggagccccagatgcggtcgatcagctggtggcgggtcatcacgcggcccttgttctgcatgaggtattccagcagttcgaattccttcagcgggaagaacacgttctcgccgcggaccgtcacctcatgctggccgattctcatggaaatgtcaccgcatacgagcggaatatcgtcgtcggcggcttctccggattcggcgaccatctggttgcggcgcagcaccgcgcggatgcgtgccagcagctcacggaaggaatacggtttggtgatgtagtcgtccgcgccgatttcaaggccgacgaccttgtcgatttccgcgcttttcgcggtcagcatgatgatcggcacacggctttgctcgcggatccgacggcacagcgcggtgccgtcaagaccgggcagcatcagatcgagcagcaccagatcgataccacccttggtgaacagttccaatccttcttcaccggtggccgcggcggacacgtcgtacccttcacgggtgagctggtagaccagcggctcacggtacgactcttcgtcctcgacgatcagaattcgcgtcatcagtggttctcctcattctctgttgtggtggagtggtcggactgtttcttttcacgggtgttatcattcgccgaatccgccggatggtcgggttccgcagcgcccgaagcctgcggcatcgtgatggtgaaggtggatccctccccctcgcgcgaccatacggagatggtgccgccgcaatcctcgacgcaatgcttggtgatggccaatcccaggccggtgccgccggtttcccgggagcgcgccggatcgacgcggtagaatcgctcgaaaattctgctgagcgacgccgcggggatgccgatgccctggtccacgacgcgaatcgccaccttgccggattcgatgccgatgccgacggccaccgtggtatgttccggcgaatagttgatggcgttctccaccaggttcttcaccgcagttttgatggtctcatggtcagcgaccacgaacacgtccaggttctgttcggcttccttggccagttcctcggcgttcgcatgcaccagcacctgccggccgttcacggacaggaccaggctgatgtgcttcgattcggccttgacctggttttcggcgagcgcctcgcgtgccacggacagcacggacagccgttccgcgttgagcatcgctgccgcgctttgcgctttctgcaggtcgatcagacggtggaccagttccgtcaatcgttcggattccttggagattcggccggagaagtatttcaccgcgtccggatcgtcggccgcgtcgccgatcgtttcggcgagcagagaaatcgcgcctgccggggttttcagttcgtgcgagacgttggtgacgaaatcgcgccgcatgatttcgaaacggcgttgctcgctcatgtcggaaatgaaaatcgcaaataggttgtcggcgatctgtccgacgcgcacgtgcaggtagagcgtgtcttcgggcaacggcttgccggcttcgacgcctttgccgttcgtgttcaccacgcccgttcgcgtgcggccgtgcagggggatggtcagttcgcgttcgcgcaccacgctgtctgtggagaccagtttcacgatgtcgcggatttccgcgagcgccatcgcctggtcgtggatgatgccgaagcgccgcgcggccggggatgcgtattggaccgtggccagcgagtctacgaccaccaaagcttcgggcatgacggccaccagctggcgttccgtggactgcacgggaacgcgggggccgaacagggacgtgttcttcgcagctccgaacaggctcggatcattggggtcgacgccgtcctgcacatcctggaagccttgtctgcggccaagcaggaacgccacgacgaacacgaccacggccacgaccaccaatgccgcaaccaccgacggcgttgccagcatctgctccaacgtcatgcgttcaccttccgataatcctcagttcttccttaagactagcggtttcggagaggctttcgcgtatgcgattctctcacgccaccggaagttttcctgccgttcatcttccgaaacgcagcatatcggaatatgagacgtcccgtttgccgatatgacgatgcatgatgacgggtcatgcggcaaacgggatgtggaaacggcttttcgcaacgttaggcgtttcgcaacgccacatgaacgctacatgcgtttggcgatgttcaccgtcagtttcgcggcggtgtccgcgtattcggaaatgtcgaacgttttgaaatcctcgtagtcggtgtccgcgttgtcgctcagcgcgcgaatcaccaatgcgggaacgtcgttgcgggcggcgacatgcgcgacggcggcgccttccatttccaccgcgtccgcgccggtctcacggatcacctgctcgaccttctgcggatcatcgacgaaatagttgccggtggcgatgatgccgacgatatggtgaatgttcaagtcgttcagcgcctggtcggccagttcgagcagacggtcgtcgctatggtattcctcgatgggccggtcggcggtgccgggcttgaattggcccactaatcgcatgtcggtgtcgagatagcgcagggtgccgccgagcaccacgtcgttgatgtgcagattcgtgttgagattgcccgcgatgccggagaagatcacggcgtccggctggtcagcgtcgatcagatgctgcgtggtggcggcgatgttgacggtgcccatgccgccgacggtcgcggcgacgttgacggcggtgcccttgttggtttcgagggtgccgcgcaccaccttgacgccggcttcctcggtgacggtgacgttgctcagtgccgttgcgatattggcgacttcctcatccatggcgccgatgatggcgattgcggtcattgcactctccctgtcttacgtgctgtcttgagtgttgttttacgcgattgcgattcgcgtttcccgaattttctgcaatcgcgcggatagtgaatcgaatcggtcacttccagcggcgcgcggccaccgcatgggcaagctcgcgtagcagctgttccgtggtgttccagctcaaacatttgtcggtgatggacttgccgtagacgagctggtcgagcggcgcggccttctggttgccgccttcgatgaagctttccatcatgatgccggtgatgccctgctcgcctttggcgatacggcccgcgatgtcacgcaccacctgcgcctgacgatgctcgtccttgccggagttgccatgcgagcagtcgacgatcagcccatgtgccgcagcggaatcggccggcatttcggcgcggatggtgtccatggccttggccaccgaagcggcatcgtaattcgggccgtgcgaggaaccacgcaacaccacatggcagtcgggattgccgagcgttttgaccacggcggcacggccgagatggtcgatgccgaaaaacgtgtgctgttgtgcggaagcgaagcaggaatcggccggagccttgatggaaccgtccgtggcgttcttgaagccgatcggcatggacaggccggacgccaactgccggtgcacctggctttccgtattgcgcgcgccgatcgcaccccagctaatcgcgtcggaaatatactgcggactggtcggctccaaaaactccgtggccgccgccaaaccctcgtcaagcacgccaagcagcgtgcggcgggccaacagcaagcccttcctgatattgcagctgccgtcgatatccggatcgttgatcagacccttccaaccgaccgtggtgcgcggcttctcgaaatacacgcgcatgacgatcagcagctcgccatccaactcgcctttcaacgcggacaggcgacgcgcgtaatcgagcgcggccttcggatcgtgaacggaacacggaccgacaaccaccagcaggcgatcgtcctgaccgtacaggcaggcacgaatctcatcacgcgaataggcgacgatctcctgcgcctgctcgctcaacggcaggtcgcccagcacctgcgccggcgtgggcaacacttcgaattccagcacgcggcggttcacgatgcggctgatgcccacctggtcctcccagcgcggcacgtcggtctccaccagcggattcttgccctcatccatggcctgcctaatggcacgtaaatcctcaggcgtgttcagctgctgctgcatgatctcgctctccttgtcgcttcctttcccaaggatagcaacgatggtgcagaaacatcagccaagcttgcgacgcgcgtcgaccgcgtcggcaagcgtgtgcagcagctgctcggtacgatcccacggcacgcatgcgtcggtgatagacttgccgtattccagctggtcgagcggcgcgggcttctgattgcccgccttgaggaagctttccatcatgatgccgagaatgccctgttcgccggccgcgacgcgtgcggcgatttcttcgaccacttcggcctcgcgcacctcgttcttgccacagttgccgtgcgcggcatcgatgatcagaccatgctcgcttggtccggaagccttggaagccttgagatccgccaacgcttgggccacggaagcggcatcgtagttcggaccatgcgaggaaccacgcagcaccagatggcagtcgggattgcccttggtctccgcggaaatcacacgaccatccagattgatggagaggaaatgatgctcgaaagcggccgcgaaacacgaatcggccgccggcttgatggaaccatccgtagcgttcttgaaaccgatcggcatggacatgccggacgccagctcgcggtgcacctggctttccgtattacgcgcgccaatagcgccccagctgatcagatcgcaaatatactgcggggtaatcggatcaagccattccgtagcggcgggcaagccgagccccagcacgtcggtaagcaccttgcgagccatgaacatgcccttgcgaatattgaactggccgtcaagatcaggatcgttgatcagacccttccaaccgatcgtggtgcgcggcttctcgaaatacacgcgcatgacgatgaccagacgatcatcaagctccttcttgacggcggcaagcctctccgcatactcgtgcgcagccttcggatcatgaatcgaacacgggccgacgatggccagcagacgatcgtcacggccatgcagcacgtcacgaatctcctgacgggacttcaacaccagatcgctcatctcgttcgtgagcggaagttccttcagaaaatatcggggagcgggaatcgggtcaagctgacgaatattgacatccacggtctccggaaacacggcgcgctcatccaacagctgtgcatccttcgaactatccggaccgcgaagacctgccatcgcttctgttcctcccctgcatcgttatgcttgcgtagcgcgatagcgccaccgtcgttaccttaacggatggggacggaatatggggatgggcgactgcatggtggaatgggtggggggtgacgtgggacgaagaaagcgatataggaaagacccaacgcggacggagagtccgggttgggtctttttttgggggaaacgtgcgtcatggggcctgccgggctgaggcgatgaggcctgcagcctcgaaaacgcctgtcggcgttttccctcgcggcggaagcccaccgggcttccgctattcgctcggcgcgtattggccagcgcgcgctccgcgcgctatttggccaatgcgcccatcggatcccacgcggggagcatggtggcgggttcttctagggccttgaggtattcggcgggaaggagggccttggggacggcgacctcgtagacgtattcggtgaaccagtcgtcgctcatggtgaagtagcccttgtcggcgatcttgtctccccacgagttctccacacgccaacggcgggtggtgtggccatcctcatccacatccacaccgacgaacgccatcgcgtgattcatcgcggaatcgccgaaacggacacgctgttccttgtccagatcgaaatcgacgccatacacgcggccatactcgaacaggtcggtggcccacgcgccattctcacggtccatcatcggatggcagtcagcgccgaaccataccggaatgccctgttcctgaagaatctgacgcacgcggtccttcatgaactggttcggcacgttgaggtactcggtcgggtctcccccggccacgttgcccagatgctcgatgccgatcttcttgcccttgacgtgctcctgacgcggatcgtccaccaggcagacatagctttccaaatcggcggaacccacatacttcttccagaactcgacaggcgtgatctcgccatcgcggtggaactcgccatccttgtcggtccactcccaatcgaagctcttcggcggctcgcccaagtgaatcgtcagaatacggtgaccggcggcgaccgcatcggcgatgatcgcatcgatcgcggacggatcagcgtacatatgcgcaaccgcggtgtgcagcatgcggcgcagctgcacgttcatctcaccggtgttcttggaggattcggtctccgggaacagatccttcggcaccgcgccatacttcttgtacacgttcatggccatggtccactggccgccgtcgcccatcacgtcggacagcagatgccgcatcagacgcgaatcggcaggctcgccggcctctaccagagccgccacgtccttcaggaagtagttgacgcgttcgagcttgtcgtagtacatggcgtagttctgggagaactcgaactccttgagacccatgttctgcttggccacgaaacgggccacgttcagcgagctgaacagccagcaacggccggaacggtcctgatgggtgacggtgccgttgtccacgacggtggagaaacgacgctgcatcagacgggcgcgatcgtagttgcgcgccaccttgtcgatgccggccgccgtgacggcgttcatggccatgcgattgtgctcgcttgcttcgaaatcgtcgacgagcttgttcagttcatcaccgctcaatggcgtgatgtcggtcattatccattccctttctatggtttcagttgttctgcgaagcgtctgcggattcggcgtcgccttccggctcggtctcggctgcggaatcgttctcgacggcatcctgcgtgtcggcgtctgccggtgcggcggtctcatcgtcgtgctgcgcgtcgtcatcagattgcgcgtcggaaggctcgccttcatcgacggcgttgaccacggacaggtcgttcatgccgaaaccggagaacgcgttggagaacatggcacgcagttcgctgacgcgctgcgtgatctgggcctcacggctctgcaggtcggcgatgcgctgctgcacgccgtccagttccttcttcgcggcctcacgacgctcgttgatctgctcgtcggcgtcttcggtggcctgcttgaggatgcttgccgcgttcgcgtccgcctcgtcacgcttgctggaagcgtacgcctcagcctcgtcacgggtcttctgcgcggaggaaatcaactcgctggcctgcttgttggcggcctcgcgacgctcgttcaggtcggtgagcagctcattgaccttcttcgtggcctcctcctgctgggcggagatgtcggcgcggatctgctccacttcggcgttgacctggctgatggtcttggtgcggtgcacttccgcctcgtcggtgatctcctgggccttcgccttggcggtgtcggtgatttcggcggcacggcgctgcgcgtcggtcatcatcttggacacctgctcgcgcacgtccgccagcttcttgttggcttcggcaagcgcggattcgatctggtcgttggtctcgctcttcaggcgggagatctcctcattggcgttcttgcgctgttcggcgatcttgctggtcgcctcggtgcgcatgtcggaaatctcacgttcctgcgtggcgcgttcggcggcaagacgcttgccgtgttcctcacgggagttggtcagttccagatcgacggtctgacgctgcgccaccacggccttctgggcctcgctgcgcatctggtcgacctcatgctgggcattggccctcatggcttcggattcgtccttggcgtcaccgagcaccttggccgccttggcgttggcgtcgtccatgatgcgcttggcgtcgattttggcgttgttcagcagtgtttcagcctgcagctgcaccgtggcgcgggccgcggaagcgtccttcttggctcgttcaagcagctcggcgctggtctgttccgcgctggcgagcatctgctgggcgttggcgcccagtgacgcgaaggacttcggagcggccttcttgttcttttcctcctgcagctgcgcctgcagctcaaggatggtctggtcgtcggccttgacctgctcacgcagacggttcaccgtctcctgagccgaagcgaacgcctcgtcgactcgatccttgtcgtaccccctcaacacgattgggaactgctcaaccatgcccttttcctttcacgaattccctacactttgcgcatctgccagcgcgcactcgttcagtactctatctcagtcagcaggcggcacgcaggacgaaatgcattattctcacagagagcacagaaatcgttcgaaaaagtctgtcgggggtatggcggtatgtccgcgaccacgtgtcgaaaccgcatgactcacatgtcgcagaaaatcgtgccgtagaaagcggagccgtcctcagccaagcagaatgtcgcttgacgagggttgcaggaagtatcgtaccgattcacgcagcacgtcatcgaccgcagcggtctgctgttcgatcgacagtccacgttcgtgcggccgaccgttgacgatcggcaggctgacgaaccccgacagaatgcgacgttcctggcccgccggccagttgagcagatggtagaacagcgaattgcatacgaacgtaccggcgtcggaactcaacgcggcgggaatctcgtgtttggcgaaatcgtgcagtatcgaccgcaacggcaggcgcgtccagtacgcggccggaccttccgggtcgatcgggcggcggggcggaatcacgttgtcggcatccggcttggccgcatccatgagatttgtggcgcatcgttccagcagaatgccacgggaggtgcgcttgagccctgtggcgatgacgatgtccggcttggcctgttcgatggcttccagcagcgtgggccaggctttggcgaagctcaccggaagcgtgacgttggtgacggtgacggcgatgtcctgcagcagttcttcggagatcgcctgcgattgcgccggatcggcccattgcttggctaccgccgccggcacgagcacggccggattgacgtcgatgccttcatagggcgtgaaaccggagatgacgatgttgatctgctgcatggtttccagtgtacgtggtgaatgtgttgaacgttaagtctgccgacacgtcgacggacttaacgttcgatgaaaatcaacggctgtgcatctgggagaacgcttcggcgaacacggcgtgcatgcgcgccttggcttcctccttggcgtgttcggggtcgaggctacgggcgatgccttcggcgatcggcatgtcggatggcgtggtgattttgaggttcgtttcggaaccgtccacgatggcgaccggctcgtcgggcaggtagtccaccaccacgcgcgtgtcgtcggtcgggtggaagtcggggtcggcggcggccagttcgtaggctttgacgatggtgccgaaacggaacgcctgcggggtctgcgcgcggaaggtgttcggacgttccggcacggatttgaccaccttgcggtcgcccagatcctctgtgagcagaatcgtgtcggtggaggcgtaggccacggtggcggcgttgaactggtccaagctgtcgatgcagccgtcgatggaccgctcctcgacgaacggacgcacgccgtcatggatgaggattttcgcgccggagggaatgccggcctgtttgagcaggtccagggcggcgagcgtgctgtccacgcgttcggcgccgccgggaacgatggcccgcactttggcgtaaccggcttcgtcgataagctcgttcaccgtctcttcgacacgttcgttgaccaccacgatgatgtcgctgatgcggtcgttgttttcgaatgcctcgatgctccagcagacgattggcttgccgcccaccgacaccagctgcttggggttgttctcgtcgaatcgggtgccgaatcccgctgccagcaccacggccacgaccggcatcttctgttcctgcatctgctctcccttactcatatgctccaccgtaaagccgcggccgcatgccaccccgttccgcggcgggttctgcacgcaatccgcaacagtggccacgcgaatcactcgaatcgcgtggcttgtatggctcgtatggtgattattcgcgtacgatcagcgccagcatgcgtccttcatgctgttttttggcgagcgacgcgcggcgatgcgagaaccacaacgggttttcgagcgtgcacaggctgcggcggatcttgttgaaccgttcggaaagcttcggatcgccttcgccatcggcggcgcagatgccggccagttcctcgtcttcggacaggtactgcgtggccgcgttgacgcgtggacgggatgagacgatgttgtcggccggcacgcccgctttggcaagctcctgcagggcggccgcggcgatgtcgatgcccggctggccaaatcggctcaacgtgaaggttcccgggaactgcgcatcgaattcgtcggcgatgtcgccgccgacctcgtagcagtcgccgcagatgcaggggccgagcgtggcgacgatacgttccggctgggcgcccttggccaccatcttctcgatggtcgcgccgatcacgcctttctgcagaccgcgacggccgcagtgtgctgcgccgatcacgccggctttgggatcggccatgagcaccggcaggcagtcggcggcgaacatgccgagcgccacgttcttccgggacgtcacttggccgtcggcttcgatgacggtcggctcaccgtcattccccgtcgcgttgttttcgccgtccgtctcgtcttccggcttcttcgtgccggacacgtcgaatccgaacggctggttgatgacgaatgattcgtccacgtccaccgcgtcgccggaatgcacctggctgatgaggctgattttcgcgccgagcacgtcggcgagcgccttgcggttggcgagcacgtgttccggtttgtcgccggatttgccgccgaggttgaagtgcgcgaaatcgccttcgctggtgccgccgagtcgcgtggtgtagacgactttgatgccgggggccagcatgatcggaatggtcacgggaatcgggttgccgtttttgtcagtggggtcgatggcgttggaatcgaggatcgcgtcatcgtattgtgtgctgctcatgtcttgtttttccttggttttgcgattggaaggcctgcttgcgattgccgtcttctattcggctttcagcgtcggctttttcgtgcgcgagcggatggccgcgttgacgggcacttcctgcgggcacggcatggagaagacgtgcgcggggttgttgatggcttcgacccagtggccgtcggcgtcacggaaaccgccggcaggcacggtgtaggcgaagggggccgcgccgggcagcacgaattcgacttcctggccggcttcgatcttgttgcggctcatgatggtcacgcgtcctccgtcttccggactccatgacagcacttcgccgacgacgagccatgcgcggaagtatgcggaacggtcggtgctttgctgcactttgtgttccggatagtagaagccggtggagtagtcgcggtgcgccactttgtcgggctcgtcgagcagccaatccggcagggtgacgtgtggtgccggccgtacaccggcgtgatgccagccttccggcagtatttcggcggcggtgttcgacttgcgtcgggtgctgcgtgcgtggtagctcagattgtccggctcgccaatcgcgatattgccggacgaaacgttgccagccgaaacgttgccggacggcacgcccccaacgggaatggcgtcgatgtcgggcttgcctgcgaacgcgccatcggcgttggccatgatcgcatcctcggtgtccggcttgccgtattccgggtcaccgggacggatcacgcggtcgcggaacggcttcagcacattgccgtcggcatcttcgaagccacgctggaccatgtattcgttgacggccgtcttgtaggcgttcgtcatggcggcgatgtagtaggcgctcttggaacggccttcgatcttgaggctcgtcgcgcccgaatcgagcagatcgtcgatgtgggcgagcatgttcatgtcctgcgaattgaacaggtacgcgccttccgcggtctgttcgatcggaaaataccgaccggggcgtttctcctccacgatggaatacttccagcggcacggctgcgcgcattcgccgtggttgccgtcgcgtccggtcagatagttggagaacaggcagcgtccggagaaggccatgcacatcgcgccatgcacgaagcattcgatgtcgaggtcgtcgggaatgcgggcgcggatgtcgcgcacggcctgcaggtccatttcgcgggccagcaccacgcggcgcgcgcccagttcgtagaacgcgttggcggcctggtagttggtgacgccggcctgcgtgctcacatgcagttcgaggttcggagccacctgcttggccatgagcatcacgccgatgtcggagacgatcagcgcgtccacgccggtgtccttcagcttgccgaggtattcgcgcatggcttccacctcgttgttgcgcggcagcacgttgaaggtgacgtacacgcgggccccacgctcgtgggcgtagcgtgcgccttcctcgaaatcctcgaggctcaggtttttcggcgcgctgcgcatgccgaacgccttgccgccgcagtagacggcgtccgcaccgtaatcgaccgctgttttcagtcccctcaaattgcctgcgggggccaacacttctggcttgtttcttctttgcacggatgttcctcttactcgtaaaagaccatcagatattgtcgtagattcacgggacaggcaaagcccgtccagccgttacgcaagctcgggctacgccaggcgctacgccagctcgcgtgcgacggcggcgagtacgtccactgcgtcggcgaactcttccggcgtggtgtaggagtagctcaggcgcagggagttgtcggcggcgaaatcgtagatgtcgccggggttgagcagcacgccacgttcggcggccagctggaacaggcggttcatgcgtatcggccggtcgaaggtcatccaaatgtagaagccgccggacggcacgttccagtgggcgagcccgtccattttctcctgcagcgtaacgagcgcgcggtcgcggcggtgccgcagctcccgtttcaggccggccacgtattcgtcgtacatgccgttcgtgaggaatcgcgcgaacgtccactggctcagcacgctcgcaccgtagtccatctgcattttcacgtcggcgagccgctgcacgatcggttcggcggcgaccagccatccgatgcgcagtccgggagccagcgacttggacgcgctgccgagcgtgatgaccatgccggtctcatcgagggccttcagcgacggcagcggggcatcatcctcgaaatacaggtcgcggtaggcgccgtcctcgatgatcggcagtcggctgtccacggaaagctcgaccagttcatgccggcgtttgtcgctcatggtgacgcctgtcggattgtgattggtcggaatcgtgtacaggatcgcattgcctttgcggttgcgcgcgttgagcggcgccggacggccggtgtcaagctccccttccgccagcaggccgcgcaatgcctgcacgttgaggccgtcgtcgtccatcggcacgccttccagatgcatgccggccgactggaacacctgcagcgacttgatgtagctcggcgattccgcgtatacggtggtgccggccggcagcaggctcaccgaaatcatctgcagcgcctgcaacgcgccggatgtgaccagcacctggcttgccgtgcagtcgacgccggtggcgcgcatgtgcgccgcgatggcctcgcgcagttcgggcaggccttcgggcggcgggtagccgagcgtttcgatctcgtccgcggcctcgccgagcacctgccgccacatggctttcggaaagagccgtgggtcgagctcgccggtgccgatgcgcgtcatgttcggcgtgaactcgtaccggttgatggcttggatggtgtcgttgttggctttgaagaagccggaatccacgtaatcggcccagtcgggcgcgcccggcagcatcagcgaccacgtgttgctgacgattcgcgtgcccgctccatgctgcccttcgacgatgccataatcggacagctcgttgatggccgcgatgacggtggaccggttcacgccgaaccattcggcgagcgcgcgttgcgacggcagacgcgagccaatcggccaattgccgctgtgcacctgttcgcacatgtacccgacgatttgttcggtgacgggttcgccggtggtacggtccggtttccaatcgatgttcagcggcgcgatgcgtgccatgacgctccttcacattggtggtgtcggtatggttcggcgttttccgcggtcggcgcatctggtttctgacagtggaccgtcctgcgattggctgagccaaacctcagcttttggctggttgcctattgtagcaacacctatacaatatgacactggttacgttgtttttcgcagaatagaggtttttcctgcgattacaaaatgagtaatttggttggttttggctgggttgattacaaccaaccaaatatgtttggatggataagaggcgagtatgggattctttttccaagggctgacgttgggattggcgtatgtcgcgccgatcggtatgcagaatctgttcgtcatcgattcggcgctgaccaagccgcgccgccgcgcgctgctgaccgcgctgatcgtactgttcttcgacgtgtcgttgtcgctgtcctgctttttcggcatcggcaagctcatgcaggaccacgcatggctgaagctggccattctggcgatcggcggcttggtggtcatccgtatcggcgcgggtctgctgtttcccggcaagggtggcgatgatggcgccgcgcaaacgccgcagtcgcagacctcgcaatcgcagggccttgcgcaacgcgtcacttcgaaattcggcggcgacagcgagctgctgcacaccatcgtcaccgccggtgtggtgacgtggtgcaatccgcaggccatcatcgacggcacgctgatgctcggcgcgttcagcgcgacgcttaccgtcggtcagtccacgccgttcatcaccggcgtggaaaccgcgtcggcactgtggttcttcggcatcaccctgctggtgtcgctgttcagccacaagttcagcccgcgaatcgtcaccgcgatgaaccgcgtgtgtggcgcggtggtggtgctgtacggcgtcaaactactagctgatttcgtgatggccgtgctgtaatccccgatagccgtccggttccgcaaaaacgtatgcccgtccgtgttttgctgcccgagctgagtggttgggttaacaaaatgcggacgggcagtgctttttcagccgaggaaggcgagctcctcgtcagtgagttcgagctcgtcggccttcagggagtcgaggatggtttcgggacggtgtgcgcccggaatcacgaacatgtggtcgcccttggccagctcccaagccagcaccacgcgctggtagctcacgccatgcttggcggccacttcgcggaacgggtcgaacagatgctcgtcgtacgggtggcggtagccgccgagcggactccagcacacgaaggcgagaccttccttcgcgcagtattccaacgtgtcctgggtttccagatggatcggcgaatactggttctgcacggcaacgagcttgtcgccgagaatctcctgtgcgattttgagctgttcgatgctcacgttggacacacccgcccactgggcaacgccctggtcgagcagcgccttgataccttcgcaggactcgttgtacggcacttccggatcgtggcgatgcaggtagagcaggtcgatcgagtcgacgccgagcgcctgcgcggactgcttgccgtattcgatgaggtgttccggcttgccgtcgcgcggccagatcggcttgtcgccatcccacgcgcggcgcagaccgaccttggtggccacggtgacttcctcacgcggccccttccatgtgtccagcgcttcgcggaccagcttttcgccggtctgttcctcttcgcccggcgtgtagtaggcccatgccgtgtcgatgtggcggcagccggcgtcaagcgaggcgtgcagggtttcgatgccgacgtcgtggccccggttgttttcaatggttagcggcatctcgccgtggccgatggcggtggtgtggaacggtccgagattacggaacaacgtcatgtcttctccttcgaaagtggtgtcttccggcaggcgcgagccggttggagccgggtcggaaccaagtcggacggcatctcgttcaggttctgccaatggaaaagcctaccaatcgccatgggcgaaaggtaggcttttcaagccggaccgggcgtgggcaaacacaatgccgacaatcgcaatgtcatagggcgtcacgttgtccgacggcgggcggcatgtcgtggatcagcggccaccgccgcctccaccgccgccgcctccgccaccgccgccgaagccgccaccggagaaggatccgccggagccagaggatgaggaaggcgcggccgcggaaatcgtggaactcaccgaagcgaaaccggaactcagctgcgaaccgatatcgccaatgccgcccatgaactgcgatccgccaaacgcaccggtcgacatgcctcccatagtggacataccgttccacgcgtgggagcgatacgtccaatagccgagggaatcgtacccatacgcgtcaagccattgcggatcgttgacttcggggtacgccttggcgaattcctttgccaccttgtcggaaatgccgaaggcggccgcatagaccatataccagttccacatcaccaaatcgagcgcaccacggtcggagaaattggagaaatcctccatatagcgtttgagtcccaagcattcgccggcataggtctgtccggattcggtgaggccttccttgcgtccggtagctaaacagaacgtgccgacgcatgcgaacgcgccgccgaagcacaacgccaccgcgatattgcttccaatattgaccagcattccaatcacgccaaagaccatggcgaagatggtgggcgctatccaacgtccgctgacatccctgaccgcgttcaattgcaggaattcaatatcgcaggcattggtgaaatggttcatctcctgatagccgttctcccagctggagcaagcctccttcatctggttaaagtcgaataccggcgaacccacgcgtgcggaaatacgaatcagcagttgcaggcaggcttcctcggagcgactcagaccaagggtttcccgatgggatagcgcctgaggcagaatcaccaacgtactagtacttgacgcggcagaggcacgggatggatcggaggaaatcatgcgcgccatatcggccgcgttcgccctgctcaggtcgatgccacgatacatgtcggcaggtcccggatatacggcgagcgctttcttgaccaccaatgccagcaccgtcgccgtcatggcacgcgaggactgttcacccttggaatcgtccaccacatcgatcagatgcgcggcgcaggcagggctgacttgaggtgactcacgccagtattcgatgccaccgtggtaggtggcctcacggtttgaggaaatcacgccgcgaaccgccagcacgagacacaatccgcccaatacaaggcataccagccagcctgcgacggtgagctgcgctttcaaccgttggctgtcgcgccactgttgttccttggcagcctccgtgtctttcagctcgtccagatagtcgccggaccgtgtgcgttcgacgccgcttgcgccggtgttgtcgaaggccgcgacgaggtcgacgtatcggtcggtacgcaggtcgctgatggtgaaatgcaacgtgccgtccgtgtcgcgagacgtttgagatgtggcctcagtgtgcagccatgcccacgaatcgtcggaaccgatgcctttggggaagcgcacggtgccggtgactttgccagccggcacctggttgtcttcggggaacatctcccacatgagattcgtcacgtcactatgctgcgtgcccatgttatgaaacgtcatggtcacgtcgaatttgagactgctctgtttgacggtggcgggaatgttccagccgatttcgatttgtttgtcattgtccgaaccgttggggtcaagcccgccggtggcagagtcgaatggttccggatagttggagccgattgtggtgtcggcgatataccaatgtccggcatattccgattcccattcactgtcggatacatcgctcggcaactgcggcgcgatctgtgtgtattcctcaccggtggacacgttgattacggaaatgtcggtgatgttcgtcagatcctggttgcgcagtttgaacgtcagatatagctgtttccacggtttcgtgtcgccgtcatcattctcgcgctccttcaactggtaatccagatgttccgtgaaacggatgtcgccgttgctttgcagctgcgcgtcaaaatcgacggaacggtagcttagatcggcttcgtcgccggagacgaagaacagcaggagcgctacaacgagcaccgcaacaaatgtggcacccgccgcgagcagtcctccacggacacgtttcgcatccatataccatcaccctttcttcctgcgtataccgtgtgccactcgtatatgcgtatcgcacatgtcagcgtcctccgaacgaaccgccgccggagccaccaccaccgccgtcgaaaccgccaccggagaaggaaccgccggaaccaccgccaccgaaacccgagccaccggaggacggcgccgccatggaaatcgtgttgcgcacgtcggcgaaactggagctgagctgcgcgccgaaatcgccataattcgcactgaacaccgacgcggcggcaacacttgcacccaccgcagcgccagtggacgcgcccataacgctgctggaatgcaacggcatgtacatgtacgacgaagcggcatgctcatccagccactgaggatcggccacttccggatatgctttggtcagctgcgccatcaccttgtcggaaatgccgaatgcggtggcatacaccatatatcggccccacaatgtcatatcaagcacgccacggtcactgaaatcactgaaatcaagcagatagcgcttcagcccagccacttggccaccatatttctgaccattgtcggtcaatgcatgatatttgccatacaccaacgcgaatgcgcaggccagcacgacaggcacacagatgctcatcgtcactgcgatctcacctctctccgcgtaccgcacgcccttatagaacgcgaaaacaagaccaagaatgccgaccagattattcaggaatcccctcgatgaatcaacggcgcgcagattgtcgaattccgtggagcaggcggtatcgaaatcctgtagcaacttgtagccctttttgtagtgtttgaacgccttgttcatctgtttgagatcgaatacctgcgtatccctcaaccgtgaagacgctttgagcaggatgtcaagcgccgcatgttcggatgagctcagcagcagcgaaccgatgtcattgcgcgccaccggcatgatgacgatggtgctggtcttcttcatcttgcgtacggttgcggcgtcagagccgagcctgcccgccactgatgccgcgttggtcgtggtcaggtcgatgccgtcatacagtttcgccggtccgggatagatggcgattgccccttttgacgcgagcgacatcacagtggaggacatttgccgattgactagtttgtcgccgttttttattttgcctgaaccgagaatcgaagatgacgcgctcatgacatcattcatccgtgccgcggcggccggactcatgtagggcaaatcgcggtaatattcgacatcgcctttgtattgcgacttacggaagctggtgataccgaggtacagcgatcccataatgaacgccaggccgatcagggccgaaacagcccaaccggtcactcgcttgaccgcttgatcatgctgtttatcgcgccattcctcctctttctgagtttcgctatcgatgagctcttgcttgtggttgccgcttatcttgcgttccacaccttgcgatttcgagacatcgaacatggccacgacgtccagatagtcgcctgcacgcacgtcatcgaccgagaagagcagcgacccgttcttgccgcgtttcgcggtggacgtgttcttggtatgcaaccatgcccaagaattcttcttggtgacgccgtctgggaacgtgaccttgccggtcaccttgccaatcggaatctggtttgtcgtgccgaatggctcccattggaaagagacgacgtcgtcataggcggtgcttacgccatgcatggtcatggacacatcgaatttgaggctgtcagcggacgcagtttccggaatgttccagccgatttccaaagtcttatcggatgaggagtcagctttcaaaccatctgtttcaggattgaacggttggggatctctgagtacgctgacatccgcgatataccactgacctgcgtgttcagcgttccaatcggtgacatcattgggattcacaaatctaccttggatgtacgtttcgttgttggtgacatccttcacgctgatatcactgatattcgtcagattattggcttttagcgtgtactgctggtacatctgtttccaatcaaagccacggtcattcagcttcatatcaatatgctgcgtgactttgaggtcgccattcttaagcaccataacatcgtaatcgagcgtacgatagctcaaatctggttcgacgtcggacgtcaaattcacatccagaaaagtgacgcccaacagcagcgcggccgcgaccaccgcagacagcataccgatcagcgcacgtctgatattcataagttctctcttgaccctctatgcaggcagtccgcgagaagccgacataccgtatagacaaaaagggagtaccggcgaagtatccaccccgtcagcgctccccttcttttgtatggaaatgctgtatggaaacgctcagaacttgacctgcggagcctgacggtccgcttcgtcgacctggaagtacgccgcctgctcgaagtggaacagtccggcgatgatgttggtcggcacgacctcgatcttggtgttgtacttctgcaccacatcgttatagaactggcgggcgtaggcgattttctcctcgagcgccttgagctgggcctgcaggtccaggaagttctggttggcctgcagctgcggatacgcttcggccacggcctggaggttcatgatcgcgcggctcagctggttttcggcttggatgcgctgtgccacatcaccggactgcgccgcctggagtgcgctggcgcgggcctgggtcacctgtgtgaacacctgcgattcatgggcagcgtaccccttgacggtctccacgagattcgggatgaggtcggcgcgctgcttgagctgcacgtcgatctgcgcccagccgtttttgacgcggttgcgcaatgtgaccagaccgttgtaggcggacactccccacagcactatcaggacgatgacaatgagtgcaataatgccgaatatcatgtgaaaatccttgcttctttgcttgtttatttgtctaattttcgcatgagggctacacatttcgttgtattgtcggttttccatgcacccgtaaatcgattgatgccaatattcgcacagcatgtcgaacgtacgaaaaacccaccccttacggagtgggtttttcgttagattacctatcggcttcgctgcgaagaatccgtgagaagacgtcagtcttcgaatgctgagccgtcaagcgagaagcccagtgggcttctcgtaggtgaagtgagcagcttcgctgcgaaggatccgtgagaagacgtcagtcttcgaacggatcaaagtcgcggcgcacgcggcgacgcggacgctcggagcgctcttcgcgatcggcacggtactcgtcgtagttctcgtcggcggcgtaacgcgggttgcggtcgtcacgacggctaccacggcgacggtcggaacggcggtcatcgcgatcgtagtcacggtcatcgcggtcggaacgacggcgacgcggacgatcatcataatcacgatcatcgcgatcggaacgggacgaacggcgatcgtcacgatcgtagtcgcgatcgtcacggtcggaacgacggcgacgcggacgatcatcataatcacgatcatcatcgcggtcggaacgacggcgacgcggacgatcgtcgtaatcgcgatcatcgcgatcatcggaacgacgtcggtcgtcacgacggccacggccgccacggcggtcatcgcgatcgccacggtcacgacgcggagcggaggattcctgatcctcgaagcccgggatggcaagggagatcttgccacgatcgtcaacaccctgcacgaccacctcaacggtgtcgccttccttgagcacgtcttcgacggcgtcgatgcgctcgccgttggcgaggttgcggatctgggagatgtgcagcagaccgtcggtgcccggggtcaggttcacgaaggcgccgaaggaggtggtcttcacgaccttgccgttgtaggtctcgccggcttccggcacgtgcgggttggcgatctggtcgatgatctccttggccttctcggcggcctcgccgccttcggaggagatgtacacggtgccgtcatcctcgatggcgatttcggcgccggtgtcttcctggatctggttgatcatcttgcccttcgggccgatgacctcgccgatcttgtccaccggaacggtggtggtgatgatgcgcggcgcgtacgggctcatctcggccgggccgtcgatgcactcgttgatgacttcgaggatggtggtgcgggcttccttggcctgctgcagagcggacgccaggatgtcggccggaatgccgtcgagcttggtgtcgagctgcagggcggtgatgaattcggaggtgccggccaccttgaagtccatgtcgccgaaggcgtcttcggcgccgaggatgtcggtgagcgttttgtagatgtgctggccgtcgacgtcgccggacacgaggcccatggcgatgcctgcgaccggagccttcagcggaacgccagcggcgagcagggacagcgtggaggcgcagacggaacccatggaggtggaaccgttggagccgattgcctcggagacctgacggatggcgtacgggaactcctcacggctcggcagcaccggcacgagggccttctcggcgagggcgccatggccgatctcgcggcgcttcggggagccgacgcggccggtctcaccggtggagtacggcggcatttcgtagttgtgcatgtagcgcttggactgcgggccggacagcgcgtcgatctgctgctccatcttgagcatgttcagggtggtgacgcccaggatctgggtttcgccacgctggaacagcgcggaaccatgcacgcgcggcacgatgtccacttcggcggacagggtgcggatgtcacgcaggccacggccgtcgatgcggtagtcctgggtcaggatgcggcggcgcacgatctggcgctgcagctccttgaacgcgttgccgatttccttgtccttctcggcgtcttccatgtcggtgaactcgccggcgagggtggccttgacgccttccttgatctcgtggatgcggtcctggcgcggcagcttttcggcgatggacagggcttcgtcgaggtcggcgtgggcgatctcgtcgatgcggttgtacagatcctcggtgtactccgggaagagctggaattccttggtttccttcgcggcgatcttcttgagctcggcctgggcctcgcagatcaccttgatgaacggcttggcggcttcaagaccgccggcgacgacttcctcgtccggcttggtctggccttcgtcgtagatgaggtgccatgcgttcttgccggcaccggcttcgatcatggcgatggcgacgtcgccgttctcgacaacgcggccggcgaccacgatttcgaacacggcgcgttcgcgctcgctccagcgcgggaaggcgacccactggccgtcgatcagggccagacgcacgccggagaccgggccttcgaacggcaggccggagatcatggtggaggcggaggcggcgttcagtgcgacaacgtcgtatgcgtcatccgggttgacggcgagcacggtttcgacgacctgcacttcgttgcgcagggtgtgcgggaacagcggacgcagcggacggtcgatgatgcggcaggccaggatggcttcggagctcggacggccttcgcggcggaagaacgagcccgggatcttgccggctgcgtacatcttctcttccacgtccactgtcagcgggaagaagtcgtagttctccttcgggctggaaccggcggtggtcgtggacagaatcatcgaatcatcgtcaagataggcggcgacggcaccatccgcctgctgggcgagacgaccggtctcgaagcgcagcgtgcgcttgccgaatgaaccattatcgattacggcttcaacagccttgatttcgggaccctccatagggttcctcctttgttttcttttcttgtgtacctactatcggcagtcctcttcagcggactccaaccgattcctacatgcgtgacgcggcgttacctccgccgcttcctcatctctagattctagacctcgtgcgccccaaacctcgggccttcaaactgtctgttccttgaactcggctgtcatgcaaaaaacgcccgggcgccatgtgacgctcgggcggaagaatgttatcggcgcagacccagacgctcgatcagggagcggtaacggttgatgtcaacgcgcttgaggtaatcaagcatacgacgacggtcgccgaccatcagcagcagaccacgacgggagtggtgatcgtgcttgtgctccttgaggtgctcggtcagatcagcgatgcgcttggtgagcagagcaacctggacctccggggagccggtgtcaccctcgtgggttgcgtaggtcttgatgatttcctgcttttcctcagccgtaagtgccacggcatcctccttattttgctgcgcggtgctgccggcccaataccggcgcgctctctatccgcgggcgaaacacgccaaggaaacatcttacacgacgtccggaccaaaatcgccggccgatatttccgcccccgccgacggccgttcttcacgtcacgccatggacgtgagcagaccgccgaacaacaccacggcaagcgcgacgagttcgattgcgaagaacaataggaacgaggcccagctgcgtgtgaggacgttgagcttcgattccttcttgatgcacaccagcaggcccacccagagcaccgcgtagaccgcgacgccgaaaccggcggcgatgatgccgagattcgcggcgttcgccagtccggccgcctcaccgtacatcacgtaggtggcgttccagaagttgaagctcagcaggcacatgccggcgacgaattgctccgcggcaaggccgatcacgaaaatggccccccacagccatttcttcgcgtccgcgaccatcagtccgagtccggtgagcgccacgatggtcaccgtccatgaaatcagcgccacgcctttgggatcgaggaaattcaggttcgccaccatccatgaggcgtcccgcaccgcgatgtcgcgtccccaccagtacggcgcgatcatggccagcagcaccaatgccatgaacagaatccagcggaccggatgcgatttgcggcgttcgatgtcggccaaggacaggtccgacggttcgatggacgccgtcgggtgtttggagacgtcgacggtctcgaccacgccatccacgacttccgttgccttgttgcgttccttctgacccatgttccgctccgtatatattgcgatatcttgcgattgcgccgccgcacgccgcggcccgttccagcatacccgggcaatcgtatgcccgggcatacggatatacgaaaggcgtgccttgaggcacgccttcttcttctctgatgctgttgtggagcggatgacgggaatcgaacccgcgtaatcagtttggaagactgaggctctaccattgagctacatccgcgtgttgccgctacggccgaagccgacacgaaacgactcgagctattatacacatcccaccaacttttgcaagcgggaatggcatttcagatttcgagcatgaccacggcggaggcgatcggcccgtcatggcttatggagatggagatatcgtacgactggcgcaccggatccaacggcaggcccaacgactgctgcaccttgcgttgcacttcggaggacagtatgacgcgcggcacgccgtgggaatcgtcgagaatttcgatgcgcacccatgggaagttgtcgagcgtgtacggatatgcgacttcggcgccgtctttcgcatgccgcgaaatggccgcgcaccacgctttcaggaacgcctccttgcctgcccagcgggcggcgaggtgcaccgcctcgtcatcatgcttgagctgcgaccgttgcgccgtctgccatatctcgcgcatggagaacagattgcgcatacgcgtccccggctcattcagctgcttggcgaacgcaggcacgtcaacgacgtcatgccctagacccagcattcctccgccttcctaggaattattgatcggggttaccccgggaatgccccgaccatgtcatatggaaaagggcgatacatctgtgcagaagtatcacccttttcttatcaggccgtcatcatttgcccatatttaggacagatttcgacgtagccgtctcacgcttcgaaatagccggtggacgcaaggcgcgcgttcggatcgagcagcatggccttctccacttcgtgcgcgtcgtagccgcggccgtcctcgtggaagcggcggttgtcgatcggctcgtagagcgcggcgcgtcccatcatgccctcttcaaggcgacgctggccggcggcgagacgcgcgttggcacggtcgcgccattcgctcagcgcgtcctcgccgacggtgttcgccacggaagcctcgaaggcgcccgggttgacgatcgcggcgaaaccggacacgtggccgaagccgagcgacgtggccaggccggccttgacggaaccgaccttcagcggctcgcgcagccagaccatgtggtcgtcgcgcttgagcttcgggtcgacgcagtcgagggccgcgttcgccggaacgacgccggacttgaacagctgggtcaggccgttgacctggaagatgcaggcaccgcccttggcatggccggtgagcgacttctgggagatcacgaacagcgggttgccgtcggtgcggccgatggcgtgggccagcgtgttgtgcagttcggactcgttcgggtcgttggcgttggtggacgtgtcgtgcttggagaccacggcgatgtcgtccggcgtgacgccgagcttggcgaggtcgtgcacgagcttggagtccttgccgcccatgccagctgcgagcgcgcccagtcccggagccgggatggaggtgtgcgcgccgtcggcgtaggagtggacgaatccgaccacgccggcgaccggcaggccgagcttcagcgcgatgtcaccgcgcgtcagcaggatggtgccgccgccctgcgattcgacgaagccgccgcgacgacggtcgttggcacgggagaagaagcgcgcgtcgatgcccttggcgtacatctcctcggagttggcggtggcgttcatgttgccgaagccgatcacggattccacgccgatgtcgtcgatcgcgccggtgaccacgaagtcggccttgccgagggcgatcttgtcggcgccttcctcaagggagacggcggcggtggcgcaggcggagaccggctggatcatgttgccgtagccgccgatgtaggactgcatcacgtgggccgcgacgacgttcggcagggcttcctgcaggatgtcggtcggaatctcgtggttgaggaaccggtcgaggtacagcttcctcatggaggccatgccgccgaagccggtgccctgcgtggaggccaccatggacgggtgcacggcttcgaggatctcggccggggtgaagcccgcggacaggtaggcgtcgaccgtggtgacgatgttccacagggcgatcttgtccacgtcgccgaccatggaggccggaatgccccacttgaccgggtcgaagcccttcgggaactggccgccgacggtgcgggtcatggccgcgcggcgaggcacgcggatcatggagccggcgtggcgggtgacgttccactcgccggattcggcatcggccgcgtagctggtgtgggcttcgtcgagcttgacgtattcctcggcgatctcacgggtcggaacggagaaggtcacatcgtggtcgaggaacacctcggcctcctcctcgtcggcaccgtccttgtaatcgttgcccatgccctcttcgaacggacgcacgccggagcgggccacgacctcgtcgtggtagcgttcggcgatgtcctcttcgggcaccaggttgccgtcggtgtcgtaccagcccggcttcggactgtcgttccaggtcagcaggcccatgttccaagccagttcgagcaccgcgccggcggacaggtcgaccttgccgtcggagtggatgccgagttcggcttcgaaacgggtgcggccggagccccacggacccagctcgccgatggagacgatgacgatctcgtcttccggacgggcggtgacgtgctgccaatccttcagatcgaccttcgcctgacgcggggcgcgcgggctcggcagcgccttgatcagcgttgccgcagcggcacaatcgccctgcttgtcctcatcgccggcttcggcggcagcggccttggccgcgtcctccatggcttcggcgcgcagtgccttgatgtcgatcggctcgctgccgaggccgccggtcaggtccacgtcgagcggggccttgacggcctgctcgcgggattccttggtggacagctcgagcagcttgaccgcgatttcggcggtggagtaggtcttcaggccgtgacgttccacgacttcgaccagcggatcgttgccgcccatcaggccggtgccacgcacccagccgatcttcgggtgggcgaaggtgacgcggctggaccacaccttttcggcgcgggcgcggttgacgatcgcgtcgaaggcgctcttgacctcgccgtacgcgccgtcgccgccgaagacgccacggttcggggagcccggcaggatcacatgcagcttgtgctgcacgtcggtgtcggcgccgatcttcgcgaagccggtgatcgcacgttccacaccccacagcatgaggcgcgcctgcgattcgaacagctcgccggaatcggccaacgtgccgtgcaccggcggagcggcgaacgggaagaacaggctcggctcgtaggcgggcttcagaatcgtggtggtcgcgccggaggtcttcttctgcacgttgccgacccacgccacgagagcgtccacgtcacggtagctggacaggttcgccggaacaagccacagcttggcgtcgcctgccgcatgctcgcggtaggtctgtttggcccatgccttcacgctctgcctgaagctatgcgaggtggccacgacggtcgcgccgccggccagcaggccgttgacgacctgtgcggcgatggagttcggggcaacgccggtcacgacggcgatatcgcctgcgaaacggcttgcttcggcggattcgtccgtctgctcgagcgcctcgccggccacgcgcttgaacgcggcggcaagctcggcgtcagcggtcttgcccgcgtaccatgcggcttcatcggcgacggccttgcccaggccgatgaagctgccgtccagtgcggaggcgtcgttgtcgtagtaggcgcgggacaggtcctcgcgtgcggatgcccaacggtcgtcgaacaggatggccttgcgctcgtcgaagcgcggttcgacctgcttcggccagtcggagccgagctcggcttcgacggcggccaccacggcggcgttctcgtcggcagagtcgtcggccaccggagcggtgacgcccagctggttcagcacgaacttggcggtggaggcgagcacgccgtcggcaccggtcaccttggccgcgaacgcgtccagggctgcggaatcgaccacggcaccgccggctgcgccacctgcgctcggcatggcgacggccacgcccttgtcggaggcgaccttctgcacggccgcgtcgatcagcgcgttggcggcggccgcgttggaagcggcttcggtgctcagcgaggcgaggtcgccaccgcgggagctggcgccttcgcgggtttccagcacaagggctgcgaccacgtgggaggcccagccttcgccgagctgccaggtgtcggtcacgcgcttggtgatctggccgagcttcacgccgacggcgccgaacaggccgcgcacacggtcgcggacgatgtcggacagcaccggaccgaacgccttgtaattcggagcgaccttgttgaccagcgcgctcagcgccttgacggtcgcttcggcggcgccgtccacggaagccacgcccagctcggagctgatgtccatgagcagctggttacggcgagaggagacgccgttggtcagggtgtcggtggtgtcggattcgccgatctggtccggacgcaccttcgccgaatatgccagcagcatggcgatcgcgtcggaagcgttgaacggaatatccgcgactgcggcgccggacggagcgccggcaggtgcggccggtgcggcggcagccggggctgcggcgacgggtgctgctgcgactgcggcaggcgctgcggcggcagcggacggagccgaagctgctgccggagcggctgcggcggaatcgtcagcatcgtcgtcggcaacgagggaatcggaatcggtcatgtagacgcggccttcgtcgcggccgacgttgtagacggtcacgtcacggccggcgaactgcggcaggcgcagcgtcttggcaccaaggttggcgagcgtcggagcgttgccgagacccacctcgacgtactcctccacgccaaggccgccctgttcggcggaaccgaacagcagcgcctgggtttcgatccaacgcaccggggaggcgaactgccagctcagcagttcggtgagcagcagacggccgagcttctggtcgtcctcggcgtaggaatcccacaccttcggatcgtccaacgcggccttgatgcgctcggacggcacgacctcgaggatcttcgcggcgaattccttggtcatctcgaacggcacggccaccaggttcggaatgtaacggccaaccagacggccacggtagtcgatgtgcttcggcagcagcgcgtcaagcttgtcgcggaactccggcacacccttgcgcagcagcgtggagtggaacggcacgtcgatgcccggcaccagcatgaacgccggcttgccgccgtattcggcgacgcggcgggcggaatcggccttcagcgccttcagaccggcgatggtgccggccacggcgtactgctgtccggcaaggttgtagttgacgatctgcaggaactcgccggaagccttcgaaacggattcgacgtattcgcgcacgccgtcgtcgcccacaccgaactggttcggacgcagcgcgcccatacggtagttggaacggcccttctcgtcacgcggaatgaggtggtgcatggtggagccacggtggaacaccagctccagcacggtttccagcggaatcacgcctgcgaaggagctcagcgcgttgtactcgcccagcgagtggccggcgaagtaggcgggccagatgtccgcgccggcttcgcgcagacgagcggtctgggcgaacgccacggtggcgagcgccacctgcgtgaactgggtcaggttgagcaggccttccggatgacggtaggtcacgccgttggcggtcagttccttcggattatcacgcacgacggcgaggatggagaagccgagcttctcgcgggtcaccttgtcggcgcgctcccacacctcgcgtgcggccggggacttggcacgctcgtcgagcaccatgccctgcttctggatgccctggcccggatagacgaaggcggacttcggcgcacgcacgatggcagtgccacgggacacgatattgccgtcgatgcggctggtcacttccagcaccatgccggcgtgggccacacggccgacgcgttcgatggagatctccacctcgtcgtcgagctgcaccatgccgtacatgttgtacgtccagcctgcgatctcgtaatgcgcgcccttctcgtcgagcgcctgcaccgcgtactgggcggtggcggacagccacatgccgtgcacgagcggcgcggcgagaccggagacggcggcaccgcgatgggaggtgtgaatcgggttgaaatcgccggaagtacgggcgaaagcggtcatctcgtgcggagcgacgaccttcacacgacgcagcagacggcgcggagtgctttcgatttcggcttcgattccaccatagtcgggcgcttccggcggcagcgcgtcggagtacgcgcggccgcggatggcgaaacgctcggtttcgttggcaagcagcgtaccgtcctgagcggtgtgcgtgacgtggatggtcaccacacggccggaagcggattcgaagtagtcgtcggcccagctggtgagctcgatgcgctcgccggtgtgcttcagcagctcgtcctcgctcacctcgagttcgatgaggtggtcgagatgcacggcgttgagcaggccttcgatgaccgggaagccgttgacgtacacggagccgagggccgcgtagatggcgggccaagccgatccgacgagcgcgtccggggcgatgcgggacggcacgaggtcgctcggcagcgcgccgccggtggcggcctcatggtcgaaaccgaggttggcggacagcgtgtagccggtgtgcgcctggccgaacgggaaggcggtcttgtcggacacttcctcgatctgcggcatggcggtgagcttgtcgccggtgatggcggtgttgccgatgcccgcggtgtcggcgagcatgcggtagacgtgctccggcagacggtcgcggtccacgaccgggaacaggccggattcgttgccgtcgacgttcagcggaatgacgatgtcgcgtacggcgtgcttggaggcgccgccgtccggatcgttgtcccagaaggtgtcgagatggatgtcgaggtcgtacttttcgacgctgccttcaacggccaccttgcggatctcgtagttggcgtcgccgttggcggtgccgtacgccgggttggccatgaggtggccgacccaggagatgttcggggatttgcggatgaattcctcggcggagacggccgcgcccaactgggcgaaggcggtcttgtcggcgctcgccgattcggcggacacgcgcttgaccatggcggcttcgaagcggccgaggatgtcggccaccggctcgtccacggtggtgatgccggccacggagatcgggccagggatgatgcgcacggaatcggcggaatagcgggagtcctcggactgccacagctggtcctggccccaccaacgcagcaggtcgttgtcgatgaccggcacgaacggcatcggcttcggatactcgcgtacgagcaccgggaaccatgcctcgtccatcggggtgacggtcagctcgccggcctgcgggtaggtttcggcaagcttggcgatcgcggcgttcggatcggcttcgacgtcggcgcgggaagcgaacagcgatgcgaattcgccgctttcctgcgtggtgacgcgggcttcgatgcgctgcagcaggtgcaggaagcgatcggcgtaggtttcgtccacccacgggaaggagaggtcggcgaaacgctgggcccactcaaggtaggtcatggtcttcagatcgccgaaatacggcttggcggtggcgttcagcgccgcgatgatctcgtcgcgacggctttccagctcctccgggtgcttcatgacgcgcaccagcaggcggccgcagcgggcggaggagttctccagctcgtagatgtcggcgtgcaggtggctcagaccggaggtgacgccgcccttggcctggccggacggcacccactgctcgcccagcggggcgaacggatcgttgccatcgcccttgaccggaatgccaggagtgctgacgagcatctgcttgacttcagggttggtgtgcgcttccttggcggtcatggcggcggtgccgacaagcacgccgtccacaggcatgagcggacggccgtattcggcggcccattcgccggtgatgtagtcggcgccgcgttccggcgtgccgatgccgccgccgaccacgagcacgaggttggactgctcacgcacttcggcgtaggtgctcagcagcagatcgtcaagcgattcccaagagtggtggccgcctgcggagccgccttcgacctcgatgagcaccttggtcggcgcgacggccttggcgatgcgcaccacctggcggatctggtcgacggtgcccggcttgaagctcacgtacgggaagccgtcggcgttgagattgtggatgagttccacggcctcgtcgaattccggaatgcctgcggagacgacgacgccgtcgatcggggtgccgctggcgcgcttcttcggcacgatgcgctgggagccgaactgcaggttccacaggtagcggtccatgaacatggcgttgaattcgacggtgcggccttcctcgagttcctcctcgagcttggccacgtgacggtcgaacacgctggcggtgacctggccgccgcctgcgagctcggcccagtagccggcgttggcggcagccgccacgatctccggctccacggtggtcggggtcatgccggccagcagcaccggagccttgccggtaagttcggtgaacgcggtgcgcaccttgtctccggcggacgtgtggatgatgctcggcgcgaaacgcgtccagttctgggtgcgttccggcagggtctcaagcgtggagagcgcgccgcgatcggccacggtggaggcttccaccacgccgacgccggtgccttgggccacggtggagaacagtttgccgacggtgttgcccggaccgaagtccagcacccacagggcgctcggatcggtggacttcatcagggcgcgcacgcgggcggcccaatccacatggttgagcagcacttcggcggcgagctcacgggcatggtcggcgttgatgccgcaggcctcggcccatgcgacggcctgggagacggcatcggccatcagcgggctgtggaacggcaaggtcacgtcaagatattcgagcacgggattgaacacgcggccgccacgcaccttctcctcacgcagctgcgcctgacgcttgtgctccttggccacttccacaccgaatgcggccaggtcctccggatagccggacaacacgtaatgcgtggcggaattggtgacggccacggcgatcgggccacgtgcgccgtcgacgcgttcgatcagcgcgtccacctgggcgcgggtgatgtccttgacggacagcatcggggtcgcctcgccgtggcgtgcggcgagaccgagctggcgtgcctgacgggtgccggcgacgccgatcagcgttgcgatcgcaagaatctcgtcgatcttggctgcggctgcgtcgatggaaccggcttcgcagatcgcctgcaccatatgcacggcaagcacgccctgggagtggccgagcaccgcgaccggcttggcctgggccggattgtagccgagtgcggcggcgtcgagcagcgcgcccagctgggtcagcgcgatgccgggaacgctggcggaagccgcggctgcggcgcccagacgtgccgggttcggttcgaagccgaacaggtcgaccgggcgtccggtggtggcgagcagctcggcggacaccgggtacagcagcgcctgcgcagcggccgcatgggtgtgcagggcctcgtcgagcgccggattggcgctctggtcggcgagcgccaccggccacggggtggattggccggcgaaggcgagcgcgtggggctcgctgttcagtcgatcaagaaaaaaggtgttcataatcttccttacttgttccaaaatttcttgcgattgttgtggttgcttacgttggttgcgtcgcgttgcgtccgtcacagcggctggttgccgtggtgtttgctggttcggcgcacgcgtttcttgctggcgagcaggcggagcgattcgatgatggtctcgcgtgtctgttcggggtcgatcatggcgtcgatctcgcccatttccagcgaaaggttcgcgttgacggtggtgcgttcgtagtcggcgatgtacttggcgcgcagcgcttcgacgtccttgccgttgtctttggctttctgcaggtccttgcggtggatgatgttcaccgcgccggccgcgccgagcaccgcgatctggctggatggccaggcgaagttcatgtccgcgccgatggctttggaacccatcacgatgtatgcgccgccgaaggccttgcgcaggatgatggtgacgagcggcacctgcgcgttggcgtaggcgtagatgaccttcgcgccacggcggatgatgcccgcatgttcctgttcggcgcccggcttgtagcccggggtgtccaccaaggtgacgaccggcaggttgaacgcgtcgcacaagcgcacgaatcgcgccactttttcggatgagtcgacgtcgagaatgccggcgttgacgttcggctggttggccacgatgccgacgggatggccgtcgatgcaggcgaagccgaccaccgctgaagcggcgaacagttcgtgcacctgcacgaattcaccgtagtccacgatgcagcggatcacgtcgagcacgtcatacggctggcggtcgttgtccggcacgagggtggcgaggcgtttggccacgtcacggtcggcgcgggtcgccgcgtacgcgtagaccggcggctgctggtcggagttggacggcagataggcgagcacggtacgcgcgtagtcgatcgcatccgcctcgtcctcgccgagatagtgggccacgccggacgtggcgttgtgcacgtagccgccgcccagatcgtccatgctgatcacttcgccggtggccgctttgaccacgtcgggaccggtgacgaacatgttggaattctcgcgggtcatgatgatcaggtcggtcagggccgggcagtagacggcaccgccggcgcaggggccgaggatcagcgatagctgcggcacgaaaccgctggcgtcgcaggttttgcggaacaggtggccgtattcggtcaacgcggccacaccctcctggatgcgcgcgccaccggagtcgatgagcgcgatgatcggcaccttgaggtcgagcgccttgtccatcagatggcagatcttgcggccttcggccacgccaagcgtgccgcctttgacggagaagtcctgcgcgtagacggccactttgcggccgaacacctcgccgaagccggtgatgacggcggagcccgcgcggccaccgttgatgtcgccgccgcggaaacggccgatttcctcgaaggaaccggtatcaagcagcaggtcgagacgttcgcgcgcggtcagcttgcctttgacgtgctggcgaccgcgggcgtggtcttcggcttcggcggcgagctgcgcggcacgcagcacggacgtacggatcggctgcgattcgcgggcttcggcagccgcttcgtcacccagtcgctcctgctgttccatgacgaccttcacggcctctttgacggccgggcttgcgatgatgtcggtcatttcgcgccgccttccgtcttggtttccgtattaccgtccgttgccggcttgccgtcagccgccttggaagcgccgttgacgtcgatggtcatcaacgtctcgcccgcttcgatgcctgcggccgggccgacgaagatcttggtgacggtgcccttgaccggcgcgtacacgtagttctccatcttcatggattcgagcacgacgagcaggtcgcccttggccacgtcctggccttcggcgacgttgatgcgtgtgacgaccgcctgcatcgggctggcgatcacaccggactggccgtcgttgccctgctgcttcttttcgacgtggtgcaggccctgtccgcgcagcggctggatggcgcgcttggcgtcacgcgccttggcgccgccggtcagattggccacgatgtcgttcggcacggtcagcgacacacgatggttgttgacttcgatgacgaaggtttcgctggattccttctgctcggcttccttcgcacccgaagcgccggccatggatgccggctggccgcccttggtggaggatgcttccttgttcaggtacttgcgttccagccatttcgtgctcacgtcgtaggccacgccatgctcggcggtgaactcgtcgtcgttgaagatctgctcgaacaggcttgccggggtcggcacgccttccaccttgagctcttccaacgcgcggcgcacacgtgccacggctgccgcacggtcggaggcggtgaccacgagcttgcccatcatcgaatcgaacttcggggagacggtgtcgccttccaccacgccggaatcgacgcggatgccagggccggacggccatgcgagcttggtcagcgtgccggagctcggcgccagattcttcgccggatcctcgcaggtcagccggagctcgaagctgtgtccgcgcagcgggtggtcgacggtcagctcgccgccgttggcgatggtgagctgttctcgcaccagatcaaggccgcagacctcttcgctgacggtgtgctccacctgcagacggggattgacctccaggaaatacaccttgccctgttcggtcaccatgaattcgcaagtgcccagaccgatgtagtcgaccgcttcgaaaagccggcgtgagtaagtctccagctgttcgagcacgccgtcggaaaggaacggcgccggcgcttcctccaccagcttctggttacggcgctgcacggagcagtcgcgggtggaatacacggtgaaattgccgtgcgaatcgcgtccgcactgcgtttcgacgtgacggcccttgtcgatgaaccgttcgacgaaatactcgtccaaatcgccgccctgcagcgcatcgtggttcatgtagaagccacgcagctcatcgtcgttgtgcacgagagtgatgccgcggccgccaccgccgtcggtgcgcttgagcatcagcggatagccgtgcgtgtgcgcgaagtcgagcagcagtcgcatgtcggaaatcgactgggaaatgccgggaaccggcggcaccttcgcgaaagtggccacgcggcgggccgtgatcttgtcgcccaggtcgacgagcgccttcggattcgggccgacccacgtggcgccggcgtcgaggaccttctgcgcgaagcttgcgacttcggaaaggaagccatagccggggtgcaccgcgtcggcaccgctgcgctgcaggatgtcgatgagcagatcctcgttgagatacgtgtccttgtaggtgtcgccagacagcagatacgcatcatcggccatctgcacgtactgtgcgtgacggtcctgttcggcgtagaccgcgaccgtgggaatccccatctcacgtgcggtgcgcacgactcgaagcgcgatttcgccgcgattcgccaccagtagtttgttgacattcttaggcataatgtcaagtttggcggtcgaggtgtgattcgacgaactcgtttcccacaaaagattcgcgatctttttgtaaggctccacaaacgttaccgaaacttagcaaccctacgatggggagcattgattgacgaaagactcattttcgtcagtttttgtagcatcctgtagcatccgcaaaaaagggaggattccaccatgcgcaacgcaatcctgaccatctcatccgcggccaaaacggccaccagcggcaaattcggcgccgttttgaagtccacgctgttcgccgtgctgctcgccgccgcctccatggcgggcgccgtgccgattccgggcactccggttccgatcaccctgcagaccttcgtggtcatgctggccgcgctgatgctgccgtggaagcaggcgggcgccgcggtgctcatgtatctggccgcgggcgcggctggtctgccggtgttcgccggcggcgcgtccaccatggctttggtcggcccgagcgccggcttcctcatcggtttcctgccggccgccgtcgtcacctcgctgctcaagggcaaggcgcgtgtcgattccctgaagcatgttgtgttgaccgccgcacggtatctgttcgcctgcgtggccggctgcatcgtgcttgactatctgctcggcttcatcgtgcagtccgccattacgggcgtggcgatgccggtggtggccatcgcttcgatgggcttcattgtgggcgattgcatcaaggcggttgtggcttcgctggtcgcgagcggactggcaaagctgcagtgacttttatcggcagcgacttttctgcggtagttttctacaactttttgctgggaattttcagctgagggttttccgctgagaatttccgctgtgatttccgggtttcttcgtgatttccgggttttgatacagtcttccgttttcgctgtgattttcgttttcgctgtgtccggtggggccggcggataccaacgtgcgacacgctccgggccgctcaggccgagtctttacggtcttacgttggtatccgccggccccacctcgttttgggggaatgttgcgtttgcgggtggcgcggtttttggatattgcgattttgggaaatgccgcttttctcgaatattgcgtttttttgaaacgtgcgattttcgaaaaaagcgctttacgactttatgagggatgagggttagagaattattggggtaggacgcctacgtcggcggtgcgcacggtgtgcaggttgccgttgtcgtctctgatggtgagggaggcgtcggggttgagttccagcgcggtgccgcgcagggtggtgccgtccacgaaatgcgcctcgcatggcttgccgagcgtccagcagaccggacgcatctcctccatcgcacgcgtagcctcacgctgcgggtcggcttcgaaatcggcgagccttgatcgcaaaccgtccaccagatgggccgcgatcatgtcgcgcaatgtcatggaatcgggcaggccatgcgcgaccagctgcagcgacgtggccttgtcggttggcagatggtcttcggggacggccaggttcaggccgatgccgaagacgatgccgacgcgttccgttgcagcagccacatcagtggtaccagttgtaccgtccgcgatgggagttgcggcaagcggaaccatttcggcgagcacgccgcccagtttcttgccgtcgacgaaaatgtcgttcggccatttgagcacgatgtccttgccgagcgggccgccgcaatcgcggatggccgcgataatcgcgttgcgcgcctcgcagccggcgatcatctgcagccagccgttgacggacgtgtcccgcacaatcgccgtaggcacgctgaccaccagggagacgatgaacgactcccccaccgcgctggtccattgatggtcgagacggccacggccggcggtctgctcgtcggcgcagatcgccacgatttcacggccggtccaatcgcgtccatcgcagccatcgaggccatctcggctggtcgagccgaacagcgcgcctttgcgcaccaattcggcggcgtacgtgttggtggaacccactgagtccagcgcgatcacctggtcggccgcgacgcaggtgcgtggcatggtcaatgcggaatccaatatggtcgtcatgattccttctcctgtccgtcgagctgtcgtccatcaagctgtcgtccatcgagatatcgttcgtcggcgtcctgcttgtcggactgctgtctgtcgatgcgacgcccgccgatacgccgtttgcccgccgtcgacgtgccaacgtacgacgcctcgcgtgcggcaagccgcgcggcacgcgactcgcgccagaactccaggcacaggaatccgaacacgaatgcgatcggaagcatatgccgttcgaaattgttggccggtgcggtgatcatcacacccataagcagcagcaacggcagatgccatgacagcgaccgccatcggcgcagcaccacttcggcggcgccgatcagcagtgtcagcgtgacatacaggttgccgtgcgtcacccagccaagcacgggaatctgtccccatttcttggcgaaaccggccacctggttgcgccactggtggttgtacaggtgaatccattcgttgtcggactgcacgtaatcgttgttcacgtagtagtccatcgacacgtatggcaggtcggtcacgttgaagtatccgaagcattcggcgaagagcgcgtcgagcgcgatctgaggattcgccttgacgatctgccaccatgcgtcgttgaaatccttcatgtcgtccttggtgacggtacgccacttgtagctgaccttcttggactggatgcccgacgatttcaccgggtcggcgtcctgctggaagtatgattcggccatctggtcgaggttgaagacaggagcgagtttcttggccgcgtcctcgggaatgccctgcggattgtatttcgccacgcgggcgatctgctgcagctggatgccacggctttcgatcggatcgccgccgatgacggcaccgctgttcaccagatagacgaggccgccatggatgagcacggtcggcagcatcaatgcgaccacgtacgtcttccaacgtttacggtcgttgatgatggccagcagcgcggcgaacagaatgatgtaccacgcgtatttggcgctgatcagcatgacgcagctcgacatgaacagtgccgccaaggaacgtttgcgcagtttcatgggcttgtcgttgatggtgggcagcgccttgatatgcgtcatatgcagctcataccacacgccgaaccaccagacgaacgcgaacgcgaacaacggcgatttggtcagtgagatcgtggcgaacaccgccaacgggcacaccatgaagaacagcagaatcacgaagcgtgtcttcgcgccggcgcgcagtctggacggacgcgccaccacacccgcctcgggatgggtgaaatcgcgcatgttccagcagtcgtgccgttcgggatgggagaagtcgaacgtgccgacgcccagcctacgccacggcagattgaagaaacgattggcggtggctgcacaacaaaacgcggcgaacagccattgcagcgcggccagcgccacgatgccggcgtcattggaatcggtgaaataccgggagaccgcggcgaacgcaccgtagaaaacggtcagcacgatgttgtgctggtcggtcagatacgtgggattggccggccacatgtaatgcgcggtcggatagatgtccatcggcacgaatgagaagaagccgatgtacggctgtttcagtccggtccactggttcaacgcccaactgaattcgcggatctgggagcggatgtcggcgccgtacgcggcgagcagggtggtcggaatccacagccagccgatgacgaacagcagcatgagcttccaccagcagtcggtgcaacgtgtcagcttgcggccgatccagacgatcaccgcatggatggcgcgccccggacggctatgcgcggcgtcgctcagatgacgcagcatgatgcccaataccgtcgtcggcgtgccggacacctcctggcacagcttgacgtaccgacgcgagaaatacgtcggcagcacgcgctcgccacggccgtaacggaccagagaccgcaatatagcaaacgaaacaacgaaggcgatcgccatgtacagcacgttggcccagccgaagtcggcgagtccggtgccaaaccagtacagcgggccgatgccgcagcaccacgccacccacaggcatgcgagcacgcccaacgtccagctgaggaacgtgtcggcttttccggctttcttgttttcgctcatagtcggcatattaccgccactgcgcgaatggggaccggaacggtcggcgaacgtgcggcaattcgcagatacgacgattagaatggacggttatgaactccgagcaggcagacatcctcgaccttttgtcaggccataccgacgatacgaccatcgagcggttggctttcgaatgcctgttgacgaacatgaccgacgatcgtgtggtctccttgatgaacattctcggatggcaaggcgatttcaactgttttgcgatcggcggggtgccttcggccagtcttgcctcgacatccctcgccatccgcaaggcggtgcgcgatttgggtggcgagcatgtggtcatcggcacgtacggcactttcctgctggctttggcttgccagatgggcgcggtcacgccggaggtgacctgtaccgcggtcatgccggcgttcagcgaggacgagccactgtatttgagcccggtccgttccggtgtggcgggggcttcgcatgcgttgcgtgagacgatgttctcgctgcaggcggctccggcgctgtccactccttcccgtccgctgcgtgccgacgagctgttgccggagcgtgcgctgctgggtgatgattacgcgcgtgaggaactgtatcggaacgtatatcaggtgctgcgcggcgagaatcccgatgatcccacttatctgacggtgtccacgttcctgaagtatggcagttcgttggagaacacggcgaaggagctgaatgtgcatccgaacaccgtgcgctaccgcttgaagcgtgccgccgaaacgaccggctgggatgccaccgatccgcgtgacgcgtatgtgctgacgaccgcgctggcgattggccgtatgcgcgaccgctgagccgctgcccgggtggtgtggcgtctgggtacgcccgttgcgtctgtcatccggtcataaagtcatgaatctttccgaacatatgaaaagacccgcatgctgcgattgcagatacgggtcttttggtgaagcttagcttctgtgcactcaggcaacgaccgccggatcaaccgggacgcccgggttcatcgtggaggtgatggtcgccttggtgacgtagcggcccttcacggtggacggcttcagacgcttgacttcgtcggccacagccttgaagttctcgtccagagcctgctcggtgaaggacatcttgccgatgaggaagctcaggttgccgttcttgtcgacacggaagtcaaccttgccgcccttgatgtccttgatggccttggtgacgtccatggtcacggtgccggtcttcgggttcggcatgaggccacgcggaccgagcacgcggccgagacggccaaccttgcccatcatgtccggggtggcgacgacggaatcgaagtcaaggaaaccgtcggcgaccttctgcacgaggtcgtcgtcaccgacgatgtcggcgccagcctcgagagcttcggtggccttcgggccacgggcgaagacgaggaccttggcggtcttaccggtgccgttcggcaggttcacggaaccgcggaccagctggtcggccttgcgcggatccacgttcaggcgcagcacggcctcaacggtctggtcgaacttgtactccggcatgctcttgaggagagcgatggcttcgttggcggtgtaaaggttgttgcgatcgatcttctcagccgcttcgcgatacttcttggaacgctgtaccattagtccttctcctctcagtcggtaaccgtgatacccatcgaacgggcggtgcccgcgatgatcttcatgccggcttcgacgtcgcgtgcggacagatcagccatcttgatttcagcgatctcacggacctgagccttggtgacggagccgaccttgtgggtcagcgggttctcggtacccttctggatgccagcggccttcttcagcagagctgctgccggcggggtcttcaggatgaaggtgaaggaacgatcttcgtaaacggtgatctcaacagggatgacctggcccatcttgtcctgcgtggcagcgttgtactgcttgcagaagtccatgatgttcacgccatgggaacccagagccggacccagcggcggagccgggttggccttgccggcctgaatctggagcttgagaagcgccgagactttcttcttaggagccattgtatggttcttctttctgtgaagcggtggttaacggcaccggagtaggtctcccgcgtccggttccttccgcaacgtatattgctgtgctgtgctagcaggtgccgccgccttgttcaggcacacgagaccctccagacacaacttttctattatgcgattccgccacgacattgcgcgtatggcaatacatacaaagaaaccccgccgaagcggggttcaaaagaatcacgatttcaggttcctgaatgggtgtgacgcgtgcggtagcaaggcgcccaagcgcaggcgtaccaaggtgcgtcaagcttggagcaacgcagctaacgctccgtcatgcacgttcaggctaatttttcaacctggttgaagcctagctccaccggcgtgtcacggccgaagatggacacgagcacggtgagcttctgcgtggacggatccacttcggagacaaccgcggccatggtggtgaacggtccatcggtgacggtgacctgatcgccaggagcgtaggagacctcaagcttgcgcttcttggctgcggccggcttgtctccggcggccttgagagcttcggaagcgatcatcggagccatcatggagacgacttccttgcgggtcagcggtgccggatccttggtcgggccgacaaagccggtgacgccttcggtctcgcggacgatacgacgggcgttctcatccgacagcatgcggatcagcacatagccggggacacgcacgcgggtgatgaccttcttgcccttttcggtgtgcttttcgacttcctccatcggcacttcgacctggaagatcttgtcttccataccgaagctggccacgcgggattcgacgttggtcttcacgcgcttctcatagccggaataggtgtgcagcacataccacttgccttcaagcgtgcgcaggctcttagagaattcctcgacggccttggcaccggcatcctgctcagtgtcttcatcctcagtggtttccgcggtctgctcttccggagcgtcctgctcggactgggcctgctcatcggtcgcctgatcggcggcgacggcctggacggcctcgccttcggccggcagcgcctcaacagcggcagcagcctcggtatcagccttggaagcctcgtcgaggttgtcggaaaacacttcgtcagtcatgcactttcaccttcaagttgtttatcagccgaatatccacagggtcagcttgcccagaccgtagtccatgccggtgaccagtgccatcagcagcagcacgaagataaacacggcgagggaccagaagaacagttccttgctggtcggagtgacgaccttgcggagttcgtcgataatctgtttgatgaacaagccaatgcgcatgaagatgttcggcttaatggccttctcgctgttcttcgccttcgccataataatcctccgctgggcttgttgtaagaagcttggcagggaaggcgggactcgaacccacaacctacggttttggagaccgttgcgctaccaattgcgccacttccctaggtgaactctgccgtctccacttgccggcgaggattctatgcaaaaccacgcaagaagcagacggcaaaaccgccaagtcgaaataatagcgggttttcgcgacttcgtccaacccgattcacgacgaatcgcaagaaaccgctattttccaacgaaaaaaagattcgcgcccggcatgtcaccgaagcgcgaatcgctaaaaatatcgtctatcaactgaactttccgtcagttgagcgcggggccggtcggctcagtcctcgacccaacgcttcatgcgacgcatgccttcgaccagatcgtcgtcggcaagcgcgtaggagaagcgcaggtagccgggagcgccgaacgcctcgcccgggacggcggcgacatggccttcgtcaagcaacgcggcggccagttcggacgtgttggcgaacgtggtcttgttggtgccgatcggtttgttcagcagcgcggtcacgtcggcgaacgcgtagaacgcgccggtcggggtcgggcagttcacgccttcgatgtcgttcaacgcggcgacgatggtctggcggcgcttgtcgaatgcggcgcgcatctcgtagacggcgtccagggagccggagacggcttcgatggcggcacgctgggagatgttgttcacgttggaggtcatgtgaccctgcagtttggatgcggccttggccacgtccacgggggcgatcatccagccgacgcgccagcccggcatggcgtaggttttggccacgccgttgagcacgagcagctgggagcgcacttcgggcaccgcggcgccgatgtacgtggttttggcgccgtcatagttcaagtgttcgtagatttcgtcggaaatgacccacacgtggtgttcgatggcccactgcgcgatggccttgacggtttccggcttccacaccgcgcccgtcgggttgttcggcgtgttcacgatgatggccttcgtgtgttcggtgcgcgcggcctcgatgtcctcgatgctcggctcgaagttgcggtcggcgccggcgaacacggtcacgggcacgccgccggcgagcttcacggcttccggatagctggtccagtacggggtggggatgatgacctcgtcgccctcgttgagcaagatctggaacgattcgtagacggcctgcttgccgccgttggtcacgatgacctggctcgggtcgatttcgtaacccgaatcgcgcaacgtcttgtccgcgatggccttgcgcagttccggcaggcctgccgtcggcgtgtaacggtagtttttcggatcctgcactgcggcggccgcggccgcgacgattggcgccggggttgggaagttcggttcgcccgcgccgaatccgatgacgtcgattccggcggctttcattgccttcgccttggaatcgacggccagagttgcgctcggagccacgtgattgatacggtcggatagagtctgccagtcagccatagtcatgcctgtaatgctagacctgccacgcgaaaaacgacagccccacgacacacgtctatttctccgcgaacgcttcgcttgaagcgaaatcgatggcctaaccacaccttttgcactggctcagaccagtacgagattgtcgcggtgcaccagcggatgcgcgtattcctcgccgaggaaacgcttgagctgggccgtattgcgtccaagcatctgcgggatctcctcggagtcgaagccgaccaggcccttggccaaatggttgccctgctcgtcgtcaacccagacggcgtcgccggcggcgaaatcgcccttcacttccaccacgccggccgcgagcaggctggccgctcccccgcgcaccgccttggccgcaccggaatcggccaccagcgtgccctgcgggtgggaggcgaagccgatccacagcctgcgcgacgaaccgcggtcgttgatcggcgcgaacgcggtgccgaccggatcgcccatcatcgcgggacctgcgttcgacgcgcatgtcaacaccgcgggaatgccggacaccgcggcgacgcgcgcggcctccattttggtgaccatgccgccggtgccgacgttcgagccggttccgccgacctgaaccttcgccagcgcgtcctcgacgttcggcacataggagatgcgcttcgagccgggctcgcttggcggcgcggtgtacagcgcgtccacgtcggtgagcagcacaagcgcgtcggcgacgacgatgttggcgatgagcgcggacagacggtcgttgtcgccgaaccggatctcgttggacgcgagggaatcgttttcgttgatgatcggcaccgcgcccaagtcgagcaggcggtcgagcgtacggcgcacgttgcggtactgctgtggggcgatcgtgtcagaaacggtgatgaggatctgtccgacacgcagcccgtaccgtgcgaaagcggcttcgtactgtgccatcagcaggccttggccgacggcggcgcacgcctgctggtcggctacgtcggtcggacgcttgtcgaaaccgagcgtgccgaaaccggccgcgatcgcgccggaggagaccagcaccacgcgtcctcccatcagccgtacgcgggcgatggccgcgacgagcgcgttcagacgttccggatccaagtgtccgctcggctcggtcagcgagctggagcccaccttcaccacgatggtctgcgcttcggcgatggccctgcgcacttgcgcttgcgatggcgtgttcatagttcctcccggtaccgttaccggctattgaaaaagcccaccgacatgccatcggcacatcagcgggcttcgttggatggttctattgttccacatcctcgtcgtcggcggtctcgccacgtccaaaaagactggtttcgtcgtgacggtcgtcgtccacggaaggatcggcccagtgtcctgccttgcgttcggccatcatggcttcgcgcacggcctgacgggcgtccatcatctcgtggtactggcgacggcgttccgtgttggaacgacgctgcgcacgaccatccgattcctgcagtcgcaggtcgacgccgcgtgcgcccaactgggtgccgtcgagcatttccgcgccggccgcgatggtcggatcccaatcgaattccacggcacggtcgccacggccgatgcgcacttcgtcgcccggcttggcgcccttgtgtcgcagctcgtcttcgacgcccagcttggccagacggtcggcaaggtagccgacggcctcgtcattatcgaagttggtctgcatgacccagcgttccggcttggtgccgagcacctcgtaccagacttcgccgttgccgttctccttgcgttccacggtgaagtcgagcgcgttgccgccttcgtcgttacggcgacggcgattgcgcggctcctcgagcggcttgatgaccacgcgggcctcttcctcggcctgctcgcgtttggcgacttccgcgcgcatgttggtcacgaggtcggccagcgcccagttgagttccttcagaccctcgtgggaggcggtggagatgatgtagaccttgaggccgagcttttcgaattccggcttgacgaattcggcgagttccttggcttccggcacatccaccttgttgaggatgatgatgcgcggacgttcggggatcggaatcgcgccgagcggcagttcgagcttgccggcgtattcggcgagctcgtgttcgagcgcctggtagtcgctcatcgggtcgcggccgggttcgagggtggcgcaatcgatgacgtgggcgatgatttcagtacgttcgatgtggcgcaggaattcgaggccgaggcccttgccctgggatgcgcccggaatcaggcccggcacgtcggcgatggtgtagcgcatgtcgccggccaccactacgccgaggttcggcacgagcgtggtgaacggataatcggcgatcttcggtttggcggagctcatcgccgcgatcaggctcgacttgcctgcggacggaaagcccaccagcgccacgtcggcgatggacttgagctcgaggatgacgtcgcgttcctcgcccggctcgcccagcagtgcgaagcccggcgcacgacgggtgcgattggccagcgccgcattgccgagaccaccgttgccgcccgcggccacgacgaacttgtctcctgcatgacgcaggtcggcaagctgctcgcccggatgcttcggcttgccctgcggtcccttggcttcgaacacgaccgtgcccaccgggacgggcagaatcaggtcggcgcccttcgaaccgtccttcgtgtcgcccaggcccatggtgccgctttccgcctcgcgatggggcatgaaacggtagtcgagcagactgttggcgttcgaatcggccatgaagatcacggaaccgccgtcgccgccattgccgccgttcggaccggccaacggcttgtatttctccctacggatgccggcggaaccattgccgccgtcgccgcccttcacatggacggtcactcgatccacaaaatcactcatgtatctaccttacatagcagaaagaccgcgtccataacgggcgcggtctttcatcaaaaagcgctatttgcgcgtgtctcaggcggcaatcacgtcgacgaccttgcggtcacgacgcacgccgaacttcacactgccgtccttgagggcgaacagggtgtggtccttgcccatgccgacgttctcgcccgggtggaacttggtgccacgctgacgaacgatgatgttgccggccacgacggcttcgccgccgaacttcttcacaccgaggtattgcgcgtttgaatcgcgaccgttgcgcgagctagacgcgcccttcttatgtgccatgtctgttcctttcggtccttgactctaaccctacgcgaatcaggcgatcgccgtgatcttgacgagagtcagctgctggcgatggcccttgcgacgagcaacgccggtcttgttcttgtacttcatgatgctgatcttcgggcccttggcctcatcgttgacaacctcagccttgacactgatgttggcgagatccttggcgttgacggtgaccttgtcaccatccacaacgagagcgaccgggaattccacggtgtcgcccttcttggcgtcgagacggttgacgaggatgacgtcaccgacctcgaccttttcctgatggccgccggccttcacaatagcgtacatatccgttcctttattaacttggaaagcttactgcccggcacgttcgagcctcgcggccagacaccagcaatctaatctacacatacccgcgtacaaccgcaagtctgctcccggcgtgtcaggttgacataccgggattttcctttattcttcttgttcttcctcgcccaggtccgcattgttggcggccacggctgccgccgcgatctgcgcgagtttggccttcacgtccggcgaggagcccttcggcacctgcacgtccgtgccatggccatgcttgttggtcttgacgaacggatcgccgcccttcagggcgtacggatcgtcgtaatccgccgaaacggtcggttcgtcatggaggatgaagccgcggcccttgcaggtcgggcattcctcggagaacgcctccaccagaccctggccgatgcgcttgcgcgtcatctgcaccagtcccagcgaggtgacttcggccacctgatgcttggtgcggtcgcgcgccaggcactccaccagtcggcggagcaccaaatccctgttggccggcatgaccatgtcgacgaagtcgatcatcaccatgccgccgatgtcgcgcagacgaagctgtcgcgcgatctcttcggccgcttcgaggttgcaacgggtcaccgtttcctcgaggctcttgccgcggccgatgaaacggcccgtgttcacgtcgatagtggtcatggcctcggtgcggtcgatgacgatcgaaccgccggacggcaggtagacctgacgttccatgcccttacgcaactgggagtcgatctgccacttgtcgaacacgtccttgccgtcatgttcggccggatcccacttctcgagcttgtccttgagatcgggggccatcgtgtcgaggtattcctcgatacgctcgtacacgcggtcgccttcaacgatcatcttggagaagtcgtcgttgaagatgtcgcgcaccacgcggatggccacgtccggctcgccttgcagcagcttcggacgcttgccgtgcaggaactcgtcgcgcttggcggtgatgcgttcccactggcgcaccaggttctcaagatccttggtaatggcctcttcggaagcgccttcggccgcggttcggatgatcacgcccatatccttcggcgcgatcttcgacacgatgttcttcaggcgggcgcgctcacgctcgctcagcttgcggctcacgccggtcatgccgccggacggcaccagcacgaggaaacggccggccaaggtgacctgcgaggtaagccttgcgcccttgtggccgatcggatccttggttacctgcaccagcaccggatcgcccgacttgaacgccagttcgatacgacgcggctggccttccagacgtgcggaatcccagttcacctcgccggcgtacagcacgccgttgcgggcctgtccgatgtccacgaacgcggcctccatgctcggcagcacgttctgcacgcggccaagatagatgttgccgacggtggccacttcctggatgtcggacacgtaatgctcgacgagcacattgtcttcgatcacggagatctgggtgtggcgctcacgttcgcgcaccaccatcagacgctcgacgtgttcgcgacgggccaggaagtcctgctccatgagctggttctgacggctgcgttcacgacggttgtcgcggcggcgctgcttcttggcttccagacgggtggatccttcgacgtcggtgatttcgtcgatgtactgctgcttgcgggagcgacgggacatcgtctcgtccgattcctcggccttcgaccctccacggcggcggcgacggcgacgggtcaccgtgccctcttcctcatcgtcatcctcatgacggcgacgggattcgcgttcggaggtctgctgctcgtcggcttcctcatggttgccgcgtccgcgacggcggcgacgggtgcgcgtcggctgctcgtcatcatcatcgtttccattgcgggactcgtcatcgatcggcgcatacgtgatgccatcgaggaccaggtcctcctcgatctgctccacttcggcagcggcacgacgttcctgcgcgttcagacgacgggaacgacgggaacgacgggaatcgccatgatcatcgtcttcggcgtcgttgttgcggtcattgccgtcatcacggccgcgaccgtcattcgaagcgtccgtgcggtccgtgtcggccgtgtcgtggctgcgacggcggcggcgacgagtcggacggtcatcgtcgcggtcatcacggctgtcacgggcatcgtccgaacctctgcggcccgtatcgtcagcatcgtcatcgtcggacgatccgcggcccgcgggggcggccggcagaatcggctcctggaacagcagcgacgtcatcggacgcggattatgacgcgtctcatggccttccggcagcgcgctgacggcgtcgagcgcacggtcttcggatgattcgtcacgattgtcacgattgccacgattgccgtaatcgtcacgatcgtcacgatcgtcacggtcatcacgcggctcgtcgctgatacggcgacggcgacgcgacgggcgatcatcctcgtcctgcacgtccacagaggaacgacggcgacggcgcggacgttcgtcacgcatctcatcgtcgtcatcgtaacgggtcacgcgacgacgacgcggacgcgacggctcggcgtcatcggcatcattgaaatcggcggaatcacgcgcaggctggacaggctcaagcttcggttcctcaaacaagggggctttggcatgctcctcgaccttcagctccaaagacgcgcccgcggcacctacgccacgcaccacgcggcgacctccacgacggcggcgcggagccggatcggcagacacagaacccgcactgcttgccgcattattggttgaattatcggatgacacaacagcctcgacctgatcgaggccctcattggtagtaggcacaacgctcctcggcaacgcgctgcaatcgcatcgccttcactcaagccccaacggttctcacaccacgctctcaccgtggccgcgcatcatggcgcccgtaggaagcaacttccgtcaaaagtcttcatcatgcgacggcggacacctgcgctcgcgactcacagaacattcacgcgaggggatcaacgccatcggatgcgtcggcggtcttgcagaaccaccgtctataagtatgacacaaaaaacaacggagcgtgacaggacgggaaatttattccccctacacgctccgttttccaatgattcgcgttgacacgccgtgaatgaacgtgcgccggcatagtggttcagcagcggttcaacggtggaccaatagtggttctgcggcaagcccgcggcagcgaattaccggcgattcaacggcagctcagcaacgactcaacggcgattcaacgcagccagtcctccagcaggtcggccatgagcagcagatcggtctccggcagctgctcgtcctgcttgtgagccagcagcgggctacccgcgccgagattcacggccggaatgcccagaatcgcgaaacgcgccacatccgtccaacccagcttggcaagcgggtcacgaccggtacgttccttgacaagcgataccagcgattgggcaagcggcgaattgaggcccggacgcgcgctcggcgattcgtccttcatctcgatgccgaagccttcgaacacgccaccagtggcctgatgctcgccgttgccaagtttcgcgcccgcatccgcgccgatcatcagcgccttcgcctcggcgagcgacttgtccggcgcgaaccggtagttgacgtgcacacggcactcgtcgggaatcacattggtacccttgccgccggaaatcagcgtggcgttcagaccctcctgataggtcaggccatctacttcgatggcgcggttctcatgtgcgttcaaacggttcagaatctcggccgccgcgtggatcgcgttcttgcccatccaggcgcgggccgaatgcgcggcaacgccgtgcgtgatcacgtcgaatcgcatcgtgccgttgcagccgccctcgatgccgcaaccggtcggctcgccgatgatcgcgaaatcgccggtgatccaatccggatgcgactcgaccaccttgcgcaggccgttcttctcggccgcgacttcctcatggtcgtaaaacacgtacgtcagatcgtatttcgcgtccgtcagcgtggccgccagatacagcatgaccgcgtcggaacccttcatatcggtggcgccacgaccccagatcacacgctcatgctcatgaccgaccgccacgtcctcgcgaatcagcgaatcgcccggctgaagccatttcggcgggaaattgtcgatcaccggcaccgtgtcgagatggccggcaagaatcacgcggcgctcgcgaccgaaatcggtggatgccaccaatgtgtcgccgtgcctgcgcaccgtcagatgcggctgttttttcaaaaacacctcgacggcgtccgtcagcgggccctcgtcgtcgctgacggagtaggcgcccatgatctgttccatcagctcgttgagctgttcctgcttggtggcggaagcggaaaatccaatcgtaagttcgttcatgccgtccattatccggcaaaagccggtgacaatcgcatttcgggcgtgcttttgagacggtcggccatgctgtcgtgcgcttggtgacacactaggtagcggtccgaggcaacggccgcagcgaaaaggagagtgcaatgccgggtctattgagcgcgatggaaggtttctgcgtcatcggcatcgtcatcgccaccggctatgtggccgcgcgcatgcgcatcggcgggccgaccgcgcagatggtgctcaacaggttcagcttcttcgtgtcgagcccgtgcctgatgttcgccatcctgtccaaggagaagatcttcgagatcttccactcctccatcgtcgtggcgttcttctcggccgtgctggtgggtgtggtctttctgattctcaatcggctgttcttccatatgaaggccgcggacgccaccatcggcgcgctgaattcgctgtatctgaactcgaacaacatcggtctgccgatcgccacgtacattctgggcaatccggcgctcgtcgcgccgatcctggtcatgcagcaggcggtgttcacgccgatcggcctgaccgtgctcgacgtgaccaccaaaggcaaggtctccgcgaaggagattctgaaacagccgttgcaccagccgctgctcatcggctcgcttctaggcattgtggtgtccgcgatttccgcgaaggtcggctatttcgtgattccgagcttcatctacgacccgatcgatatgatcggcgattccgcagtaccgatgattctgatggcgttcggcatgtccttgcacggcacgaagccgctgcaggacaagtcgaacgttccggcggtgttcacagtggccgtgctgaagaacattgtgatgccgatcatcgcgttcctgctgtcgtatttcgtgatgggcttccgtggcgccacgctgtacgcgtgcgtggtgctcgccgcattgccgaccgggcagaacgtctacaattacgcggcgcgatacaacgtgggtctgtcgttcgcacgcgacggcattctgttctcgacgttgtcgtcgccgattttcatcgcgatcatcgcggtgctcctcggctgacctcgccagtcctcgccgcggtatccacgaccgccgcggcgaggccatcaatcgtccatacggtagccggcataaccgagcccgtgcgccgcatgattcgcggcacaccctccgagcaccatcagcgcataacacaagccgattcccgcggccaacgtaagcaacgaagccggattgagcaacgacgttgccagaatcggaaacagcaacaacaccgagcaccccaatgaaacggccatcaccgtgttgagcggggtgatcacttccatcatgcgtgccttgtcgagcgtcgcctcatccgtgccttccaacgcaagcatgcggtactcgtcggcctggtcgtagacgttgcccgtctgcatcacgccggaactgacggcggcgagcaccgcggcaaaggcgagcgtcaggaaaccacccatcgctatatcgcgcatgtacagcatagatgggtcgaacgggtcgtggttgcctccgattccggtggcaagcaatccgcacaccgacgtcatccccgcgatgaacacagcgagcgccacaccggacacgttgcgccaagcacgcttgggattgtcgaggatacggcgcatggcaatcatagtggccgcgtccttcgggtgtttcgcacgcgatctggcgcgcatcgccaccacccaggtaccgacgacgttcaccatggcgaaaccgaggaagaagacgccgaagatgatggcgtagaccaccatctgacccaagtgcgcgaatgcggagacgctgttgagcagcaggtagcctacggccaacacggcaaggaaaatcagtgcgcgccatgcggatggcatgggttgtccggtacgttgcgtcacgccaagcggggtgatggccacgcggcgtagggcgaccagcgcggagaccaaggcaagcagcgtgactccgacggtcacggccgccagagcaggcagtcccacccacaactgttcgaaggtgaaatgctggttttggaagtcgagcagcatgatcgccggtatcagcgcgaagtagccggccatgccgaccagcgcgccaagcagagcctggccacccgcatcgagcgcggtgagtttcgtgacctgcgcggtggtggcgcccgcaagtcgcagtgcggcgagacgtgcgtccctgcgggaggccgcgagacgggccgccgagccggcgagcgccacgaacggcacgatgagtagcagactggcgaatgcggcgagcagcacatagccgtcggaataggtgttcatgacggctgtggcctggtcggccgtccaatggccgtcgccgaccgtggcgacgagcttgtcggcgtgcgccagggttttggaccatgtttcgtatgtaccgggcgcgcacctgttggaattgatcatgcaaccgaacgtgtggtcggcggaggcccgccagatgaagccatgcaggcctccgagcacggttaggaagacggcggtggcggatgcgaaggcaacgatggccagcgcagaggtgcggctggatatgccgcgggtgccggagcggtggaacaatcgccataatcggaacatgttcatcgtgcgcctccggcggtaggttgggattgctgcggcgagctcagcctgccgtcacgcatggtaacggtggcatcgcagaatgcggccacgttcgaatcgtgcgtcaccacgaccacggccgcgccggtctgtcgtgcggtccgcatgagaatgctcatgatttcgtggccggtggtctggtcgagcgcgccggtcggttcatcggcgaagatgactgccggctgcgcggcgagcgcacgtgcgatggcgatgcgctgcatctggccgccgctcatttcgccgggacgttgttgcgcgagctggcgcaatcccaatcgttccagccatagcatggccgtgtcggtggcctgctggtagcttgcgccgcccagcatcatcggcaacgcgatgttttcgatggccggcagttccggcagcagctgtccggattggaagacgaaaccgaaggcgctgcggcgcagtttggtgcggtcagcgtcgctcaaccgcgccaggttggcaccgcgaaacatcacattgccggctgtcggggtgatgatgccggcgagtgcgtgcagtaacgtcgatttgccggaaccggacggtcccatgaccgcgatgctttcgcctgcctggatgccgaaatccacgtgattgagcgccagcatgtgtgtggcgttcggtgtagcctgttgggtcgaataatccatgaccagatcggtcgcgtgaagtatgtgttccatgtttcctacggtacggaaacggattggtcccggccatcagacggcgggatgaacttacaggtttccttccggcatgcatcatccgcaaggattagcgtaatcgcggactgcggatgagatgccgtatgtcagacgagatgccaggagaggcggtgcaggtcgctgggcccgaattcagcgatggcgtcacggtgtgcggccgaaccgtaacccttgttgtgggcccattcatagggttcatattggggttgcgctcccagttcgaccatgagccggtctcgcgtgactttggcgatgacggctgcggtggccacggtggcgcagtacctgtcgcccttcactttggtagagacttccgcaggaaccggcacgtcaggcgcgtcgaaggtgttcagcgctttggtgatgtagtcgttcggtccgtcgaggatcgcaccgaccttcaccggcttgccgtcaagcatgccatcgccgtcgatgccgagtttctcttccgcttggccgagtgcgcgcaatgcggcgatgccaagcgcataggagatgccccaatcgtcgatttccgtgttgctggccgagccgaccgcccaggacgcgcaccacgatttaagctcttcgaatatggcttcgcggcggtgttccgtcagcattttggaatcggccacgccgtcgggcacttgcagcggcgacggaccggacagatcgcacgtgcggattgcggcggcgccgaccatgacgggaccggcgagcgagccgcggccgacctcgtcgaagccgacgatcacgtcgtagccggaggccgcggtcgcccgttccatatccaatgtaggcactatggaaacggacatcagtcggcagatccttccggcacgtccctgaacacgtcgtgatgcgcgtccagcgtgctgatgtggttcagcggccaatacttgaccagaccgacgccgaccacgtcggaaaccggcacgaggccgtgcgaggaatcgtcctgatggtagcgggaatcagcggaattggcgcgattgtcacccatgacgaacacatgtcccgcagtcactttttcactgaacgcgaaggagctggggtccacgccggagcggatgtacgaagtttcgtcgatggccacgccgttgaccgtgaccggcttgccgggcccctcgcaggccacggtgtcaccgggcaggccgataagtcgtttgatgaggtagtcgccgccgaatcggccgctgttctcctgctgcagccaatggtcggggtccttgaagaccaccacgtcgccgcgctggagcttgaagactttgggggtgagtttgctggtgatgacccggtcgcccggttcgatggtgttcagcatggagccggacggaatcacgtagaagccgaacaggaacatgcgcaccagcagcacgatgacgatgggtatgccgcaccagatcagggtgtctcgtaagccgaagctttcctcgctttcgactctttttctggcatgcttcatgggattccttaccgtccggtttcacgcactggcccctatcatagcggcccaatatagaaaatcggctcctcgacgggttgccgaagagccgatttcacgctttattcgcgattcgaactcacttctcggagttgtcgcggcgctcgacgatacgagcggccttaccgcgcaggttgcgcaggtagtacagcttggcgcgacgcacgcggcccttgcggaccaccttgatggaatcgatggccggggagtgcagcgggaagcggcgctcgacaccggtgccgaagctgatcttgcggaccacgaaggtctcacgaacgccgccgccctgacgagcgatcaccacgccggtgaaagcctgcagacgggagttgttgccttccttgatcttcacgttgacttcaacggtgtcaccgggacggaaagccgggatttcctcggccggcttcaggtgcttggcgtcaaatgcttcaatagcgttaaccattgtgtttcctcgagtcgccgccgcatatcggcgcacaggtaagggcttcgtacggcgttcttgcgattgccgtctcggcctgttcttccgctccgcaggtctgcctgcgaagggttgccgatccgccggaaatattgcgataaagcacggccggagttacctgcgaccgttccggctggacccacagaaaagcgggattatgcggcgtcccgcctttcggcacagcaataatcaaaaataccccatccgcaagacacggatggggcatctcgttcagccacacgtcacgcggctttatgcgcgccgatcgtgagtcagaactctcgattcgcgcggtagaacttgatcagggactgggtggacggatcctgggcggccagggcgtcgtcatccttggagatggccggggtgatctgcttggcaagctgcttgccgagctcgacgccccactggtcgtaggagtccagaccccacacggtgccctcgacgaaggtgatgtgctcgtacagggcgatgagctcgccgagcgcgaacggggtcagagccacgccgaagatggaggtggtcggacggttgccggtgaacacgcgggccgggacgatctcttccggggtgccctcagcgcgcacttcgtcggcggtcttgccgaaggccagggccttggtctgggcgaagtagttgcccaggaacagctcgtgcacgtcctggtcgccgtccttggtcgggttcggggtgttcacgaacgcgatgaagtcggccgggatgagctgggtgccctggtggatcagctggtagaaggcgtgctggccgttggtgcccggctcgccccagaagatctcgccggtctcggaggtgaccggggtgccgtcccaacgcacggacttgccgttggactccatggtcagctgctgcaggtaggccgggaagcggtgcaggtactggtcgtacggcagcacggcgtgggaggcgaccttgaagaagttgcggtaccacacgttcagcatgccgagcagcacgacgacgttcttctcgaacggggtgttggcgaagtattcgtcgatctcgtggaagccgtgcaggaactcctcgaagcgggccgggccgaagaccacggcgagggaggtgccgacggcggaatcgacggagtaacggccgccgacccagttccagaagccgaacgcgttgttcgggtcgatgccgaactcggcgaccttctccaggttggtggagacggcgacgaagtgcttcttgatggcttcggcgttcttggcgtcggaaccgtcgatggcgcccttggccttgagctcttcgagcagccaggtgcgggcctcacgggcgttggtcagggtttccagggtggtgaaggtcttggaaacgatgatgaacagggtggtctccggatcgaggcccttggtcttctcggccaggtcgttcgggtcgatgttggagatgtagcgggcggagatgccggcgtcggcgtacggcttcagagcctcgtacaccatgacgggacccaggtcggaaccaccgatgccgatgttgaccacggtctcgatcttcttgccggtcacgccggtccactcgccggagcggaccttgtcggcgaacgcgtagatgcggtcgagcacctcacgcacgtccttgacggtgtcctggccgtcgacgatgtacttgccctcgtcctcgaccgggcggcgcagcgcggtgtgcagcacggcgcggtcctcggtgttgttgacgtgcacgccggtgtacatggccttggtgcgctcgtcgagcttgacggccttggccaggtcggcgaacagctgcagggtctccggcttgatcaggttcttggacagatcgaagtgcaggtcgcctgcatcgaagctcagcttctcgacgcgctcggcgtcatcggcgaaccactgcttgaggctgatgccctcggactgcagctcgtcgtagtgcttctgcagcgcggcccactccggggtcttggtggcgtcaacgggaggattgatggccatgttgataggtcctttcatcatcactgtgaagcggaacgtgacggtggaatctcgttcgattttccacggcacgagccgttttcttcacctcacaagatactcacaaaagccgacagaacaacacaaaaatgtttcccgagttaacacattcggtcggaagcgcgatataccgcggttccgaccacttttcagcggcgacatgccagataaacgacgattactgaaatcgtatgcaacgttcagcggaaaagcttcaacgcacgtgaaaacggctgtcgtatgcaacgatcgcattacgattacgtacgcaacttacgcacgaccacgcacgcggcttacgcaagtcaggcgatggcggcgagcaggaagtgcgcgccggtcatcatgaccaggccgatgatcgcggacacggacagcgagaagccggcgagtttcgcattgccgagcacttcgtcggtgaacagggtggagaacacggcgattggcgcgaggcagcacatcaccacggcttcgcgcacattggcgccgaacggcagcacgaaccatgcgcagacggcgaacagcaggccgaatggcagtcgcagttcgatgatcttcagcagcttcatcacatcgtcacggccggcgggcaggtccatcagcatgccgaccatcagcatggcgacgaacgagttggcgttggcgagcggctcaacgaacgtggccacgacggcggggatcttcacattggcaagcatgagcacgatcatgaccaggtaggtgtcgaacgggatggagccgaagaagcctttcgccacgttgcgtagcagcgcgtggcgggcgagcctgcgggcgtccttgtccttgggcttcacgtacggcagcaccggagcgttcccctggtactgctcgcccagcgtcttgcctggctggatgtgcagtagggtctgcgtcatgacgttcgtgccggccgccaccatcacgcagttgccgatgtcgaacatggccgctggcacgatcgccgcggtgccgagaaacgcctgtaccacggggaagcagaagcagccgatgttgaagccggaaccgttgagcatggtgaacgcgcgatcctgcacaggcgtgtgacgtgtggtgaggaagatgagcacgggcgggatgaacgcgaccacgaagccgaagacggagatccacagcatgctggaatcatgcgggttcgtggcgaacgagtagatgatggcgcagggcagaaccaggttgaacagggcgacctgcatgatgcggtagtcgcggtttttgaatttgccggcgcgtttgaacaggtagccggtgaggatgatggccagcagcgcgattggctgaattaacgtggacatgtgcgcgagatgggacttgaacccacacgtcaaagacacaggaacctaaatcctgcgcgtctaccaattccgccactcgcgcaatcaccatccgcgcacggcgaaaaccgatacgcacggatgcacatatgcaaaaccctagatgctcggaaaacctccgaacatctagggcagtggagccacttgacagaatcgaactgtcgacctgctcattacgagtgagccgctctaccgactgagctaaagtggcgcaatgcccggtaagcatacgctagccgcgcacaagaaacaaagcatagcggaaaaaccggacgagcacaaatcgcacgcacgccatccagtgtcgtgcgccacggcaagcgcccgtcgcggccgtcatccgatgttatttgaccagcgcttcgatcgatgcgaccagcgcgcgcagcgccttgcctcgatgggagaccgcgttcttctcggccggctccatttcggcggacgtgagcttttcgccggcatcgaccgcacgctgcggctgatcgttcggcacaaacagcggatcgtagccgaaaccgttggcaccgcgcggggcacgcagcagcacgcccggcatttcgccgacttcgacggtttcgctggcgatcgtgtacggcttatcatcatccgcaccgtccgctttgcgctctcccggcacgaccagcgcggcggcgcagcggaaccgtgcggtgcgcttgctgtcggggatgtcggccagctgcttgagcagcagcgcgttgttggccttgtcgttgccgtgctcgccggcccagcgtgcggacaggatgcccggcgcgttgcccatgacgtccacgatcaggccggaatcgtccgcgactgccgggcagccggtgcgttcggccacgtcgcgtgccttgatgagcgcgttctcctggaaggtcacgccgtcctcgaccggatcgggcaatcccaaggagcctgcggagacgagctcgatgtcggcggcgtccgcgccgagacgttcctcgagaatgcggcggatttccgccagtttgcctccgttatgcgtggcgacgatgatcttcatgccttacggttccttccgtcgttttcctacttatatctgttttgcgttgttctatgcgccgagtcgccggcatcggaccgtcaacgtcctacattcagcgcatgccgtgccgtcgatcggctcagtcgagcgcgagcgcggcgcgttgggcggcctgcagctccctgttgcctttttcggcgaggtcgagcagggtgttgagttcggcgcggttgaacggacgatgctcggcggtgccctggatctcgatgaaatcgccggaaccggtcatggccacgttcatgtcggtcatggcctggctgtcttcgatgtacggcaggtccagcatcggcttgccgttgatcacgccgacggagacggcggagacccagtccttgagcacacggtcggcggacttgacgtgcttgtgttcctcggcccaatgcatcgcgtcgacgagcgccacgtacgcgccggtgatcgaagcggtgcgggtgccgccgtcggcctgcagcacgtcgcagtcgatctgcacctggttttcgccgagcgccttcatatcgacgacgccacgcaggcagcggccgatcagacggctgatctcgtgcgtacggccgccgatcttgccgcgcacggactcgcggtcggtgcggtcggcggtggcgcgcggcagcatcgcgtattccgcggtgacccagcccaggccggagtccttgcgccagcgcggcacgccggccgtgaacgtggcggtacacatcacgcgcgtgttgccgcattcgatgagcacggagccttccggaacgtccgtgaaatgccgggtgatgcgcaccgggcgcagttcgtccaccttgcgtccgtccgcacgcaccacggtctggtcgcccaacatatccttaatcgctaccattgctgttctgcacttcgctttccgctgatttcggcttttgccgccgtccgattactcgtcttttcagcattcgaccctatcaccagccaagcacgccgcgcctcgagacccctcctgcacgtatgatgggatgcaaccaaagattggccaccgtgggtcctacacttatggtcagtttcaccaaaagtcaagaaaggctttggaaatgctggattattcacccgcactcatgaccgacatgtacgaatacaccatgcttgacgcttgcctgaaggacggcaccgccaaccgcaagtgcgtattcgagatcttcacccggcatctgccgttgggccgccactacggcgtggccgccggacagggacgcatcctcgacgcgctcgagaagttccacctcgacgacaacgacctgaaattcctcgccgaccgcaaggtggtaagcccggaaaccatcaaatggctggagaacttccacttctccggctccatcaagggctaccgcgaaggcgagatgttcttcccgaactcgccgatcctgcaggttgaaggcacgttcggcgaatgcacgctgctggaaacgctgctgctgagcattctgaattacgattccgccgtcgcctccgccgcgtcccgcatggccaccgccgcgaaggaccgtccgtgcatggatatgggcggacgccgcacgaacgaatgggccgcggtcgccgccgcacgcgccgccgtggtgggcggattcaagggcaccgccaacctgctggccgcgcaaatgtacggtctgaaggccatcggcaccgccgcgcactgcttcaccctggtgcatgacgacgagaaaagcgccttcgaatcgcagatcgcggcgctcggcaagaacaccacgctgctggtcgacacctacaacatcgaagaagccgtgaaaaccgccgtcgaagtggccggaccggaactgggcggcgtgcgcatcgattcgggcgacctcgcgtccctcgcgcagcgcgtacgcaaccagctggacgcgctcggcgccaccaacacgaagatcaccgtcaccaacgacctcgacgaatacgcgctggccgcactgcagaccgcaccggtcgactcctacggcgtgggcaccatgctcgtcaccggctcgggcgccccgacctgcgcgatggtctacaagctcaccgaacgcgagaactccgccggcgaaatgcagccggtcgccaagaagtcgaaggacaaggccaccgttccgggccgcaagctcgccttccgctcctacgaatactcgctggccgactgcgaacacgtcatctccggctccgaagacaagctcgccgcataccagccggaagacggctggaaggacctgctcgtcgactacgtcaccaatggcgagaaccacagcgaataccagggccacgacgcgatcgtcaacgcgcacaactaccgcgcgcaggcgctcgccgaactgccgatcggcgcacagagcctgatgaagggcgatccggtcatcccgaccgaagtcaccgtgttgtgacgtccgtcatggcgtgaaccgccctgtacagcgcaaaagacataacaaaaaccgacgcccggtgaatcaccggcgtcggtttttgcataacatacgacgttgcgccgcactcggtcgccgcacccagccgccatattcaatcgccacgttcagccaccgcaaccggcggcatgaatcggcaacatggtcgaacggcaatcagaacgagctgttcatcatctcgtcatagatgcgcttgcaatccgggcacaccgggtaatgcgtggggtcacgcttcggcacccacaccttgccgcacaacgccacaaccggacgacccgtcatcttcgattcagcgatacggtcacgcgacacataatgcgcgaaacggtcggcatcgccattgccaccgtcatcaagcttcgtttcctcttcaggacgttccagaacggcggtaccggtacccgcatccgggttggacagcggcgaaaccggatcgtcggatccgaacaggccatcgaaaatcgcaaatgccataattaagactcctcacacaagccgcgatcgcggccccactgccttccatcatagccgagccgcattgcgccgccacccgtatgcacgaaccgcgccaacacgggcatacgccgatgttgcgcacgttctcaaccaatcgcggtacgcttaaggttatgacaattgcagtttgccccgggtcgtacgacccagtgaccgccggccacctggacgtcatcgagcgctgcgcgcgctttttcgacgaagtgcatgtggtggtggccgtaaacgcggcgaagacgccgatgttctccgaagaaacccgtgttgagatcatccgccaggcgctcgccaagcgcggttgcaccaatgtgaaggtggcgtcgaccaccggcctgatcaccgactattgcacgaaaatcggtgcgacggtcatcgtcaaaggacttcggcagaacggcgattacgaggctgagctgggcatggcattggtcaaccgcaaactcgccggagtggagacgctgtttctgcctgcggccccggacctggagcacatctccagctccatcgtcaaggacgtggcacggcacggaggcgatgtgacgggcatggtgcccgattgcgtgattccgctgcttggcgaggcgctcaagaacgaaaagagagcatgatgagtgaagagaccaacgatttcaagccgcttgctgacgccgatgacgccacgtcgcagcagccggtcacggcggcggccgattatccggccaccggcgctgttgccggtaccgcagcgaccaacaactccgcaaccggcaatgccgccgatcgtgctacggatgagccggcaaagcccgcgaaatcgtcgaaaccgtcgatttccatgtcggacctgcccgaccttcgcgccacgttcgaccccaacgcaccactcgacgacagttcggatcgcagccgcgacgaattcaccaccgtctacgacatcatcgacagcatcgaagaggaattggacgaggccaagccgattctgttcgcgccgagctcggtgcgcgtggaccgcgaatcgttcaccggcaagctcgacaaactcaagaagatgctgccagtgcagctggaacgcgcctccgcgctgatgcgcgaatcggaacgccgtctggaaagcgcgcaaacgcaagccaacgcgatcatcgcatccgcgcagtcgcgtgccgccgacaccgtacgcgaagccaacgagcaggcgcagttccttgccgggcaggagaacgtgacggaactcgccaggcagaaggcgcgcggcattctcgaccaggcgcaagccaaggccgacaagctcacgcagaacgccgacaaatactgcatcaccatgatggaatcgttgcaacagcaggtcgacaagatcggcaccggcgtgcaggcgggcctgaacgtgctgtacgatcgtcaacgcgaagccggcgcgcatctggaccatctcgacgcggacgattatccggaaaactgaacaagacgcgtaacacgcgtggaacgcatagcaagaaagagcgaaagactgaactatggcacgtactgaagattccccgtgggccgtttccgtggcgcaggtggcctcgcgtccggggcaaagcaaggagatcgacgccactttccccgcgccgagcggcatcggcgatgaaatcgtgggcgtggacgaaggcgcggatgtgagcgtggtcggctcgttcgattcgatcgtcgacggtctgattctgaacgcgcgtatcagcgctcccgtgcatgccgaatgcacgcgctgcctgaagccgatccagcgcgattggacggtgaacgtcacctccttcttcccgtatgaagacaagtccgccgccggcaagggcggaaaggccggcaagaacggcaaggaagaggaagtggacatcatcgccggcgaggacgaggcggaagacacgtacccgctgctcgacggcggcgcatgggccgacctcgaggcgctgctgcgcgacacgctggtcgaggaactgccgctgcagccgttgtgcaagccggattgcaagggcctgtgctcgcagtgcggcatcgacctcaacgagaaccccgaccatcagcatgacatgaccgacattcgtttcgccgcgctggaagggctgaaagccaagctggaaggcaaggaataagccgttcggatgggatggtccatcgtttgtacggagctcacgttaagatactgaacgcttaagctcaatcgttcgaacgaaatagaggaaacacaatggcactgcctaagtacaagacctcgcgcgcgaatacccattctcgccgcgcaaactggaaggccaaggccgcccagaccgttacctgcccgaactgcggcgctccgacgctgccgcacatggcatgcccgagctgcggttccttccgcggccgcgtgtaccgcgaggctgtccgctccatccacaccaagtgagtggttgccggataacggtataaagcatcgaaaccctgccatcgacgggtggcagggtttcttttattattatcaagtgatacggcgattgcattgcgatttatttccgcgtgcgatcggcgtacgacacacgttgcttgcgtagcaaaaccgccagatcagctggcgtcttgccatgtgcgcaacggccacaaccacagaccgcggcgggttacggcccaccgcatgaacggtaaggaacatccatggccaaagagaccaatcaggacaacgcacagaacaacacccaaaccgaaaacggcaacaataccaacgccggccgcatcggcacctccatcacccccgaaggcgagatgaccgccaatgtgttgctcgaggcgctcggcaccacaatcgaaccggacctgctcgtcgaagcgctcacccaccgctcgttctcacacgagcatgagggggccaagaactacgaacgcctcgaattcctcggtgatgcggtgctcgaactggtctccacggaaacgctgtacaaggtgcatcccgacatgaacgaaggccagctggccaaaatgcgtgcgaaggcggtttccgaggaatccctgagcaaaatcgcccgtgaaaaactgcacgtcggcccgtacattctgctcggccacggcgaagcggaacagggcggcgcggacaaaagctcgattctgtgcgacatcgtcgaatcgctgatcggcgcgacgttcatccagcacggcatcaacgaggcgcgccgcgtggtgcatcatctcgtcgacgatacgctggcggaggtcgccaccgaaggtccggcgctcgattggaagacgtcgctgaccgtcaaggcgcatgagatgggtctgcccgacccgcactaccagacgtcggtcgccggaccggaatacgcactggagttcaccgcgcgcgcgattctcggcgatggcggcgaagtcatcggcgtcggtaccggcagcagcaaacgcaaggcgcagctggcggccgcggaaatgggctggaaggcgcttgacagtcgcaagggcgaaatgggcggcaagcagaacgggaagacgcataagtcgcaccacaggtcacaccgcaagtccaacggtggcacgcaggatgcagcgcagggcaagtaaccgcgcaaacggtaacgcaagcggcggcacggccggcgtcacgaaacagcattacaaggcagcgtcgcaatcgcaaaaaatatggtccatatcacaatggcgcgtaacgcgccagaatatgggcctttccggcgaaccaagctgtcagccgttagcatagactcattatcagagaggaatgcggctgcaatccgccacaagcggttgcatagcattccgtttaaggggtaaaacggcgcatgaacgacgcgaccgcggccccttacgaggaaattttccacgaacgagcatgagagggaacatggtgttacctacgcctctgcaggcattcagcggcatgccaaaggcatccgctaccactgaaaagcagaccattgtcgacggcgaaaagatgaccggcgccgaagcgctggttcgttcgctggaggatctgggcgtcaaggacgtcttcggcgttccgggcggtgcgattctgcccgtctacgattccatcaaggacgatacgaagttccgcttcgtgctgatgcgtcacgagcaggccgccggacatgcggcagaaggctacgcgctgaccaccggacaggtgggcgtgtgcatcgtcacttccggtccgggcgcgacgaacatgatcaccccgatcgccgacgcgaacatggattccattcctatggtcgtcatcaccggccaggtcggcgtgaacgccatcggcacggacgctttccaggaagccgatatcgtcggcgccacctatccggtggtcaagcattcgtacctcgtcacccgcgcgcaggacattccgcgcgtgctgaccgaggcgcactacatcgcacgctccggccgtccgggaccggtggtggtggacgtcaccaagaccgcgcagaccggcgagatgtattattcctggccgcagcgcatgatcctgccgggatacaacccgactaccaaggcgcacggtcgcgtgctgtccgacgcggcgaagctgttcgagcagtcgtaccgtccggtgctgtacgtcggcggcggcgcggcgcgttccaacgcgggcgagctggtcaaggagctggcggaagtgaccggcgctccgatcgtcaccacccttccggcgcgcggcattgtgcccgattccgatccgaaggtgcttggcatgctcggcatgcatggcacgatcgcggcgaccggcgccgtgcagcgctgcgacctgctggtcgcgatcggcgcacgtttcgacgaccgcgtcactggcaagctcgacgcgttcgctccgggtgcgcgtgtgatccatatcgacatcgaccctgcggaaatcggcaagaaccgtcagccggacgtgccgatcgtcggcgatgtggccaccgtgctcaaggacctcatcccggagatcaagcgcgagcaggccgtgcacggcaagcccgacaccagccactggtgggacgtcatcaacaagtgggtcgaggattatccgattacatgggacgaaccgaccgacggcagcctcgccccgcagtgggtcgtcaagcagctgtccgacatggccgatccggacaccatctgggtttccggcgtgggccagcatcagatgtgggccacccagatcatcgaattcaacaagccccactcctggctgtcttccggcggcctgggcacgatgggcttcggcctgccggcggccatcggcgcccgcgtcggctccgcccgcgaattcgacaacaagaagccggtgtggctcatcgacggcgacggctccttccagatgacttccgaagagctggcggccgcgttcctcgaccacgcgccggtgaagatcgcactgctcaacaactccgtgtacggcatggtccgtcagtggcagaccctgttctacgatcaccactattccgcgacgaacctgctggacggcgagaacacgccggacatcgtggacgtgccggacttcgtgaagctcgccgaagcgtacggctgcgtcggcatgcgcgcgttcaccaaggacgaggccatcgaatgcatcaagaaggccaacgaaatcaacgaccgtccggtgctgatcgatttccgcgtgtggaaggacgccatggtgtggcctatggtcgcagccggcgattccaacgacaacgtcacgtacaagccgggcgtgaagcctttgcagcgcgccggcgagaacgactgaacgagtagcgtaaggaaggaaatttcgatcatggcaaattatcctgcatcccagccgggttccaagcgtcatacgctatccgtgctcgtcgagaaccgtccgggcgtgctggcgcgcatctccggcctgttcgcccgtcgtgcgttcaacatcaactcgctgtccgtctcccccaccgagcgtccggacatttcccgcgtcaccgtcaccgcggaagtggaggaggtgccgcttgagcagatcatcaagcagctcaacaagctgctgcacgtgctgaagatcgtggacctcgatccggagaccaccgtggagcgcgagttggtgctcatcaaggtggcggccgacgagtccgtccgttccgacgtgctggagatcgtgcgtctgttccgcgtgcgcgtggtggacgtgaatccggaatcgctgaccatcgaggccaccggcgccgaaggcaagatcgacgcgctgctcggcctgctggagcattacggcatcatcgagctggtccgctccggcgcggtggccgtgacccgcggtccgaaggcgctgagcgagaaggtgctcggctccgaaatcaccggtcgctgaacgggctgagcggcattgcctacggcaaagcgccgccccacgattcgtttcgtggggcggcgctttttatttcgattcaccgcaacatcgtatgttcccattgcgccgccttgggaatgctacgaatggaacgggaacatatcaccagcacggcgcttgcctcgagaacggcgaagaacaccagcatcgtgccatggaacccgagaaccggaagcaacatgccggccacggcgctgcagaacatcgaaagcacctgggccggaaccgtcaatgtgacggtgatacgcccctgcatgctcgtaggcgacttggcgaagatgaaaccgaggagcatcgcgttaatcaacgggaacggcaggccaaccaacgaattggcaaccagcatgacccaatagttgtcggtcaacgccatcggcaatacgcataagcagatgaacaggtaggcgaggcacacggttggtccaaccggaaccttatcgctgaatttgccggcaagcaacgatcccacaagcatcatcagcgatatgccgccactgatgaatccgatggaggtcgcattggtcccgcacgacaccaaatgcagctggatggcatattggatgccattgacgccgaaattgaccaatgccgccacgatgagcacgatcaccagcgttttcctgtgcaacgaccatgaccagccttccaggaaatcgcggaagaaaccgcctttcactgcatcgccatccgtttccccgatacgcccgccatccgcgccatgttcgcggatgccggtggcggcgacgccggccacggcatacatgcatgccgacgcaaggaacggcagccatggagcaatgctgtacagaaaacctccgatggggcttcccgccatggcgatggttgcgtcacgcccctcgttgaggctccgcgccttgggataatagcggatatcgataatcgagcgaagcatcgcatccgtagcgctcccaagaaatccgttgatgccggatgcgagcaccgcgatcaacagcaacacggggaacgacaatgcgccgcacagcagcagcaccgcaactgcgccccaagccagaacgccgacgacggcgttcgccacgataagccgtttgcggtcatgcctgtcgacgaaggtacctccgaatacgctcgcaacctgttgcgcgatcatcgacgacgttccgagccacccggcggcgatggtggaaccggacaccgcatatccaagcaaactgatcgccagtgcgcgcagcgccgcaccgaccgccggcgccgtatcagcggtaaaccaagaaacgtaccctgcggattgccagaatgatttcgctgttccgtccatgtcttgtttcacttgttttccctgttccgtccacgctgttcagatcgcctatgggtccatatgcaaagcccgccgactccttacgaaaaccacctgaaagcctgtagaatcagcgccacgggttcggcgcccggctcatcgtcgccatgcatgccggccttgatttgccagcgacgtacgacctcattgagttcctcaatcattaaacacatttcctcggcggtcaggttcagaacatgatcgtcgctggtgcatgaatcggcccattcccgaggcaattccggcagcctgtccagaaaacgctcgtaggccatctcgtaggaaagtgccgccgaacgccgaaacagatccatggcctttgccttgtctgcactgttcttttcttcggagttccccagacgaacggcggtttggcaagccttccaccagctttttcttcggtcgccatcaggagacctcaccttctccaccagtcccacccgtgcaagctgccccaagtgatagctgatggcccccggagcctcgccaagctgctcgctgatgcttcccacggtctgctcgccattcacccgcaacgttccaaggattctcatacgaatcggactcgccatggcccgaagagtatcggcattggtcacggtcactgcggcatcttcgggcatccgcgcttcgttaggggtcacgtcagtcattgcaaaggtcccctttccaccgcctcccattatatacaaattttttgtacaaaatatttgcttttgaatgggttcgcaacatgtgtctcaccggtaacgccgcgatctattgcagctgcgaaaaatgtctattctggaacgagaaacaaaccacgggggaatttatatgcgcacgattgtcaatgattcgactctagggattgtggataatgatccactggtcgcgagcgcaattcaaagcttattggtcgagacatgcgcaccaatacagattctgtggactgtcacctctgcagaacaagcacttgaggccatgagggactctgcacaaaggccacaagccgtgcttaccgatatcgcaatgcctgggatgaacggctcggaattagcgcatcatatcaaggaacaacatccagatattgccgtcattggtatcagcgcctttttggatgacgaaaacgaaaaaagatacggagcacaatggtccgatgcgttttatgcgattattccaaaagaaattcccacgattcaactggttcgaatcatcggaaaagccactggaaatgacgaggttgcgtcgtgggcggggaagagcataaactccatgcggctttccggcaaggaattacagatcattgccaactatgcgagaggattcaccacttccactattgcacaccaactgaatatcagcgaagcatcggtaaagacatatgcacgacgagctttcgagaagctccatgctcatagtcgtgccgaagctgttgcgatgtgcgtaagaaacggttggatataacgatgaggctgccccaacaaataatgtcattggcaaaggccgtgcgcaagccttacttagcgggatccattatctgtatctgctttttcctgctcgagctgaccgcttggccaaatatgtcaccttggtcatggctatatttggctccgtactgcatcgctctgttgctactgacttggttccccgtaccggcaagcatggcgattcttgtaacacacatagcatgtgcaataatcccggcaatatgcgatggcccttcgacgttatatggcacatggcttgtatgtggaatagttgcttttgaaatcaaacgatttgaatttgccatcatgggaccgctgctttgcgcactagcacttcctttgggctattggacaggcggcatcgactacaatccaagcatccctgtgcttgcgtgctcctacattggagcattcttcgttggctttgccatacggtggaagatacagacagagcaacggaaaaccgacctggcgattgcacaagaacaagttcgacgccagcagaaaagactcaaagaaattcacatactgcacgattccatcgcaggagctatgacatatgcgattctgctgtgtcgcaagaaagagccctcagagagcagcgacactttgccacagattgaacaagtcctcatgcaggcattacatgagcttcgcactcaaattatcagcccgatgaccgatgagcttaaaacagacaaagaggaagacgcggacgagctctttcaacaacatatagaagctcaatgcaaaagactgagaatactgggttttaccgggacaccaataatccgcgggaatctaaacgcaatggacaagtcactactaccatcgttgcaaacggtttgtaccgaaattctcaataacattgccaaacacgggaaacccggggcttttgcttttatcctctctgtaggaccagatgcggttcgcatcttcgcatcaaatctatataacgccgcaataaatagtgctccagaaaatcactacgggacagccctcatacaagattttgcgcaacaacataatgggacaatgaccataaattcagaaaatgaagaatggtcattgtccctgacaattccactagcccatcaagttaagctaatgttttcccccacagaaaaactctagaaatggagggcaaggcacaatttgttctctggtgttgccgcgatgttttctggaaacatcaattgtgatataaccatggctggtttgtcggcatctttgcatgcttatatttttgattgacgacattacacggagaaacgacgtcataccgtgtgtaatcgaattcgtatccagctgcaccaagttgaacccattttgtggtatttgatgtgtttgtccaactccatccctgactttcagagacagtctgtgaggttgatagactcgattgcacatgtgccttaacatatgaggaaaattcagcatccactccgcctgtaacactcccagtgaccgttgtagttttggcttttgttacagtgtatgtcccaccaggcgaaagccaatttttaggtagagaacctgccatgaatatgcggcctttgttagagacagactgatgatgtccaatttcgggacaagacataggcgcaacgtcagtattttgctcagcctgcgcaggaatcgagagagatgccatagaggcagccaacaaaatactagtaattactgcaactactttatttcgcttattcatgatggttttcctttacttcatatacggaaacaacaagatccgtattgccgatattgataatggacaatgaggtggcgctagggaaattcttcgccggaagagagactgtttccactccattagaagtacaggattccctagtggttacagtgtgcggctgtccatctttgtagaggacaagtgagtaaggagcctgctccttctgtttgcacatggaaacgacataatacatattgttttcgtcgacttttttggcaaatggaatagcatcatcgccgtgcacggatttcgcgcccagcttgtttactagaaccagtttgtctgagttattgagatcgtcggcggcaatacggtccaaagcgtccacagtaaacgctttatacgcttgctccgctgcatcatcgttcttactgctgctctgggcagcgtctccttcagagatttcgtgtacggaatttgcacaaccgacgcatgagcacagcaacaaagccgacaacaaacaacaggcacttcttcgcatcacttcattcatgagacacctccattggtttctccagcgaaaacagctaagaacttctatgcgaacagaatatggcactgatgcataaaacgccacgcatcgttgtcgcacgaatggctatcgttcattgcacgcattagactaatgcatgggctagtggaagagactctatgcggagttggggaatgtgacgagatgacgattgattccatccatgcgattgcggcgctatgcgtcggcatcgtgcttattgcactgccttggctgcttccacgggattcaggggaatatgtacggtgcacgcaatgcctcaaataccatcaggcatgcagccatatctgccccgcatgccttacgcccgattccaccgcatccagcgcgccgcaatatgcatacatcctcactacgcgcacacgaggcatgcatattcagcttctgcttgcagtcggcgaattcctcatctgcgtggcgcaatgcgcattaccttgtctgatcatcaaaaacatcgtcgtcaatgccggtctgccaacggcttatggcattaatcaacacatcaaaatcgcgtttgttcttttgctcgttccaactgtcgcctgctggtatgcgttccttggttccggactacgaggggaacaaagctactcgcccgcacgcccgatggtattccgccgtggaacgccatccgtcgtcaaggagctgctttccggtctcggcttcgctcttacgcaatcggccttgctatggctcgtgattcgccccatgctggccgtcaacggcgcatcggcattcatgctggaagatggcaggcccctgctcgcatatggcatcgggaccgtctgctgcgttgtcgcattcgcgatttcctgctgcgtggcgccttgcacgttcggcacattccggcacgtacctcgtggaggatacgccatcgaccaggcaaccaacgccgtgaaagtctcacatgaaccttccggattcagtattgccagcgtattggaaatagcacaaacgctgttcgacgattgccttcgctaggaaactggctcgcaatgccgctaaccaactgtcagccttggatgaaatcactttccttgataaaatgtacgtgcaatatctagcttttgtacatacaagtggatgaggtttctgatgagtgcatcaacgttgaccatacggatggatgacgaactcaagcgttcggccgccgacgtggccgaatattatggcttggatctctcgtcagtggtgcgcgccgtattcaagcaaatggtgaataccgggcgcatcccattgacgttcgcccccgaggagcctaatggcgaaagcctgaacgccgctgccgaagcggacagcttcatggcatcgggcaagacggggcgttttaccaacggacacgacctgctcgaagcggcgatgcgctgatgggccggttgaccgccgacttcgcgaaggccttcagccgcgatctgaaaaagaacgccaaacggcgtaactggaacctgaccgagcttgaaaaagtcatcgatctggtagtggagaacaccccggaaacgctggaggagctgcaccgccgccacaacatgcacaccctgtccggcaattggcgtggacggtacgaatgccatgtcgccaatgccggggactggctggtgatctggtcatcgaacgattcggtcgcgtttttcgaacgtaccggcagccacgacgaattattccggtaaaccgacgctgagcgaatcgccagcgtcggttttgtgcattccgtaccgccaaaccgacacctacaagcctctcaccatcagtttgcccgactgggactactcgagctgttcggagagctccatccattccatttcgagggattcggactcgtccatgacggcctgcaactgctcgttgagcttgcccagcccctcgtaatcgcttgggtcgtgcgcggccatctgcgcttccaaatcggccttctgctcctccagcttggccagcttgcgttcaatcgcagcaacgcgcttggatgcctcgtggaacgccttgccggtaagcttcggcgcggccgcagccgagtcgccatcggcagacacggatgaggaatcaccgacaacgctcgcggacgcggcgtcattaccgcccttgctagccttgccggcctttccggacttctcgtcggcgaacggatccttgccgttcttgatggcctcggtcatgtcgaggtaatcctgcacgccgccgggcagatggcggatcttgccaccgatcagcgcgaactgctggtcggtgacgcgttcgagcaggtagcggtcgtgggagacgacgatcagcgtgcccggccaggtgtcgagcaggtcctccatcacggcgagcatgtcggtgtcaagatcgttgcccggctcgtccatgatgagcacgttcggctcgtcgagcaggatgagcagcagctgcatgcggcgcttctgcccgcctgacaggtccttgatcggtgtcatgagctgtgcggattcgaagccgaggcgttccatcatctgccccggcgtggtctccttgccgtccacgatataactcggcttgtagcggctcagcacttccttgatcttgtacttgcccagcttctccagctcgtcgagacgctgcgaaagcaccgcgaacttcacggtcttgccgatgttcacatggccggcggtcggggtgatcgtgccgtcgaggatcttcagcagggtcgatttgccggcaccgttcgcgccgacgatgccgaagcggtcgcccgggccgatcagccacgtcacgtcgtcgaggatcttacggccggtcacggtgaccttccgcgccgcggacgtgacctccggcgtggactcgtcggcgtcgccacccgactcgtgcgactcctcctcggcctgccgggcggcctgcgccgcctgtcgcgcctcgggcacgccggcgtccaccaaccgcggatcggtcagatcgtcgacggcgacctccacgctgccgtgcgcctgcggctcggcatacatggccggcaccacgtccacgcgcgaggccgaagcctccatttccgccacatccggatcgatatcggcctcgccctgcgcatgttcgaagatctgcgtcacgtcgatgagatcgaccacctgtttgccgagacgcgacgtggccatctgcttcagctccaacgtgttgcgcaccggcggcacgtcggcgatgagctcgcgcgccgccttgacatggaacttctgcttggtggaacgggcgcgggcgccacgggtcagccaggcaagctccttgcgcgccaggttgcggcgcttcgtctcgcgcacgtcggcctggcggtcgcgctccacgcgctgcagcatatacgcggaatatccgccttcgaacgggtcgatcacgccgtcgtggacctcccacatcgactcgcacacctcgtcgaggaaccaacggtcgtgggtgacgagcagcagcgcgccctggccggacggccaacggttcttcaagtgttcggcgagccagtggatggtcaccacgtccaaatggttcgtgggctcgtcaagcgcgagaatgtcccagtccttgagcagcaggcgagcaaggtcggcgcggcggcgctgaccgccggacagggagccgatcttcgcgtccagactgatgccgccgagcagcgcttcgacgatctcgcgcgatttggtttccgcggcccactcgtaatcttctcgcccttccaacgcggcttcgcgcaccgtggcgttgtcgtcgagcgggtcacgctggtcgagcatgccgaacgtcagtccattgcgcatggtcacgcgaccggaatccggctcctgcgtgcctttgaacaaatgcagcaatgtcgatttgccgtcgccgtttttgccgacgatgccgatgcggtcgccttcgaaaacgccctgcgtcacatcggtgaaaatattcttggtcgcgaaagcgagcgaaacgtgttcaagtcccaaatcataagtcggcataactcaccaatgtagcgcgtcggcggaacaccgcctcccgcacacgtatttggggcttgctcaccagctgcatgatgcgaaacgtagacaggagaccttggaatgtaggcaacgaaaacgccctagaagattccgtaggtggttttccgcttccgtaggtggttgtcttcggataccgcacgaagaaaagccttaaattcagcctttccgaaacactggcccatcacccaaccacctacggaactcaggaaccacctacggaaggcactcagctggcgattcagtggggcgtgtagcgggcagaacgcttatcagcgctccagcgttgcggcataggtgctgcaccgggccgcgaatccggagaaaacctgatcggccatcggctgcagctgcggattgtattcggcgaaggcgtcacgtagctgcgatttcgaaccgccggcggccttcaaatccttcaccatgcacggctcgtccagccactcgtccaacaacgtgggggtgacctccaggtggaattgcaggccaagcgccgaaccgaaccggaacgcctggttcttcgtcttcgcgcttttggccaacggctgtgcgccttccggcagggtcaccacgtcgttgtgccagtgcagcacgtccaacgtcttgttccacatggagaagtagtcgtgcttgtcgatgcgtttaatcggcgcgaatccgatttccggctcgctgcccttcttgagtttcgcgcccagcgcggtggcaatgatctgatgtccgaggcacacgcccagcaacggtttgccgacgctgacggcggcgcgtacgagtttggattccgctttgagaccgggatacttgtcggtgtcgagcgcgcccatggggccgcccataatcacgatgccggagacgtcactgaaatcgggaagatcgggctttttctctttggcgatgttcatcacttcatacgacatgcccaagtcgtcgagactatccaaaatgcgccccggtttctcccacgggacgtgttgaagaatcagcacatgcgattgcgtcatgccactatttttacatcatctgcgtaaatgacgctcgcgattcggctctgtgtctgcatacgttcgcaatacgatgccgtgcatatgccgggaaaaccaagcgtcatgtccgattctggcaatattctcatgactatgacaaacacgcaggaaccgcagaataccaacacttccggcgctcttgcggtggcgaaggccgccgcggggctgaagctgtacgacaccgcatcgcacgccgtgtcgtccttcacgccgatcaaaccaggtcaggtcggtatctacgtgtgtggcgccaccgtgcaaagctcaccgcatatcggccacatccgcgccgccgtcgcgttcgacgtggtgcgccgctggttcgagcgactgggctacaatgtgacgttcgtgcgcaatgtcaccgacatcgacgacaagatcctcgacaaggccgccgccgcgggccagcagtggtgggagcgcgcgtatatctacgaacgcgagttcaccgaggcgtacagcaagcttggcgtggagccgccgacgtacgagccgcgcgccaccggccacatgatcgacatgatcgacctcatcaagaagatcatcgacaacggccacggctatgtggtgcgtgacgcggacggcaacccgaccggcaacgtctacttcgacgtggcgagctggccgcattacggcgagctgacgcaccagaagcagaccgcggtttccgacgcggcttccgaagtgaccgacgcgatgggaccgtccgtggacaacgcgggcaacgacaagtacaatccggtcgaccctgccgacatgtcccccgacaagcatgatccgcgcgatttcgcgctgtggaaggcgccgaaggattccgatccgctcgacgcgcgctggaataccccgttcggcacgggccgtccgggctggcatatcgaatgctccgcgatgagccaccgctatctgaaggacatgttcgacattcacggcggcggtcttgatctgcgattcccgcaccacgagaacgagatggcgcagacgcgcgccgccggttacgattcggccgcgcgctggatgcattccgcctgggtcaccgcgaagggcgagaagatgtcgaagtcgctcggcaacggcctgtccgtgccggcggtgctggccgagcattccgcttgggtggtgcgttacgccctcggttccgtgcagtaccgttccatgctggaatggtccgaccagacgcttgccgaggcgcagtccgcgtacgaccgcgtggcgaacttcatcgagcgcgcgggcgctgccgtcggcgaacagccgtcacgagaagagattatggcgatttccgccgacgcgcttcccgccgatttcgttgccgcgatgaacgacgacatcaacgtttcgggcgcttccgccgcgattttcacggcgatccgttccggcaacacgttgctgtcgaagctggccgaccgcgccgattcggacgtggcgaaggccgaggttcgcgaggcgctggtgaacgtgcgtgcgatgctcgacacgttgggcttggatccgctggcggagccgtgggtttccgacggtgccgcaggtggtgcggctggtgccggagccgattccgccgagcatgacgcgctcgacaagctggtttccgaacagcttgcggaacgtgccgaagcgcgcaaggccaaggatttcgcacgtgccgacgcgatccgtgacgcgctgggcgcggccggcatcgccatcgaggacggtccgcaaggctccacttggtcgctgaagtaggcaatcgcacccatttcatccgctatccgcgtgaaacgctagactgaggaacattatggcagcatttagttctttgacagaccggctctcgaatgcgttcaagcatctgaagagcaagggcaagctttccgaggctgatatcgacggtaccatccgcgagatccgccgcgcgctgctcgacgccgatgtggcgctcgacgtggtgcgttccttcaccagccgcatccgcgaacgcgcgctcggcaccgaggtttccgaagcgctcaacccggcgcagcaagtggtgaagatcgtcaacgaggaactcaccgcggtgcttggcgccggtgtggaccgcccgttgaacttcgcaaagaatccgccgacgatcatcatgctcgccggccttcagggcgccggtaagacgacgctcgccggcaagctgggttactggctgaaggattccggccacaccccgctgctcgtggcggccgatctgcagcgtccgaacgcggtgacgcagctgcaggtggtcggcgaacgcgccggcgtgccggtgtacgcgccggagaagggcgtgcagtccgatggcggcgaagcggtcgtctcccccggccagaccaccggcgacccggtgaaggtggcccgtgacgccgtggagctcgccaagcagaagctgtacgacacggtgatcatcgataccgcaggccgtctcggcgtggatgaggagctgatgaagcaggctcgcgacatccgcgatgccgtgcagccgaacgagattctgttcgtcatcgacgcgatgatcggccaggatgccgtgcagacggccaaggcgttcgacgagggcgtggatttcaccggcgtggtgctgtccaagctcgatggcgacgcccgtggtggcgccgcgctgtccgtggcatccgtgaccggcaagccgatcctgttcgcctccaccggcgagggattgaaggatttcgaggtcttccacccggatcgtatggcgtcccgcatcctcgacatgggcgatattctcaccctgatcgagcaggcgcagaagcagttcgacgaggaagaggcccgcaaggccgccgtcaagatctccgacggttccttcggccttgacgatttcctcgaccaacttcagcaggtgcgcaaactcggcccgatgaagaacctgcttggcatgattccgggcatggccgcgcatcgtaaggaacttgagcagttcgacgagagggaaatcgaccgcaccgaggccatcatccgttcgatgactccggccgagcgtcgcgatccctcgatcatcgacggttcccgccgcgcccgcatcgcctacggttccggcgtgacggtttcgcaggtcaacgcgctgctgcagcgcttcgaccaggccgcgaagatgatgcgccgcatgagcaacaaggtcggcgccggcgtgcccggcttcggaggccccgcgatgggcggcggcaaaggcaagggcaaaggcaagaagaacaagaagaagtcgggcaagtccggcaatccgatgaagcgtgaggccgaggagaaggcattgcgcgacaagctcgccggcaaggcttccggcggtgcttcgtcgggtggctccgcgttcgccaagaagccgcagaatccggcgcttcctgccggattgcaggatatgctgggcgattccggcgagctgccgccgaacttaggtggcggtctgtccggtctgctgcactaagcgtctgctgcactaagcgtctgctgcactaagccgcgatatgtgcgattgccggcgattacgacaaccggcaatcgcaatacggcatatataacgaaactgccgacgttggaacattttccagcgtcggcagtttcgttatgccagcttattttcggcttatttcaacgtcagcgtggcggccagagcaagatgatcggtaccgttgaccgtgaaggagcgcacgtcggatgcggtcagaccggcggtgaacaagatgtggtcgaggatgagacgcggccacggcagccacgatgggaacgtggcgcggcggcccttcgcctcggtcaacgcggcgtcctggaagccggcgtcaagcagcttgcggaagctcggatggtcggtaccggagttgaggtcgcccaatacgacggtgatatcgccctgcttctgcgatgtggccagctcacccaagccgatgatgccggcggaccagtcgcggcagccgcgcatcggcgatttcggatgggcggaaacgaaagtgatgccgcgcatcgcatcaatcgggaagcacacgccaggcacgtcggcggcgggaatcacggcggtgatcggcgacgtgtcgcttggctcgatgcgaatccaaataccgttgaagccgccgttatccgtttccttgctctcccctaactggcggtacggcagcaggtcggacaggccggcctcgtccaaggccgcgaccagatcgtccgtcaattcctgcagcgcgagcacggcgacgtcgtgttccttgacggcgctgacgattgcggccgcattggcacgaccgtaccggcagttgagcgtcatcacgcggaaacggccgtgtttcgcggcttccgcggcagtcgacgtatgtgttccacaggatgtttcacgcttttttgcgatgttgtcggccaccatctgcgccgtgttgatggacgtgagattgttgttccaatacgcgattttgcgcagcagcgaagcgatgcacgcgatcgccgcgacgatggcgagggcggtgtcatgccgtacgacaccggcaatcgcaatcgccaatgttggaatccacaacagcggtgtcagcgcaatcagatacggcaacggcaagtggccgtcccaaccggccggcatttcgctcagagcgatccacaacacgcataccagcagtacgatccacaacgcaacactcatgcaaatccccttgaaatggccataatcaggcgcacgaaaaccgccaatgaacatatccagcatagcgagttcgtccgattcgggtgatccggacgcccgagaccgccacaacacctcaccaatgtccgattctggagaaacggccattcagaatgcgcaaaacgcaagccgagcgtccgagtcaacagaaacggacgctcgggaacgcatacgggaacgcgtccataccccacggttataattgctcagttattcgcgcgcgcgaggccctctaccaatcgcgtgacgtgaggaacacgtgggtttcggattccgtgccccacacagaacacgaaacacacacccctagttacaaggagagccattttggcaaccaagattcgtctgaagcgcatgggtaagaagttctacgcgttctaccgcgtggtgatcatggattcccgtaccaagcgtgatggccgcgccatcgaagagatcggtacctacaacccgaacacccagccttcgaccatcaacatcaactctgagcgcgctcagtactggctcggcgttggcgctcagccgaccgagcaggtgctgaacctgctgaagatcaccggtgactggcagaagttcaagggtcttgacggtgctgaaggcaccctgaagaccgttgaggctggcccggatgccgccgctcgcgtcgaggctgtcgaagcccaggcccagaagctgaaggccgccaagtccgaagctgacgccaaagccaaggctgaggccgaagccgccgccaccgaggaagctccggctgaagagccggctgcggaagccgagtgatcatgctcgcccaggctgtggaacatctgatcaagaacatcgtcgattttcccgatgatgtctcggtgaagtcccatgagaatccgcgcggtgaactcattcgcgtgcgcgtgaaccctgaggatatcggtcgcgtcattggacgcagcggacgcacggcaaatgcgattcgcaccgtggtgcaggcactgtccgaccacaaggtgcgcgtcgacatcatggacgtgcgcaggtgagatcctagcgtggtgcgtgatatgcattccgacgaccctcaacagcttgagctgctgagggtctgtcgtatcgggcgtgcgcaggggctcaagggcgaggtcaccgtgcagatctttacggacgaaccggaataccggttcgctcccggtgctgtgttgtatacgaaggacggcgaggaagagtacgtggtggaaagctcccgtaccttcaaaaaccgttggatcatcaaattcgaaggcatcgacgaccgtgatgcgtccgaagccgccaatggcgtggtgctgtatggcgaagcggacgatccggaggagatgcttgaagcggacgagtggtacccgaaggacctgatcagtcttgaggcgcgccttgccgagggcaatacgctggggcttgcgcccggcactgtggtaggcaaggtggtggatgtgattgaagtggcccagtggctgctcaagatccgtctggccaatcccgtcaaggacgccgatggcgtggtggtcgagaacagcgcgctcgtgccgttcgtggacgagctcgtgccggacatcgacctcgagggcggatatctgaccctcgacccgccgggcggactcattccggggctctgatccgctgcttttccaacaaggcgctggcgattatgccggcgcctttttcgtacgcgccgcgcttggcaggcgtaccggtattgtggagcattatgaagatcgatatcgtgtccgtattcccggaatatttcgaagtgctcaacctgagcctgctcggcaaggcgcaggagaagggcctggtcgaagtcaccgcgcacaacctgcgcgactggacgcacgacgtgcaccattccgtggatgatactcccgtcggcggcggcgcgggcatggtgatgaagccggaggtgtggagcgaatgcctcgacgagctgctgcatcttgagccgaccacggttacttgcgattccacggcagacgcagacgacacggcttccgcagacgcggccgaaccggcggaatcggcgacagaaatcgccgcaaatgccgataccgttccggcgaccgaccgtccggtgctgatcttcccgaatccgtccgctcccctgttcacccagcaggacgcgacggagctgagccacgccaaccatctgctgttcggctgcggccgttacgaaggctacgacgcgcgtattccgcagtattaccgtgcgcagggcgtcgacgtgcgtgaatattcgatcggcgattatgtgctgaacggcggcgaggtggccgtgtcggtcatgttggaggccatcacccgtctgctgcccggtttcatgggcaatgcggcctcgatcgtggaggaatcgtatacgggagagaacgccctgctggagcaccgccagtatacgaagccggccgattggcgcggtatcaaggttccggacgtcctgttgtccggcgaccacgcgaaggtcgaccgtttccgccgcgatgaggcgctggcgaagaccaacgagctgcgtccggatctcatcgaggcgttggattgttccaagcttgacaaggccgatcgcaaaacgctgatggcgttgggctgggaggtttccggcgcgcacccacggcagcgctgattacgcacgattgttcacgtcgacggagggcatgcaggtccaccgtcgacgtttttagttggaaagcccggacgtcagtccgcggattcaaccggctctgccggctcggcggattcggcaggttcgatgtaatacacggcggtttcgccgtaatcacgccggtcggtgatatcccagccttcgggcgcggtcggctcgtcggaacgagtggagcgttccagcacgatcaccgtgccctcgccagtcagttcgccggactcacggcccgccaaatcggccagcagctggttgcacgcctcggtttcgaacgcgtacggcgggtcgatgaagatcacgtcgaacggcgcgaccgccgatgcggccgccgcgtacttttccgcacgcgccttgaccacgcgggcgctcatgcccggctcccaggaacggttgtgcttcaacgccgtcaacgtctttgcgatcagcgcggcggccggtgcggccgattccaccgccaccagttcgcgcgcgccacggctcagcgcttcgatgcccaacgcgccggttccggcgaacaggtcgagcacacgtgcgtcatccagcacgccccacgaatcgaggtgcgagaaaatcgcttccttggtacggtcggtggttggcctggtgcccggtttcggcgtggtcaatgccatgcctttgaatcgtcctgaaattacgcgcatagctatcgagcctagttgctggtcaggaacgtctcgttgccgcgcgtgaagtcgagcaccgcgccggcaagctgcacgtacccttgcaacgtggggtcttcggccaccagtttcgcggcttccgctctggcttcctcgatgatcttcacgtctttgaccacgcgcagcagtttcagtccggatttgccgccggattgcgcgtcgcccagcacgtcgcccgcgccgcggaattcaaggtcggcctgcgcgatttcggcaccgtccaacgtgccggcaatcacgtcaaggcgtttggcagcatcgctgccttccggcgcacgtgaaataaggaacgcgcccgattcggtgccgccacggcccacgcgtccacgcagctggtgcaactgggacaggccgtaccggtcggcatcgaaaatcaccatgcagctggcctgcgccacgtccacgcccacttcgatgacggtggtggccaccagaatcggcgtcacgcccgcttcgaaatcggccataatctgcgatttcgtttcgtcatcgtcgcgaccggtcagcgtggcgatacggatgccggcgaattgcggcagcgatcgcaagcgttccgcgatttccgcgacggaatgcaacggcggccgctgttcgcgctgttcgtcatcctcgcccaaatcgtatgtggcgtcgaatgcggaaccgacttccgcatcgcctgaaccgcccgcatcgtcggcatccttcgcgtcggcgtcgatgcgcgggcagaccacgtaggcacgttcccccgcgtcgatacgcttgcgaatcagaccgaacatttccgccatcagcgggccgttcgcttcgggcacgacgaatgtgcggatcggcttgcggccgccgggcagttcggtgagccaggagatgtcgaggtcgccgaaccaggtcatggcagcggtgcgcgggatcggcgtggccgtcatgaccagcaagtgcggtgccgtggagcctttggcattcaacgattcgcgctgttccacgccgaaacggtgctgttcgtcgatgaccgccagcgcgaggttgggcgcttggaaggttttggagaacgcggcgtgcgtggccaccacgatgcatggtttgccggaggccgcttgcgcgaggacgcgtcggcgggcggcgagtttcatgccgccggtgagcagcagtacgggaatgtccggcaggctgttcgattggccgtccagcagtttctccacctggccgccatccgattgtccaccgttttgcggttccggcgcgtttcccgacgtgacttgtccactttcatccacaaccgcatggtgcgttgattttgtctgcgattcccctgatttcgcggtttcggcagcctcttcgccggtaccacacatccgatccaccatgccgcggatgctgctgtaatgttgttccgccaacacttgcgtcggcgcgacgagcaccgcttgtttgccggagccgacggcctgcatcatagccgccaccgcgaccacggttttgccggagccgacctcgccctgcagcaggcgttgcatggggtaatcacgtgccatatcgtcggaaatatcggcgatcacctgctgttgcccgtccgtcagcgagaacggcagcgactcgacgaaatcgtctttcagccgcgtgtcggcgcaggctgtggccgtggccttacgcgacgaatcgcgagactgcaccagcgcggtttggcagatgagcgcttcctcgtagcgcagtgtacgcaacgccttgttgaaaccgtcgcggttttgcggatcgtgaatcgccatgaacgcttcggctcggtgcatcagcccatgttccatacgaaacgcttccggcatgatgtcgggaatggcggcggcaagcgcttccgtccgtgcctgccggtcggcttgcggcgcgtcgaattccccatgttgcgcgtcgctggcatcggcgccatgcaatgcacgggctgcctgtgccgcagcgtattcgtcaccgcacagccggtccatgcatttttcgatcgactcgtggatgtgttcgctggagatgcgcgagttcgcgtggtagacgggacgtgggcggcatacgtggcgcatcgcctccggtacggaagccgcatcgtatttgagattcggcatggtcggcgattgcgggactgccgccggttgttccgtgccgaagccgtcatcccattcggcggcttcctcagatgagcggctgcgcaattgctcgccggctggatcgaccgtcagtatgtcgggatgggtgaattgcagacggtcgttgtatacgcttggctcgcccgcgaccaccagcaacgcgccttcgtgcagtttgcgctggatccaatcgacgtacgacttgcgataggagaagaacacgagagacgccatggaagcgtccatgtgccggctgcgtgcgaaatcgccgtcatcaacgtcggcgatcagccggaatccgcgacgggccatcggaaagacgcgcacgccacgcacgtgcgcggcgaaggccatgttctcccctattttcgcttcgcgcagggcgcgtgccggaaccgggtcggtgacgcggaacggatagtaggtcagcgcgtcgcccacggacaccacgcccagcgatttcagcgcgccgactctgcggcggttcgtttcgaacgaggaaatcggggtttgccatgtggtgctcataacactccattgtgtcacgaccggatgattgtgcggcgggctgaattccccattattcgtggcggcgccattcgccgcaacacggcttgtggacggtcagataaagcaaaaccccggcggccattcggcttaccggggtttcaagctgttatttcgcgattcacgcttcaacgcgctggaccttgccagccttgatgcacttcacgcaaacgcgaacgcgaacgttctcgccgtcgatggtggtgcgaaccggctgcaggttcgggcggaaggtgcgcttattgcgaatatgtgagtgcgaaacggtgaaaccggtctgcggtcccttgccgcacactgcgcaacgagctgccataatggactccctataattactattgacttgcaagtctgcgcgttcgacaccacacaacgaagtgcatggcagaacacacaacttctcaactatacaaccagccccggccaatcgcaaacttgtggacgaaaatcggcttgcattccccatattccgccgtttttgccatgtctcgacagcacgcgtatgcggcccgtacgggcagaacatgcttgttcatgcgctgttcatgtcgaatggtctgttaccacccgccacgcccgtacgatgaagtaatggaataagatgagccataagattgacatttagccgaaaagagtcaacattgaccgacacagccgagccgcagacccaaccgtcccagcagaacgcgcaggcccagcagccgcagcaatccagccagcaatccaagcatatgatgacgccacgcgagaagaagtggatcgtctacgacgtcggcaattccgcgttcgtgctgctgtccaccgccgtcgtgccgatctacgcgaattcgctgctcaaggcggccggcgagacgaacatcgtgtcgacgtggggctacgcgcagaccatcgcatcgctcgtcatcgccgtgcttatgccgctgctcggctccatcgccgacgtgcagggcatgaagatccgcttcttcaccggcttcttcctgacgggcgtggtcatgtgctgcgcgatggcgatgccgcttggttggctcgcgttcctcatcgtgtacgtgctggccaccatcggccttaatggttcgcttacgttctacgactccatgctggtggacacgacttcgagcgaacggatggaccgcatttcctcacacggctacgcatggggctatatcggttcgaccgtgccgttcatcgtctgcatcgcgctgattttcggaggccccgcgctgttcggctggtcgaccacagcctgcacgcgcgcctcgttcgtcatcaccgcgctgtggtgggtggcgttcaccattccgctgctcaccagctataagcaggtacattaccgcgccaccgcggggcaggcaggcgaggccatccgcggcacgttcgccgagctcggctccacgttccgcgccatccgcaagaacaagccgctgtggatgttcatgatcgcgttcttcttctacatcgacgccgtcaacaccgtcatttccatgagcacgtcgtatggcacgcagctgggcatcgactccacgcagctggtcgtggcgctgctcgtcacgcagttcgtggcgttcccctgctccatcatctacggcaagctggccggccggttcggctcgaaaaccatgatcaccgcggccgtggtggcgtacatgtgcatcgtcttcttcgccgcgttcttcctgcgcgccgcacttgaattctggattctggcgattctggtcggcatgttccagggtggtatccaggcgctgtcccgttcgtattacggcaagatcattccgaaggaccatgccaacgagtactacggcttctacgatattttcggcaagacggcgtcgattatcggcacgttcctcgtcgctaccacgacgtcgctgactggcaacgcgtcgatcggcgtgctgtcgatagccattctgctggccgtcgcgctcgtcttcctgcttctgcagaaggatccgaccaagggttcgacggaagccgcaaccgtcgactgacagctgccgtccgacagcgttccgctcgacagcaatcgctcgatagcattccgcctgacaatcgtcgttcggcggaatgcgctgtgccggcctgcgggaaaccgcgtaggccggcacaacttcgacagttaccatctggtatgttatactggcatcgtttgcacaccgtggcgcaacgtagcgccgctccagcaatgacgcagagagaggtaaacgatgtcattggcaaatgaactagtcgaagcagtgtccgcatggccggaagtcgaggccatcacgttgggtgggtcacgcgccaccggcgataacgatgaaaaatccgattacgacgtctacgtgtacgtcaccgcacccgtatcagccgaacgccgccgcaggctgctgcgcaactattgcagccatatggaaatcgacaacgatttttgggagaccgaagacgactgcacgctgaacgacggcaccaatatcgacgtgctgtaccgcgatctggaccagttcgcagccaatgtcgccgacgtggtggaacggttccaggccagcaacggctatacgacgtgcatgtggcacaacatgctcaccagcaaggtgctgttcgaccgcgacggccagtacgccgcgacccgacagcggttcgacgtgccgttccccgaggaactgcgccgcaacatcatcaatcgcaacatgcgcctgcttaccggcaacctgccgtcgtacgacgcacagatccgcaaggccgcgagccgaggcgacaaaatcgcggtcaaccatcgcatggccgcgttcatggaatcgtatttcgatgtgctgttcgcgctgaaccgccgcacacaccccggcgagaagcgtctcgacaagctcgccgaacgcgactgcgccattctgccgaaggatttccgcaaaaacatcgatacgctgttcgattcgatgtacgccgatcaggcggtgttcagcgagactttgggcgaaatcgttgacgacctgcgtcagacggtcgacgcgaacctgtgatttgaccgcgaatccggcggttcgacgccggtagcgattggttttagaagaagttgagcgcgcgggccacttcgtcgacgatgtcgaacatggccttgcgcgcacgttccggatcgcccttcgctatcgcgtcggcgaccgcatcgtgcgcgtcgagcgcggccggcttcggcttcatcgggtatttgccgagttccacacggccgcgcagcacggtggcgatggtgtcggcaagcgcggcgaacagctcgttgccgctttcacgcagtatcaaagtatggaattccacgtccagatcgtggaatttggtcaggccagcagccccctcttcgtttgattcggcgatttggcgcatctgcgccgcgtagacggggaatttcgccttgacgtcgatggaggcgaggcgtgccgccgaggccgccgcagccggttcgaccgccaatcgcaattcggtcaatgacgacagctgccgctcgcgctgcgtggagtggagtcgccattcgatgacctgatggttgagcgcctgccagtcggagaacggccgcgccaccaatccgacgcgtcggcgcaccgtcaccgcacccatggattccaacgttttggcgacttcgcgcgccacggtacgggagatgccgaaacggttctgcacgtcttccaacgtcaagctttcaccggccggccatttgccgtccagcatttcgatggccagcgtgcggcacactgcatcctgcagcagttcgccgccgtttttgtttcctgccatccacaattcctctcgttgtgcgtgcaaatcttttttcaggtttttgcgacacgccgtatacgattgccgttcgcgtgacgtccgaataattacccccgcacgattcgcgcgatttgccgccgatttgtactacctacagcatagcaagtcgcatgattatttttattcgtagtacttttaacttgactagtactacctttcatagctatattgatgtcatcgccgatgcgaagtggcactggcaatacagcagagttcaaggaggacaacatgagcattcacgtagtggtgatgggtgttgcaggatgcggcaaatccaccgtggcagaagccattcacgaacgtctcggatacgtgtacgcggagggcgacgacttccatccgcaggccaacatcgacaagatgagcgcaggcattccgctgacagacgaggaccgttggccgtggctcaaggtcatcaacacctggatggtggctcgcgaggcgctggacgagaacaccgtggtctccagctccgccctgaagcgcagctaccgtgaggtgctcgcccagaacgttcccaccttcttcgtgcatctgaccggctcgcaggaactcatccagcagcgtctcaacgagcgcaagggccacttcatgccgccggcactgctgccgagccagttcgccattcttgagccgctccagccagacgagaacggcgtggaggtctccatcgaaggcagcgtcgaggaaatggtcgaacgtgccgtcgccgcagtgaacgagtacgcggcgaaggtggccgcgcaatcgcagcaagccgagtgaacggcgcaagccgcaacacagcgcaaaataatcgcacataactaaaaatcgaaagagaaattcaacgagtcaaggaggattcatgaatctcatcgcagcggcgatcatcggcatcgccgtcatcgttcttctcatcgcggcatgcaaggtgcatccgttcctgtccctgctcgccggctcattcgtcatggccgtgtgcgcgggcgtgccgttcgacaaggcgttcgatagcttcacttccggcgtcggcggcacgatttccaacgtgggcctgcttatcgcgttcggctcgatcatcggcaccatcctgttcaagtcgggcggtgcggacaccatcgtcgacaccatcatggccaagacaccgttgcagcgtctgccgtgggccatggcactgatcgcgttcatcgtgggcatcccgatgttcttcgaggtcggcgtggtcatcctcatcccggtggtgctgttcgccgcccgtcgttccaagtcccctgtggtgctgctcggcatcccggccctcgccggcctgtccacgctgcacgccttcgtgccgccgcaccccggtccgctgaccgccatcggcgcgctgaacgcgaacctcggcatcaccctggccctcggcctgatcgtggccatcccgaccgtcatcatctccggcccgctgttcggcaggctcgccgccaagtgggttccgatcgcagctccggagaacgaggctgaggccgaagctccgaagtccgcggagaatcgcccgtccttcggcaccgccctgtccgtgatcctgctgccggtcgtgctgatgctcgccgcgtccatcgtggatctgaccggtcagaacaccaccgcctggggccgtgtgatcgcgttcctcggcaccccgctcgtggcactgctcatcaccaccgtcttcgccatggtcgcccttggctacatgcagaagttctcccgcgacgccgtcaacggcatggtcggacagtccttcggctccgtggccggcatcatcctgatcgtcgccgcaggcggcggcttcaagcagacgctggtcgactccggcatcggcgacgtgatcgccaactccatcaccgaatccgccatgaacccgctgatcgcaggctggctggtggccgtgctcatccgtctcgccaccggttcggcaaccgtggcgaccgtcaccgcctccggcatcatggtgccgctcgccgccggcatgagcccgacccatctggcactgctggtgctggccatcggcgcaggctccgtgttcttctcccacctcaacgacgccggcttctggctggtcaaggaatacttcggcatgagcgtgggccagacgctgaagacctggtcgctgatggaaaccattctgtcggtggtcggcctgggctgcgtgatgctgctctcgctggtgctttgacgcactgaacgcagcaatcgcaaccacactcacataacccaaaacataaccaaaacttgccgcccgcaaagcttgccgcaaccttcttttctgcgttgcggaaggcgcgggaagccaacgggcggcatcaatccttattcaaaatcgcaaaaacttttcaaccatttttagagaaagaagcacatcatgcagttgggaatgatcggcctgggacgtatgggcggcaacatggcgaagcgcatcgcggcggcggggcatgaggtggtcggctacgaccgctcccccgagtcggaccgcaccgtggcaagcctgaaggaactggtggccgcgctgaaggccccgcgtctggtgtgggtcatggtgccggccggtgaagcgaccgacagcaccatcaacgagcttgccgagcttcttcagccgggcgatatgatcatcgacggcggcaactcccgttacaccgacgacgcacgccacgcggccgaactggagccgaagggcatccatttcatggattgcggcgtctccggcggcgtgtggggcatcgaccgcggctacgcgcttatggttggcggcagccagggggacttcgagagcgcgcgcccgattttcgaggcacttaagccggaaggcgattccggactggtgctggccggcccggtgggcggcggccacttcgccaagatggtgcacaacggcatcgaatacggcatgatgcaggccttcggcgaaggcttcgccaccatggtgaagtccgatctcgttgaggatccggcggccgtgatgagctcctggagggacggttccgtggtgcagtcctggctgctcgacctgctggccatcgccttcaagtccgacccgacgctcaagtccatgccaccggtcgccaacgagtccggcgaggcgaagtggatgatcgaggcggctctcgaactcggcgtgccgaccccggccaccgcggccgcactgtacgcacgtcagacctcgcgcggcggcgccgacgacattctgcgcgtcgtgtccaccatgcgcgcccagttcggcggccacgtcaccaagatcgacgagatcgccacccactgacggattcacgcattaaccgattcagattccttccttccccataacagacttcgcccggagctggaccccaccagctccgggcgaacctgtatatcaacgcacacggtcccgtcagacagtcggcttgccgccccacaatcctgcactatctcgcttatagatggcggattttccaaatcgccccacggtatctcgcttatagatggcggggtcctacagcaaaaagccggttagggggcaatatccataccctccaaccggcttttcccccgcatcatccgccatccataagcgagatggcatcaggcacgagagcgaatccgccatctataagcggaatataggcgaaatacgcgagcggctcagcggccgtacacctcgtgcacgaatttctcaagcgccgcgatggaacgctccaccttctccgtgtcgatgcagtaggccatgcggaagtagccgggcacgccgaagctgtcggacggcacgagaatcaggtcgtaatccttggccttcatgcagaacgcgttcgcgtcctcctccagcgccttcgggaagatgtagaacgtgccgccggggcgcaccacgtcgaaacccagacgggtcagcgcgtcgtacagcaggttcatgttggtctcgtacacggacaggtcgctcgtctcgtccaccaccttggacacagccagctgcgcggtggaagacgggcaattgtggccggttccgcggctgatctgtccgcacatcggcacgatcagctcggcgtcggtggcacgcggattcacggccacgtagccgatgcgctcgcccggcagcgacagggacttcgaatacgaatagcaggacagcgtgttgtcgtagaacttgctcggatacggctgctcgccgccgtcgaacacgatctcgcggtacggctcgtcggcgatcaggaagatgtcgtggccgtattcagtctgcttggcgttgagcacctcggccaggcgggtcagcgtttcagcggaatagaccgcgccggacggattgttcggggtgttgatgagcaccgccgcggttccggggttgagcgccttctcgaacgcgtcgaagttgatctggaagttatcggtgtcggccggaacgacggtcaggtgcgcgccggtgccgttcacatacggctggtattccgggaagtacggggcgaaggtgatcacttcgtcgcccggcttggtcaccacgcgcagcgcatgcgccaacgcgccggccgcgcccgtggtcgggaagatgtagtcggcggtgtagtccatgtcgaagcggcggttgagactttcggcgatcgccttgcgcaccgacggaatgcccaaggacggagaatagccgtgcaacgccaccggttcggccgttttatacatgtcgatcacggcgtcggtatagtcctgcgggcacggcacgctcgggttacccagcgaatagtcgaacacgttctcgtagccgatttcggcgccacgcgcggtcgcgtattcgctcagctcgcggattacggattttccgccgagcatggccttgtaggcttcgttgatcatggaacaacctccctgtcgtgctgttgcatacgtctgacgcaccctgaaagagcgccgctacagacgtttctaccaccgaaaagtcacgacatgcggcgcatcgttcactgttcggctttctgttcggcttcgctctgcacgccctgccccgccacgaaaccgctgctgaagatgcgcttccaataacccagcatgtcggttttggacatggacatgaatatgcccgtggccagcaccgccacatcctcgttgaacacggcgtccatcggcagctgctcatggagcttcggccagcggcgcagcaccgccaacatgcctccgacggtgaagtcgagcatcaggtcagttttgaggtcaagatggtcggcgtcaagccccagcacggagatcaacgtgagcctgccgaagtcctgcagggattcaacgagttccggcgagctgtgcggcccggcaagcagcgcgagccggtcaagacgctgacgctgctcggactcgcgtagcagcgcggtgacatgcttgcgccattcgttgtcgggattgaaattcgcgttgggcgcgctgggaagcggcgtgttttccacggcgtgcagaatggcggaatcggcaagttccggcagtcccgtgaaatgatagtagaaggaattgcgattcacgtccgccgtgcgcacgatgtcggtgacggtgattttgcgatactcgcgttcggaaagcagttcccagaatgcgttttcgagccgttctttggctggcagaatctccgaatcccggcgtggacgtggcatggctccccctattttgtaccttcgatttaaaagcgcaacgcgaattactatacaagttgtctagaacaaactgcacagcatgtcgcattaatagcgattgccatccaccgcaacgcctcacctcacaccactgcgtcacgacctccgcgctacgtctacttgcgccgcactttcggattgcgggcaagagcggcctgcaacataatcgccagcgcctggttgagattgcgtcgatcctcaccgctcaacccaacgtacgtgccaagcatttcgggaatgactttcggcccggccgccatcatggcggaaatactgcccgcaccggacgcttcgagcacggcaaacaacgcgtccaccgcacgctcgcgctgctccttggacaggttggcaagccacttgttcagcgctttgttgaaggtcaccgaactgctggccacatcctcgactttgtcgaattcaccgccgtgcatctgccaggagaacacgaaatgctgcattattccttccacgtcggatttcaccacgatgcagcgttcgggagttcccagcaccatgcccactaccgatgagtccggcacgattttgacgattcgatcgctcacgctcgcatattcgaagctattcaccaccgcctcagggaagcccggcccatccaacgaatagatgcgttcgatgcggtccttcaccccgtcctcagcgttcatcgccgcataaacggccagattgccgcctttggaatggccggtgagcacgatcggaacatccttccacaactcggccaccctggcgagatagtcggcggcggtcacctgcgccggcaccgggtattggaaggccatgttgaagtcctccttccaacccacgagcgaatcgtcggtaccgcggaacgccacaaccagcatgccggacggcaggcgataggtcacggcggcgaactgcgtctgctcatcgccgtcgaactgctcgagaaacgcccccatttcaatgtcggaaaaacgcggattcgcggcgatggcatggtagaaatcgtgcgtcacctgcggatcaaccaagcccacgttctcgacattatggtcgggcaccgcgcttccatggtgcagctcgtcgtcggcgcgcgcgatcgtcacaccgtcgaatggaggtttccgcagcatccgcacggagcgtatgggatggcgcgggtcgaattgcttcacacggtcatgcaacgtgccgtatcgcgattcgatgtcgtcaagccgcggcacgcattccggcacgtcgtcgtacgaaagctgcgcgagcacgagcgcgtcggcctcacggaagggaagctcgccgaaatcgcgcgtctccgtacgcgcgtaatcgatgatgttgcccattgcacacccctttcgcagccgtcgacattccgcattccattatgcttccacaattatgcgtccgcaccgcaccatcctacgtcagcgaacggagatgcatccggatcatcagcgccccgatgccctccattgcccttcttatgtgtcacttgcgcggcactcgtgtgtcacttgtgcggcacttatgtgtcacaattccatttttcacgccttttcgaggatcgtgacacatgaatcggccgaaatgcggctcggcaaccatcccgaccagccgttgcatccgcccatagccccgcctcggcacgcgcttcagcccgcctcggcactcaacccgcttcagccctcgcgcaccgccttcgccgcgctgaccggaatcgccttgatcaccgccctgatgagtccgcgcgtctcccgatcggtattgcgcgccgcctccacaatcttcggcagcgaatccgtccaatgctccaccaaatcggcgatattgccgtatcccgccgccgcgaagatcccgtagatctggtcgatggcgcgctcgcgctgctcctggcttacggtgtcaagccacccgtcgagggttcgtttgatgagctgcgcgccggccgtcagctcgtccacctgttcgaaatcgccattttccgccacttgccagctgtttcccatatgctgcatgatgccgatggcatccgctttgacgatgcgcactggcgcattcgattgcagcagcatgcccacgacggacgattcgggcacggttttgcggatacgcgattcgattgcacggtacgcctgaccgcgcaccgtcgatttcggaaggcccggcccgtcatgggaaaagatgcgggagatccgtctgttgcgaccccgcactggcccacccaatgagggcagcaatccgagccgccgcgcgcgctcgccagccacttcgatgtcatcgtgcgcgatacgcatggccgcatacacggccatattgccgcctttcgaatgcccgccgagcatgaccgcgggcgaatcgcccgacgaaaggaaaccttccgacctgtccagaatcgagttcacataccgatacgcggattcctgggacggcaccgggcaacgcaccgccatattgaaatcctccttccatccgacaagcgtgccatcggtgccacggaaggctacatacagcgaatcgacgggtccgcaacccacgtcgaacgtcatcgcggcgaactgctgctgttcgcgctcgctcagacgctccgcgtactcgccgacacgcaacgcgcggaaacgcggcgattcgcagacggcacgcagcaacgcgagccgatactcgttcatatcggaggaattcgaaacgaacatgtcgtcatagctttccgcacgcagcagctctcgaatcggcaccgtcgccaccgacctcgcctcgccgaacgccggaaccaagccggaaagccgcatatatgagagctcagccagcaccagcgaatcaacatcgccgaacggcagctccgcgaatccatgaaactcgcgccgcacataatccacgacattgcccatgtcgcaccccttttcgctggccaacgcatcctacggaatccattatgctccgctgcggccagccggcggatcaggaatcatccagtcaatcgcaagcgttgtgcaacgtcccctgtgtagactaggcagccatggatccagttgaaattctcatgcactggcttgccaaaaactacagcaagctcatcctgctcgccgtcgtgctcatcgtcgccgcgcttatcgacaaggcgctcaccaaggtggtgcgccgcatgctcgacaaatcgcaggtgccgaacgcatccatcttcgtcaacatcctgcgcgtggtggtgtgggtgttcgccatcggcacgctgctgcaaccggtgttcggcatcaatccgaccaccctgttcacggcgcttggcatcggcggtcttgcggtttcgctgggtttgaaggatacgatcgccaatgtgatcggcggcttcgggcttatgcttggccgcgtcatccagccgggcgattacgtcaaggtggccggcatcaccggcaccgtcaaggacatcaattggcgtcagaccatcgtgcgcgagcgcaacggcaacgagatggtcattccgaattccattctgaacaccgcctcgctggagaagcttgacccgtcgaacgagtgcctggtgtcggtgccgttcaccgcgaaggcgggcgtggatgtggagcgtatgaaggccgacatcgtcagcaccgtggaacatgcgaccgtggggcttgccaacccgcaatacaagccggtggtgaagctcaacggcttcaccccgtacggcatcgacggcacgatctacgcgttcgcgaaaaacgacctgctgctgtccacgatggcggatgcggtggcgcagtcgatcgcgcatgccgattatcttgagcaccgcgcggtcggcagcggcgaatagcggcagcggcgtgcgcaacgcaacgcacgcaacacaagctatgcaggcaacagaaaggccgaccgggaacgtatccccggccggccttcataatccgcgcgactgcggctataggaacagactgatcgccgtcagcagcaccgtgagcacgatgaacgtgatcatgccgacgttgccgtacacggttctggcgccggtcccacgcggcagctcctccggcgcgatgtagaattcggctttcctgaagttacggatcagcagcacgaatccggcgagaatcacggcaccgtacagcaggaaatagacgagcatgatcgccagcccggtggcgttctgcgacgcccactgttccatcgccgccacattgccgttttccgcggcctgagacaccttgtccagctggtccaggtcgacgcgcgtcagaatccacggcgcgagcacgccgccgttgaagttgatgatcatgtgcatggccgtcgaatagcgcagtttgctggtgcgcatgtagatgtagccgaacatgactcccagcaggaacgcatagaagaactggaacaggttcatgtggaacagtccgaacgcaaggccggacagcagaatcgccgttttctctccgtatttgcgagtgtggtcgatgagctgcttgcggaacatccattcttcgaaaatcgggccaagaatcaccaagaacacgacattccagatgttcgtctgcatggcaagatcggctacgcggttcgtggcttcaccgtcggaaagcgccagcgacagcatactgccgaccatgctgccgacccacatcatcggcaggcacatgagcagcagcttgaagaacatgcccggtttcatgttgaatttgcgggtttcgatgacggtcgatttgcccatgagcgccaccgcgaccggcatggcgatcagatacagcggcacgtcggaaatgaggaacgtcatccaattcggcatatcgccgccggcgcctacaccgcccgcgaccgcgcgcaccacgcctttgagcaggaagacgcccgcgtaccagatgatcaccatcaggcacaggcttgcgccgatgcgcgaaaagtcgcgtcgcgcctgcttcaaccattcgaagaatggattgcgattggcgatcggcggctgcggatattgaggcatgggctgcatcggatactgcgattgcggaccattcggctgatattgcggagccggcccctgcggttgtccttgcggttgctgcggatattgaggctgctgcggaaacgtcatagtcaccttacgaaacttcggaaaacaaaaaagctgatattcagcactgtactaccagtccgctgaatatcagcttgagatctcaccgtaggtgggtgtcgatcagcgcagcacgccttcgatgagcatggtgatcaggtcggtgtagcgcacgccggtggcctcccatgccttggggtacatggagatggacgtgaagcccggcatggtgttgatttcgttgaccatcaccttgccgtccttggtcacgaaggtgtccacgcggctcagaccggcaccgtccacggcgacgaacgccttcttggcggtttcgcgtacgaggttcagcgtctcttccggcaggttggcgggcacttccacgtggcttgcggcggcgtccatgtacttgctgtcgaagtcgtagaactggtcgtcgccttcggcgcgcttgtcgagcacgatttcgcccggccagctggcctgcggcgcttcgccggccttcgggcacaataccgcgcattcgatttcgcgcgcgtcgatgccctgttccacgaggatgcgccaatcgtggtgggacgcctcgtacacggcggccgcgagttcggctgcatcgccctcatgctccaccttggtcacgccgaagctggagccggcgcgggacggcttgacgaacagcggatactgcaagccggcttcgctaacctgcgccatgatcgcatcggcgtcggtcttgaattcggaagccttgtcgaaggaacgcgcgtcgagcgtgatgccgggcgcgacgggaatgccggcggccgcaagcagcaccttcgtgtaatgcttgtccatgcaggccgcggaggcgagcacgccgcaccccacgtacggcacgcccatcatttcgaacagaccctggatggtgccgtcctcgccgtacggcccgtgcagcacggggaacaccgcgtccacatggccgaacggggtcagcgtaccgtcatcctcgcgggcgaagaagccgtcctgtccgagagccacttcaagcaccacgtccttggcgcctggggttttctccacggtcggcaggccttcgtccaggctccatccgagcggattctcaccgttgacgatccacttgccgtccttggtgatgcccaccggaatggcttcgaacttgtccgtgtccagcgcgcgcagcgcactcgcagcggagatgcaggagatcgaatgctcgtcggccttgccgccgtacatcaccacaatgcgcttttttgccatatctatagcctttattccttaacttttatgacttttcaggatttttgccaagcatccagcatacaagccggctgctactcctcggtgatgccttcgccgaacagttcggacagcatctgcgcgcaggagatgccgtcgtccagcacgtggctcatggccgtggcgagcggggtcggcacaccgtactgcttgcccaacgccaccaccgcgtcggtggtcggcacgccttcggccacgccgttgctcaccttggtggcctcttccacgctcaggcccttgccaaggttggaaccgaacgtgtagttgcggctcagcggggaaccgcaggtggcgatgaggtcgcccacgccggcaagtccggcgaaggtcttcggatcggctccggccgcctcgcccagcgcggtcagttcggcaaggccacgggtttcgatcatggccgcggtgttctcgccgtagcctgcgccacgggccatgcccacggcgagcgccaccacattcttcagcgatccgcacatttccaagccgatcacgtcgcgcgtcacgaacgcacggaagtagtcggtggtgcaggcggtggcgattttgcgcgcgttgtcgatgtccgcgcagccaaccacggtcgcggccggctcgcggtcggcgatctgcctgctcaggttcggtccggaaatggcggcgaaacgttccgccggaaggtcgagcgtttccatgacgacttcgtccatgcgcttgccggtggtgcgttcgatgcccttcatcagggatgccacgagcgcggtttcggggatgagtcccttgaattcggccagtgcgacgcgtgcgaactgcgcggcgatggccacgatgacgatgtcggcgttggccacggcttcggcgcggtctccggtggcggtcatgttgctgggcagcgtttccacgctgggcaggcgcacaccgttgtggtgatggtcacgaataccttccacgatttccggttcgatggcccacatggtcacgttgttgcccgcgtcggcaagcacttgaccgaaggccgttccccaagcgccagcgcccagtaccgtcacattcgccatgaattttgctccttggattatttgggttgctttttgcggccgagcgtatgccacatcggccgccgctttcaatcgacgttgtcttatgctaccgccggctacgcacaccggccgcgtgttccggtcgcacgcgtattttgttcgccgccggaacgggtgtgtgtggggaaaatcagtctttcacgcgactcatggtgcggtagtcccagtagccgtcaggtgcctgttcgccgcggatttcggccatgatttcggtcatgcgcacgcggatgcggcgggtcagttcgtcggcgcggtcggtcggcacgtccttgccccaggaatcgcagccgtcaagcaggtccgcgtagtcgagcgcttcgtcgtagcacatcaccacgttcttgcgcggccacggccaccagtggttgatgctggccgcgccccaggtcacggcacagtacagcggcacctggtagccgagtcggcgtgaggattcgagggcgatcacacccacgccgtttttcatgctcatcggccatttttgcgggtcgcgcgtcacggtgccttccggccatacggtcagcgggcggccggaggtgaggatttccacggacgtttcctcgatggctttggccttgcccgcgcggcgctgcaccggctgcatgccgaccagctggaaccatttgccgatcagcggccatttggccatttccgccttggccatgtagcgcgggcggcggccctgatggaacagcgagaccatcggcacgaacacgtcgtacatggtcacgtgtgtggcggcggtgatgaacgggccggtttccggcacgtgttccaagccccaggccttcactttgctgtgattgcgcagcaccacgtcgcagccggtcagcaggcgatgcgtggctttggggttctgcgcttcgatttccgcggtgttggctttgcgcggaccggtcgggaaatcgtgggtcgggtctacaagatgatgcttccgcgcgagttttgcgacttgctcgtcgctcagcggcttcactgcggagcgcggcgacggttttcctttggatgccatggcttccattgtgccaccggccgccgatacgttcgacggcgccgctttccacgacattttgcttttactacctcataccatcgttttctgcatcatttggccgtcaaatgatgcagaaaagacgggcgatgaggcagtaaaaggaatatgcggaagatgtggaaggtatggaaagcaggtttgcgattgcggcagcggcaatcgcggataaaacaaaaccggcacccgcgcaaggcgagtgtcggtgaaaggtggtatgcgttcagcgcgactggtcaatcgcaataaatcagccgcagccgattcatcgaaccaatcgcagcgaatcagtcgaagtcggctccgagggcttccaacttgccgcggaagtcggcgtagccacggtcgatcagggagatgccctgcacgttggacgggcccttggctgcgagcgccgcaatcaggtggctgaagccgccgcgcagatccggcacgtcgatgtcacgtccggtcagcggggtcggtccgaagatgaccgcggaatgcttgtagttgcgctgttggaagcggcatggcagggaaccgaggcattcgcggtacagctgaatcgtggcgcccatctgcaccagcggcttggtgaaaccgaaacggttctcatacaccgtctcatgcacgatggaaaggccgttggcctgggtcagcgccacgacgagcggctgctgccagtcggtcatgaagcccgggtgcacgtcggtctcgatggctaccggcttcaggtctccgcccggatgccagaaacggatacccttgtcggtgatgtcgaattcgccgccgattttgcggaacacgttcaggaaagtcatcatttccggctgggtggcacctttgacgaagatgtcgccatgtgtggcgagcgcggcggacgcccaggaggcggcctcgatgcggtcggtcaacgacgtgtgcgtgtagcccttgagctccttgacgccttcgatacggaaagtacgatccacgtccacggagatgatggcacccatcttctgcagcacgctcaccaaatccatgatctcaggttcgatggcggcgccggaaagctcggtcttgccttcggcgagcacggcggcgagcagcgtctgctcggtggcgcccacggacgggtacggcaggtggatcttcgcgccatgcagaccgttcggagcggtgatgtgaatgccgtccttgtgttccttgtccacgttcgcgccgagcttgcgcagggtttccagatggaagtcaatcggacgaccgccgatgttgcagccgccgagcgccggaatgaacgcctcgcccagacggtgcagcagcgggccggagaacagaatcggaatgcgggacgagccggacagcgtgtccacgtcggccacgtcggcgagttgcacgttggtggcgtcgatcgtcaccacgccgttcgcgccgtccacggtcacgtccacgccgtgcaggcgcagcaggtcggacaccacgtgcacgtcgcggatttccggaacgttcttcagcacggatgtgcccggggccagcaatgcggcgaccatggccttgcttacgaagttcttcgcgccgcgcaccttgatggtgccgttcagcggcttgccgccttcgacgtgcagaatgtcgttcttattgtcagacacgctcaacctctttcgattcccttttggatcaagctcaaaaaaacactgctgcttagtttgccataaggcatgtagcatgttcgcgaaaaacggaattcagcgcagtgtctccttaatttcgcgcgcgagattcgcatcccacatggctccggtggcgctcatcacggcgttcgcgccagcctcacggtacgccttgtagtcgtcaggacggatcacgccgcccacgcccacgatggcgaagtcgaagccgagtttttcacggatggcggcgagcctgccgaccatgtcgagaccggcgccacgaatggcgttgccgcacacgccggaacggtcacgtccgactcccggcagcgcctggttgccgttcgcgtccaccaggcgcgcggaaatcgtgttgatggtggagaagccttgcacggtgccatgtccgacggtttccctgaccatggtttccaggtcggtgtcgttgggaatgtaggcgagtttcacgatgagcgggcgatcgccgatttcgtttttcacggcttccgtgatttcccccaccagatgcgggtcgtggcacagcaggcgattgtgaccttcgttggggcagctggtgttcatttccatcagtccggctccggtttccgtaaccagatgcgcggtggtgacatggtcggcgatgtacgccttgcggtccatgccgtccacgcgggagccttggaagctgggcacgagcagctgcccgtcgccggcggcggcgatcgccttcttcatgtccggctgccattcgtcggggtcacgcgacggcacgccgaaactgttggagatcgaaatcggaagctcatatcgggtgtcggcaagcacgccttcatccagttcggcgctgccgggaaccagcgacccgtctgcgttcttcggatgcacggcgagcacgttcgggaaggcgttgcaaccccacgcgcgggagcggaccgtcttgtacaccgccaaatcgaaacccatgcggaaggcggcggtggtgaaccgctcgttcagcagcggaccggcgggaatgccaaacggcaggttcacgcggaagccgaggaattcctcggcctggtcggacgactgcgactgggtggtctgtgcagactgcgcggaggcgccggcagcggaatcgcccttcatcacttcggcgaacgcaccgaacggcccctgcagatagttgtcttcatacgtgcgattgacgtcgtaaaacggcgcgaaaccctggctcatactgctccccgaaattgttctcgtgtcatgttttggatatgcgatgcgaacacatgaaatgtcatgtccactgtaacgcgacacacgtcccgcctgcacgccccgtctcaccttggaaacctccttggctaggacttccccagacgagtttgggctctcgatccaggtcaagtccagagaaccggaacgccgtcatgagccggtatgctcggcaagacggtacttgcgtccgcgtccgacgcctattggttcaataacaccgtctttcaccagtgaggccaatatctcccgggtacgggtgaggccaagccccagcaccacagccagatacgaggtgggttgcggtccgccgaccgtcaacgcataggtgattttctccaactggctttgcggcctgatcgcattgccgaaatcggcaggtagggccacgttcttgccgaatgtgccgaccatgtcgttcaaacggtcagccccgcgagcgccaatcctatggaccgtaccagtgccatactccgaattccgcattgtcggcgactccgcaccaacagggcccccgccatctgcagagactccgggaacagcagaagctccggcgatcatggaatctccggcgatcttgcgcggatacaacgtaagctgcacacgccacggatcgtcgagcacttccaattccggcgcggcggttcctgcgaacaggcagccttcacgcatcacgtcaaaaccactgcccgccttttctccgatgccaatcagattgaacattttcatcaacgtgggattccgcgtatccgaaatgccgccttgcatcacctcttcggaggaaagacgcaggctgccgggattcgacaatacgattctgtcgtaatactggatgatcaccgtgccccggcgaatgaagtaatcggcatgaacgagcgtgttggtgacagcttcacgaacggccttatccatcggattgtcatcaatcctatgcaaatcggcatcaagctggaacggatgggcaacagccgaccgcagacgattgaccaccttgccccaaaaatcgtacaagttgcccgaccacgtgtcatcgtccgaagtgaatcggtcgttccaccgctcctggtcgtccatgacctcgcgatagtccaggaaatagtaggggaattcggacgtgattcgccacgcctcaccgaacatcagcaatccggctcgtgtgggacgcacctgagaaccatcaagccgcaacgcttcgatgcgaagcaggaaatcctcatcagacaatccgacccatggatggccgggccgtccgttcttgaactgccgacgatatgatgcgacgctatccgcgttgagcgcgtcagcacccatgccttcaacaatcgttctgtccaagggaagcaggtcactgtcccgaagcatggcacgaaccgtttcctcatcgcacagataatcgccatcgccattacgccggtatgagcccgtcatcggattctggcccacgtacacgggaatacagtccctcgccgcacgaggaatgtcgatggaaataacatctccctgcgaggtatggcgaatcaccacgtcgttgtcgctcagcacaacggcactgaccttcgatggatcatgcaccatgttccaaaaatcctgcgccatgttccgcgcatcatctactccggtgatatacaaagaatgatcttcatgctcggacacgcccagcagaatcagcccaccttcggtattggcgaaggagctgtacgtctcccataaactgtggggcaggccgcccttggcacgtttcgcttccaaacggttgccttcacgcatccgaggaacctcccgggaccaccaggcatcatcgtgctcgctaccgtccattggccatcaccgccttacctaccacgcgttttacgctcgttttgccgccgctttgccgtcgtattatgattttaccaccgctttgcgcgcgctttgccaccgctttgtggaatttgctgttggcggaaaggtgatggaaggtaaacaaaaagcccggcttgggtgccgggcttgggaaaagttagatgtggttgcggtcagccaatgatgaaatgggctaccgtcgcgatcagccaacgggcctatctgcaattacggactgcgctgcgcgcaggctcattgctgccctcgtttcggactcgggcaaggccctgtcggcagtgcactgcactgccgaccagccatcgcgtcagatgatgccgcgatcggccaacgggccttgccaatcagggtattcaccctcacgggcggattcgatcggctgttccggctcgcgcttgaccggcagggtcttcggcttgaacgggaacttttcggcgcgcatcttctcgtatgcgatgatgtcgtcttcgtgctgcagcgtcaggtcgatgtcgtcgtagccgttcatcagacgccagcgggtgtagtcgttcacttcgaacggcaacgtcacatcgccgcaggtgacggtacggtcttccaggctgacggtcatttcgcggcccggctcctcgtccagcagcttccacagcagctcaatggattcctgcggcataattgcggccagcacgccgttcttggcggtgttgccgtagaaaatgtcggcgaaacgggaggaaatcaccacgcggaaaccgtaatcgtgcagcgcccacacggcgtgctcgcgggaggaaccaatgccgaaatccgggccggccacaaggatcttgccctgcttgtattccggcttgttcagcacgaattccgggtcgcggcgccacgcgtagaacagggcgtcgtcgaagccgcttttcttcacgcgcttcaggaacacggccgggatgatctggtcggtatcaacgttggaacggcgaagcggcacggccacgccggtaagggtagtcagtttttccatgtcaacaaatccttcgattgcctatcgatattcgatttcgatatttcgattacttacgattgcgttcgcagcttccgctcgcagcaggctcacaggtcggccggcgagcagatggtgccgcggatggcggtcgcggcggcaacggccggcgacgccagatgcgtgcgcgaacccttgccctgacggccttcgaagttgcggttcgaggtggagatggaacgttcgcgggctaccatcttgtccgggttcatgcccaggcacatggagcagccggcgttacgccattcggcgccgaagtccttgaagatcttgtcgaggccttccttttccgcctgcagacgcacgcgggaggatgccggcaccacgagcacacggtggatgttgtcggccttgtggtggcccttcatgatggaggcggccacgcgcaggtcctcaagacggccgttggtgcaggagccgatgaacacggtgtccacggcgatgtccttgatgcgcatgcccggcttcagtcccatgtaggcgatggcacgctcggcggcggaacgctcggtctcgtcgttgaaggaggccggatccggcaccacgccggagatcttcacgccctggcccgggttggtgccccacgtgacgtacggctcgaggtcttcggcgttgatggtcacttccttgtcgaacacggcatcgtcatcggtcttcagcgtcttccaatattcgacggccttgtcccacatctcaccttccggcgcgtgcggacggcccttcaggtattcgaaagtcacctcgtccggggcgatcatgcctgcgcgggcgccggcttcgatggacatgttgcagatggtcatgcgggcatccatcgacagcttcttgatggcttcgccacggtattcgatgacgtggccctggccgccgccggtgccgatcttcgcgatgatggccagaataatatccttggcggtgacgcccttcggcagctcaccctcgatgttcacggccatggtcttgaacggcttcaggctcagggtctgcgtggccatgacgtgctccacttcggaggtgccgatgccgatggccatagcgccgaacgcgccgtgggtggaggtgtgcgagtcgccgcacacgatggtcatgcccggctgggtcagacccagcaccggagcgaacgcgtggaccacgccctggtcagcgtcgccgagcgggcacagacgcacgccgaaatccttgcagttcttttccagcgtgctcagctggagcgccgaagtctcgtccggattcggacggtcgatgtcgacggtcggcgtgttgtggtcttccgtggcaatcagctggtcgacgtgacgcggcttgcgtcccgccagacgcagaccttcgaacgcctgcgggctggtcacttcgtgcatgagcatcaggtcgatgtacagcaggtcgggagccccatcgctacccttgcgtaccaaatgatcggcccagaccttctcggccaatgtagttcccattgtgggacctcctcagatttttcctcactaatttcctcgcggctattgccttgccgcattcttcgtgctataagcctatgggcttgaaacgggttcgaggtccttcatgccggtatatgagatatgaacgagggacgagcgcggcaaacgcggaaaagttacttcccgtcttcttacggcatatgcgcaatcgttgaaatttcagcattttcccggcttcaccagccggtggaagcaaggtaaataatctgctttaccccagtcgcgaaccacatacattttgcatttcaatatgtgagatggcataattcagcgtatgacttcttcttcgaatacgagcaacgccatgcccaaaacgcaggccatgaacgccacgaacgaggcaaacggcaattacgcagccaccccgcaaagcaacgaaattcattccggggtcggcgtgctcgacaagacagtcaagattctcgacgctcttgaatccggcccagccacactcggacagctggtttccgcgaccggtctggctcgtccgaccgcgcatcgtcttgcgatcgcgctggaacgtcaccgtttcgttttgcgcgaccagcacggtcgtttcgtgctcggatcgcgattcgcggaacttgcggccgcagccggcgaggaccgcctgttgaccgccgccgcgccgattctgcagaccctgctcgaccgcaccggcgaatccgcgcagatctaccgccgtcagggcgatcagcgcgtctgcatcgcagccgtggagcgcgcgtccggcctgcgagattccattccggttggtgcgatgctgtccatggaagccggttccgcagcccagattctgctggcttgggaggattccgaacgcctgcatcagggtcttcgccacgccaagttcactgcggccaagctcaccgccgtccgcaagcgcggctgggccgagtcgatcaatgaacgcgatgagggcgtgtgttcgatttccgcgccgattcgcaacgcgtccggccaggtgatcgccgccatttcgatttccggcccgaatggccgtatgggcgccaaccccggccgccgttacgcgccgctggtcatggccgccggcaagtatctgaccgacgcgctgatcaaggcgtcttccggccgctgacaggtccgcgaccagtcgcatacgtaacgtaaaagctgacgatggaaagttcccatcgtcagcttttttgtattcatttcaaagctaaaagtcgggaaaaggaatagtcaccgccggaaaggctaccggcggaacgactagtcaacaaacagctaccggcgaaacagcgagaccagcttgttccacgtcttgctccaccacgtcggcctgtggagcaggtccatgccttccgaatcgggcttcgattcgctggtcatgccgtaggcgtaggccttgcccgcgctgggtttgcccaccagctcgtcgtattccaacagctgcgtgcgcggctcgtacgggtggcggatgtcgaattcgaacagtcgagcggcacgcttggccggcaccgggccgtatgagccaaaaccgctggtcggcgaggcgaccatcatcatctgccggtcaccgtcggttccgaccggcacggaaccgacgaaggcgttgcggtggtcgtgcccggcggaaatcgcaaaatatcccgccttgtcaaggattgcgaattcgccgctgtcggcatccgggcagctgacgccctcccccagatagcttccgggttgcgttttgtcttcgttgagcacgaaatgccgccccgcgaagttgcggtatccttcaatcgcgcgcgcagcggtggccgcgaccggcttgagcaggcgataatactgttcgatcgggaaatgctggaacaccatgcatggcagcgtggacggcgtcttgcgcggttcgcgcggcgagtcctgttcatcttgccggtcttgttgcagctgctgcgattgcgtcgccatcagccccggcgcatccgccaggaagcgcagcgcggcttccgacgggctcccgtagccgccggaacgcgcgtaatcgcccgaatccagcaagaccaagcccaacacgtcatacgtgcgatcgacgtccgtcaccgacaacgcgaatgtgccgggcgcgcacgcgatcacgggctgttccggcaatccgaagtcctgttccatatcgccaacatcatgtttcacaccatgtttcacggcgatgcccgtcgtgccgtcggcagcgcgttccggattgatacaccctgggaattcgcggcagatgctttcgatttcgtcattgtcgagcccgcactggaagtcatggttgccgaacgtcacagcccacggcacgccgcggtcggcaagcgggtggaccagttgttcgatggtggctcgcaccaattcgcgggtgtgttccaatgcggccgcatagcgttccccggacgcttcggacgatgcggatgccggacgcgcgtcccagcgacgcttgcgggaggtcagcgcgtatgcggaatcatatccggcgatctggttgccgttgaaaataacaagatcggggcgtgtggcgtcaagcgaggcctcgatgaggctgatggtgtctttgctgactttcggcccgtcttggatgtcggcgaattgcaatacgcggaatttgccggactggtggaattgcaggcggccaagccgtgcggatacggaaagcggtcgacggtccccctcttccgctggttggatgcgcgggcgcgtggctttggcggcatgctgcaattcggtcatacttctagggtaatgcaacattgggcgattacatgtgcgattcacgcagggcgtcagcagattgcgctgccacatcgcatccggcaaaatccatcaacccaccgcccaaagcgacgtgaacagacaggtgcgaaaaacaaaaaaccctcgcatctgcgagggctcattggctgggatgcctggactcgaaccaagaatggctgaaccagaatcagctgtgttgccaattacaccacatcccaatttggcaggcgtggcaacttcgaaaagttgtccgtcgtacccccgaccggatttgaaccggtgttggcgccgtgagagggcgtagtcctagaccgctagacgacgggggcttgagttatcgctgtgattctcagctaggctgtgaaccgcaacgagtgataaatatacgcgaaacagcacagtcgcgcaacttacggcgtgtcgcgctattttccgccattccgcaccagccttccgcataaacgaaaacccgccgaatcactccggcgggtttccatcattcagctaacagtcagcagctcaacggctcacaggtgctcgcgcaggcccttgagtcgagccatggcaacgtccttgccgacgatttccatggattcgaacagcggcggggacacgcggcggccgctcatggccacgcgcaccgggccgaaagccagacgcggcttgtagccgccgtcttcgaccagcgccttgttcagcgtctcgtgcaggaagtcggtcttccaatcaccctcagcaacggcgtccagcgccgcgatcgcagcgtcgagcacggccggagcggaatccttcagctgcttcttggcgtcggcgtccggctcgatgtagccttcggtggacagcagggagccgaccatgccggccacttcgcccagcaggcgcacgcgcggctgcacgagcggagcagcggcggtgaggacctcgcgctcacggtcggtcagcgcgtcccaggaatcggcggacaccacgccgtcacgcttgaggtacggcacggaacggttcaggaagtcctgcggttcgagcatgcggatgtgctcggcgttgatggagatggccttgtcgatgtcgaagcgggccgggttggccttgacgtcacgcacgtcgaacttctcgatcatctcgtccatggagaacacgtcgcggtcgggggcgatggaccagcccagcagcgccaggtagttcagcaggccctcacggatgaagccgttgtcacggtgcaggaacaggttggattccggatcgcgcttggacagcttcttgttgccctggcccatgacgtacggcatgtggccgaacagcggcatttccttggccacgcccagctcgatcaggtaacggtacagcacgatctgacgcggggtggagctcagcagatcctcgccgcgcagcaccacgttgatgcgcatcatggcgtcgtcgaccgggttggtcagcgtgtacagcgggtcgccgttcggacgcacgatcacgtaatccggcacggaaccggccttgaattcgatgcgaccgcggataaggtcgtcgaacgcgacgtcctcgtcgggcatgcggatacgcagggccggcttgcggccttccgcgcggaacgcggccttctgctcttcggtgaggttgcgatcgtagccgtcatagccgaaagccttcggacggccggcggccacgttgcgggcctcgatctcctcaggagtggagaaggattcgtaggcgtagccggcttcgagcagcttggctgcgacgtccttatagatgtcgccacgctcggactggcggtacgggccgtccgggccacccacgttgatgccttcatcccagtcgatgcccagccaattcagggcctcgatgatctggttgtagctttcctcggagtcgcgctgggcgtccgtatcctcgatacggaacacgaacgtgcccttggtgtggcgggcctcagcccagttgaacagtgcggtgcggaccatgccgacgtgcggaatgccggtcggggacgggcagaaacgcacacgaacgttttcaggaagttccggtttggtattttcaacttcagtcataggctccattgtgccgcgcaaaccggacgtgccacgacccaatcgccgtttttcttccgcagcgttccatactgcaatatttttccctatcttcacatcggcaaaggagtaatgtatgaggcgactttctttattctttagtcaccgttttgtgaaagggcactctaatgacggaccccaaccaatacaatccgcaggtgccgcagccggcagcgcagtacggccagactcctgcccccgactacgggcagccggcaccgcagtacggcacaccggattacgggcaggcgcaggcaccccagtacgccaccccggactacaaccaggcacctcagtatggtcaggctccgcagtacggccaagcaccgcaaccgcaatacaaccaggctccgcagtacgctcaggcccctcaatatggacaggcccctcagtacggccaggctccagccgcgaattacgggcagccggcaccgcaaccgcagtcgggcaatagcttcttcgcattgaccgcgccgcttgacatgcccgcatatggctgcaacctgggcgaggcgatcgtccgtttcttcaagaagtacgcggtgttcaagggccgcgcctcgcgtagcgagttctggtggtggttcctcacctataccgtcgtcactttcgtgttgagactcgtgttccgcacgttgaggaacctcaccgattccggcgtgatcgccaccgtcggagactcgttctcctccatttggggactcgtcgtgcttgtgccgaccatcgcgcttggcgtacgtcgtctgcatgacatcaacatgcgtggcaccgtgctggccatcatctacgcggtacaggcggccgccggaatcttcttcgccatcggtctgatcctcatcatcggcagcagtctttcgttcaggtcgttggaggcgggcaacagcgtcagcatcggcggcgttgtcctgctgatcctcggcgtgctggccttcattgccagcggtgtgttctactttgtgctgatggcccgcgattccaatccggaaggcgcgcgtttcgacgctcctacggcttccaacgcatgggctcccgccacgggcgaggctccggcagacccgtatgcggcgcaggccacctcgtacggcaacgtcccgctgccgaccaatccggcggctgcggcaccggccacgccgtacacggcaccagcgactccggccgattcgtacacagctccggcaccgcagtatgacgccgcgcagcagcacgccgcgccgcaatacgccgcacctcagcagaatccgctggcggaggctccgtccgtaccgtctatgcctccgatgccggctgttccgaccatgcctccgacaccgtccattccaccgatgccggaagtgccggcccagttccagcatccgcacgagcagccgaataccgacgctccggcggattcggacgctccggcagtaccgaatgatccggcgaacggcaccgatcagcagctctgatttcgctctgatccccgccttatcgccacacaaaacgtggcacaccataacgaataacgaataatcccggtatcctgtgcaatcgcaggataccgggattattcgtttcagatcattcgttacgggtagtgacgtcgttgcggatgtaacgcgtgggataggcgacggccacgcgcaattcgagcgcaagcacaagcgcacgcaacgcaagtacacgcaaagccttcaccgtcagacgtcacacgaccgcccgcaacacttattcctcggtcggctccgaaccggcctcttccgacgagtccgaatcctcagacaaattcgagtctgcagacgaatccaaatccgcgtcggaagccgcgttatcgccatcgctcgtcaaattgtatttctttgcgagcgcttccctgcttttgcgctcgtcctcgtctttggcgtcctgttcggcctgcttcgggtcccactccaggaacctcatatgccgcagccattcctgccccgcgaagaaagcgaggtacttgacggtggtggagaacgtcagcgggttgaacgagctgtcgaacaccgactggggccgtccgaactggcgggcggtgtcacgcagaccaaacaggttgatgagctgttcggcgttgatgaaagtgggcggaatcgacagctggttgcgcatggcgttgacgaacagcagcaccggcagcacgcggatggcctgctcctgcgaatcgtcggtgccatagcacatgaggtttatcagcgcgtcgagaaccgtcatcgaggcgaggtagcgtcttgcgaattcgttgcggtccaccgtggccgactggcagatgccgacgttttccgccacgtcatcgtcgacttcgaatccggaggcgctgcgcatagtgcgtgagaggttctccatgaggtcttggatttccttttcgattcgggtctccacgtcgatgccgagtattctggcggtttccatgaacagttcgatgccgtcgaccccgtggtaggaggccatcacgtcataggcgcggttggcgtccatcagcgtgcggatgatttccggatcgacgccgggaagcacatccatgccttcgtatacggcttccgcaaccgactggtcgacttcttcggagcgtttcagcagcacctgcgtcatcatgccggagaacatcacctgcaggttctccgcatatttgacgtcgttttccagttcctggttcgtttgcaacggccacatcttgaccagatcgacaccgtagtcaactgccatggagaccacgtgcgagccgtacatcgagtcgacgaccttctggtcgtatacaaaagacatactttctccttgtatatcgtgcggccggcccgaaccgcagtcatccccgaccgcgattgagccaccgcatgttttggttcacattattcgacgtccgccgccggatcggcgtacgtaatggacattattttcccggtattgcaatcgtaagtgatggaggtgatagaagcgagcgcggtgtggcgcaacagcatgttgtgttcggggtgccccgtttccagcatgtgccggtagctccaaatcggcgattcgtggctgaccaccacgatctgtttgccggggtattccgccactttctccagggcgaagtcctgcatgcgatgcgcgatcgactggtagctttcgccccagctcggcttccacaggttgcgtaccagcttccagttgccgttcttccacagcgcgccttcgccgaagccgatacgcttgccgcgaaattcgttgcgcgcttcgatgaggcgttcgtccgtctgcagctccagcggttcctcgccgcgcagtccacgtaccgaattcagcgattcgaggatctcccccgccgtttcgcgcgtgcgttccagcggcgacgagtagacggcggatacggtgttcagctgcgggctgaccgcgatgtaatgcgcggtggcctgcgccatgcgcacgcccacgtcggacaggtggaaaccgggcagccgctcgtacagcaggtgcccggggttctccactttgccgtggcgcacgaaatggatggttgtcgccggcatattggccgcctttcttgcgtttcggacctgccggccacgtgctggctcagcacgtttcgccggtcgccggccctgtgaaaaaattcgtcgattcgaatattggttcctgccctaatgtaccgcgtgtcacgacggtacctgcgcataaagttgccttggtcaacaaagacacacaaacaacacgcaccatcccacctttctccccgtgtgcggcatgtcaaacatgtcaatcgattgacgtgttcggacggctggggcagcgagctggtatcggaagcggttaaccaataattcaggggaaccaccaccatcagtccgcacgcgacgcaaagctgcggacgtcacgagcgaaaccgtgagcggaaaggagcggcaagcatgaccaacaatgtcctcgtcggcgtcaaagacatcggccaacgtcttttcggagggtatgcggagctgcttcgcataccgcacaccgcgcgattctccgtcggatcggtaatcgcctgcatgccgttcccaatggtcggcatgacgatcacgatttccgtgcagcattactacggcaactattcgctggcgggcgcgctgacggccgtgcaggcgatcgcgctggccgtggcgagcccggtgctcggcaagctggtcgacaaattcggtcaacggcaggtgtcgattcccacaatcatcgtgtggatggtggcggcgatcgcgctggtctcctgcatcaccgcacgcgtgccgtcgtggatcctgttctgcatagtgccgttcatggccgcgattccgccgtggggcgcgatgagccgtcaacgttggacgacgctgctcaagggcgatgcggagaagacgaaccgtgcgctgtcgctgtccggcgtattcgacgagtgcatgtgggttatcggcaatccgctggcgtccacattggccgtgatctccggactgctggcgttctcgttcaccggcatgtgcgtggtgatcggcgcgctgatgttcctcacggaactttctaccgaaccgaaatcgcagacgcagttggctcgtgaagccggcatgacacgtaaagaataccgagagcgcgaggctgctcgttccaaggctttgcaaaccgaagcggcggtagaatacgcgcgcgacaaggctcgtgcggaaggcaagacggccgctgaggtgaaggccgcgatgcagaaggccgccacggatattgcggcaggccgcaaggaatcgatttgggggccaggcctgatcgccgtgtgtgtgacgtggttcggcctgggggcattccagtcagctgccagcatttcgattgttgcattcgccacggaagcgcatatgaagcagtacaccggtttcgtattcgcctgtttctcgctcagctctctgatcggcgcacttgtgtacggcgcgaagaattggaagattccgctgtggaaacgtttctacttctgccttgcggtggtgaatctgggcatcggctcattcatgttcgctaagcatctatgggtgatcatgatcatctacctgtgcatcggcgtctgccaggctccgacgtgggtgaacggcaaccagctgatgctgcacctggttccgcccacgcgcttcacggaaggcatggcctggatgggcgcgatgaattcgatcggcggttcggtgggctccgcgatcgcgggacagttcatcgaccgcatgggctcgcatggcggcttcatcgtggtgacgactttggcattggcttcgctggtgatcgccctgttcggcttcaagcagatcaaggaatccacggagcagccgatgctcaccagcgtgagcgtgtgacggagcatgtgccggatgccgacgggtaaccggcaggcacggcagacaatccgcataacgaaaagcgcgtccgaatcgcaatggattcggacgcgcttttcgttaccccgttatttgggagttacttcggccagcccttgggcgtatgttccagcgaccacacgccgagcttgtgcgagaagctgttctcccacttggcctccagctcttcgggagtcaggcggttctcctgcttcttcaagcggttcatcgcattggtgtgcgtatcgtccagcagccacttgcgggtcaggaagttccacaccatcaccacggcggtggcgatgagcttgcccacgttggtgcggatcaggtattcggtgctctgcgacacgtaggcatcgtggttcatgccgtacgtggagatccagatgatggcgtcgttcataaacaggccgatcaccgcgccgaccacgaagatgacgatctccatccaacgcgccatgtcctcacgatgcttgaacaccatcttcatgctggcgacatagttgaagatcaacgagatgataaacgagatggtggcggcgagcacgttgtgcatgtggaaggcgccgacgagaatgtttagaataccccagtcgatgatgaaggcgatcacacccacaatgccgaatttcataagctgttcaatcagttttctcacacgggatatttaacactcgcgcgcagaccacctaaacttgggtaacgaagaacaatatatttcaacgattgcaaggagcagcaatgccagtcatccacacgcacgtttccgtatccaccacccctgggcagcgcgaggcgctgaaggccgcctacggcaaggccatcaccgcagttcccggcaagtctgaaggctggctgatgtgcccgttcgaagacaatatgccgatttatttcggcggtgacgattccaagccggccgcatacgtggaagtgaatgtgttcggccgttccgtgccgggttccgcctgggagaagctgacggagcagatcatggccgcgctgggcaaggagctgggcattccggccgaccgcacttacatccgctacaccgccacgactgactggggctggaacggtggaaacttctgacgaagttccaccgttccttcgaggtttgcccatattgcaaacctctcacctcacctacgggaagcacgtctaggaagctcgcctgactacggcagggaaatcgcaatatcagcacccccgaccgctcacaaaagcgagaaacgggccttttctacgggacgtgagcgaaaaggggtatgaaaaccggcaaaatcgtcagtaatcatacccccttttgctcataagagagaaaaatcgccccattccgcaactcgtgagcaaaagggggcgcacatgcaagcacgcccgcacccacaaacggacaacgtaaaggtatcacccacgaaaaaaaccgccggcccgaacgggaccagcggctttgtatttacgccgaatcaacgattagcgagcgccctcgacggtacgggacgtaccgccacgcggcgcaatcgcaagaaaatcagacgatcttcggcatcggggtggtcagcgacgtggtgaggttcacgtgcaccaggcccgcgccggaatgcacttcgaccttcttcagcgtgacggtgcgctcggcttccggagcgcggtcgttgtcggtcatggtggccggagacttcaccgcgaccagagcaagcgagccgaaatcgatgcccgcgctggcgcacagaccctcggcggcctgcaacgactcggcgaaaccgtccttcagaatcacacggtcggccggaacgccatacgcatgctcggcgacccaacgcacgttctccaccagagccatgcccttgtggctgtgcggttcggccggcatagaaccgttcgtcacggcatcgacgaacgcatcgagctgcggggcgagcgcgtcgccaccgtcgcggtacaggttgccgatgatcgggtcgcggaattccagttccttggcggtgtccttgagcgccggaatctgatcatcctcgccatcccacaggttgataagcgggaaggtaggaatatcaagaccttcgaggcgctggacgtggaacgggtagcgccatgccagatccggatcgtcgcgccacgtggaagcgcgggtcacgacgatggctgcggacggccactgcgcgtcgtattcgcggcaggcgatgtcgagccacttctgcgcaccagcgtcggtgccgtagccggcttcgacgatgaccacgtcatgcagcgcgcacgccatctccacggaaaccagcgtcggaatgccgatggacacgttggcgaacgggccgccgtgcacgtacaccggagagccgttcacggtctccgtcttggctggcttcacggcgtcgccgaggatgccggtgatacgccacaggtcaacgaattcgccgaaggtcacggccttgccatccttcgtgccggcgaccatcttggcaacgcgctcggagatctcatccatggaacgcgacagcacaacgatctgcatgagctcgcaggtcggggtgagcaccacacgctcagccacgtcgccctttccacggtccactgcgatctggcgcagggaacgggacggcacttcggagacgcgcggtacgaggatggtgtccagcttgccgtcgtcaacagccttctccgcaaaggagaccaacaggttctgggcggcctcgatggctcccatttcaccgcacagaccccagtcgatcagctccgggtgggtcagggaggccttgccgccaccggaggcgccacccttggaaccggctgcggtgatgcccatgctcggctggcgcagcacggctgccgcgtcgatgccacgttcgcgcaacgcgtcgatcagcgcgatcgtggtggtggtcttgccttcgccgcgggacgccttcagcggggtgtcggcggtgacgaggacgaccttgccatgcttgcgcggcgcatcaggattcttcttcaggtaatcgagatagccgaacgcatcaatcttctgcaccagaccgtattggctggtgaaatcctcaatgctggtcactgggttcctttcttgggaaagcattccgctgtatggcgcacaacgtacgcgacagacatcgcctatgcaacgcgcgccggcacgagcggaaaagcaaagacgatcgccattctaataagcacgcgccaccaaagaaaaccggctcccgcacagcggacgcgcgccgaccgtcatacggaactgtttgtggcgaacgctgtgcggaagccggttgctacgcgggttttcgtagaatttcttgcgattgcgcaatcgcagaaaatatcagaagtcggacatgtggaagccgttcttcatgttcatgctggtggtgtagagcacggagtcgagcagcttgtcggtttccgccttaagctgcgcggccatggtctcgttggcggcggcgagcacttcgcgggcttcgttgttgcggacggcttcgatgatttcgtccggttccatcggctgcacgtcgccgatctcgtcttcggcgtcgaattcgtcgaccacgccttccaccagtcggtcgatctgctcgtcggtggcggctaccatgcggtggcccatgccgccggtcttctcctggtagcgctccaccgcgttggcggtgtcggcgaagctggcgtcgcacagggccgcgatgatgcggttctcccagtagaagttctcggaggtgacgcgcgtggtggtgtcttcgaggtacttcggcgtggagtcgacgttcgggaagaacggcacgagcgtgttgaacgggttggaaccgtaggcaatccactgcacggcacggttgacctgcgggcggtacgggcgaatctgcatgacggacagctggctctgacggttgatgccgatcggacggaacatgtggcgcgaatgctggtcgccgagcttgccgtacggatcgtacggggtgccttggtagtgggagctcagcacgtacttcacgtcttcgatggtgatcttgcgatcgggctggcgagcccatggaatgtcgtccgcggtcggctggtggtcggcgtcctgaccgtcccactgctcgtcgtacgggttgaggaaacgctgcatgtaccaggcgcgcggggtgttgtagacgtggtcggaatcggagtgggagccgaacgcgtcgcgcgggttgaacggggtgacgttctccacggccaggtccagatggttgcgttcgatgaattcgccgaggtccgcggagcacatgtgctcttcctggtttccgagcgcgtcgtcgaggtcgaattcgtcgatgccgagctggttcggcatggtcacgtatgcctcgtccggcacacgcttggcgatccagtggtggccgccgacggtttcaagccaccagatctcatccacatcggagaaggcgacaccgttcatttcgtacgtgccgtactgttcgagcagcgcgccgagacgtgccacgccttcgcgggcggtcttgacgtacggcagtacgagggtgaggaagtcctcttcgccaatgccgccgggcacttccggctcgtagccgtcttcgccttccttgcccttggccggagtgagctccacgaacgggtcggcgccgagcacgcgctcgttggtggtgagggtttcggtggcgctcatggccacgttcgcctcgttgacgccggcttcgccccaaatgccttccttcagatccgcgttcggcacggccgtgtactgcagcggctcgcccggcaggtcgacttccacgtgggacagcacgctcttgtagtggcgcggctgctcgtccggcttgacgacgatgaagcgcttcgggcagaattcgccgttcgcgctgtcctcattgcgggcgatgatggtcgatccgtcatagcttgcgtccttgccgaccagaatcgtggtgcatgccatatatgtaggttcctttcgtttgttttgtttacgtttgcggtattctttggtattttcttgcgattacgcggtttgcgccttgccggctgttctcgccggtttcgccggtcacgccttgccggtcaggaagatagcgccttggtccgcgatcgcaccggaattacgcaacgcgcgttccatctcgttgagccagaagccttgattgagaccattgagaggcgcggtggtgccccatacgtgcaggtagtattcgtgatcccgatcaggcggatacggaccgttgtaacgcatggtgacggccggatcgccgctgcggcccttcagcagcggcgacgcggcggacgtgcggccctgcaccgtctcgggaatcatcgcggacaccgtgcgggagaagtcggcgggaatcgccagcgcgtgggaatcgttgaaatcgtacatcagcgcgtccacgggcagattggcgagcgaccaatggttccactggaagccgcacaccggaatggaatcgggatcgacgaattcccaatgcaggaactgcacggacgggtcgagctcgtcgatatagaaggggaaggaaacgatcggagtgccgtcgatgcagttctcaggcggcgccgccttggcgaacgcgtcgggaatgacggtgaaatctgcggaaatcttcatgcttccagtatcgcgcatgcgcgtgacgcgacgcggccgtatgacgcgtctacgccggtggcgcaatcgacgcaatcgcagcaatcgacacaacccgcaaccgaaacgaccccgtccgcgcggcgatcgcacgaaacggggtcattccgggaaacagggcccatcagaaccgaatcgctctcataggcacatttgcagtggcggaaccctgcggccgcgatgacgcagccgcaaagtccggaatagccgagcgaaagaaagaagggggaaaaatcactcggccggcttgtagaagtcgccgttgagggcggcggccgccttggccttggcctcttcgaaggtgacttcggcgagggaggcgcgcacatcgtccagcgccaccggggtcatggacagcgagttgacgccgagaccggccagcacgaccgccagatccggatcggccgcggcctcgccgcacacgcccaccggcatgcccttggcgttgcccgcgtcgcagatcatcttgatggcgcgcagcaccgccggatgccatgcggtctggtagttggccacggaaccgagggtacggtcggcggcaagggtgtactgggtcaggtcgttggtgccgatggacacgaagtcggccacgtcggccaccttgtcggccatcagggcgatcgacggcacttcggccatagcgcccacgaacttcagaccgaagctcttgccgagtttgacgaagtagtcggcctcatgctggtcggcgaccatcggggccatgacccacaggttcgcgtcggttgcggcgtcggcggcggcgagcgccttgagctggccttcgagcacgtccatgtgggcgcgcagggtacgcaggccacgcaggccgagggccggattcggctcgtcttccggagtcaggaacggcagcggcttgtcggcgccggcgtcgagcatgcggatcacgaccttcttgcccgggaactggctgagcagctcggtgtaggccttggtctgctcttcgacgctcggcggctcggagttgccgatgaacaggaattcggtacggaacaggccaacgccttcggcgccgtattccagcgccttcgcggcatcggacggcttaccgacgttggcgagcagcggaatcagatggccgtccttggtggcgcccggcttgccacgcagttccttggctgcggcggcacgggacttggcggcttcggcggcggcgatctcgtcttcgctcgggttcaccacgatctcacccttggctgcgttgacgatgacgttggtgccgttctcaagttcggcggcttcggcggcggagacgaccgcgacgatgccacgggcgcgcgccagaatggcggtgtgggaggtcggaccgccctgggaggtgacgatggccagggtcttgctcatgtcgagcgcggcggtgtcggccggggacaggtcttcggcgacgagcacgaacggggtttcgctgaccggcaggcctggggcgggagcgcccatgaggtcggcgatcacacgctggccgacgtcatgcaggtcggctgcgcgctcggcctggtagccgccgatggcgcggaacatgtcttcgaccgcgccgaagccttccagcacggcgcgctcggcggtcttgccctggttgatgaggtccttgatggactgtgcaagggacggatcggaggcgaacatggcgatggcctgcaggatcggggcggcctgcttggcgccttcgtcgccgttggcggcttcttcggcgcgacggttcaggtcggcgttgacgagggcgagcgacttttcgacgcgggcgatttcggtttccgcggagatgctttcggcgcgcggagcgtccgacggttccggcagcggagcggccatgcgaatgaccgggccgactgcgacgccacgaccgataccaacacccttaatgttcatgagaactccttttcctgtttccttgggaaaaaatatggatacgcaaacgattgcaggattatgcctgccttgcgtaggtgagttactgcaatgatccccaccgtctttgccggtaaatcattttcagcctgcgattagtatacacgaaattcccgcaaaacaaaaccggtaaacgttttctgtgtttcgtaaaaactgtgctatgataatcgcaagaaatgcagatgccggcaaaagccgcataatgcaatcgatatgcaaaaatcgatatacatcgacgtgtaaatatcgagacgacccaacgtaagcaaaccaaccaccaaccacaacaaaggagaccattatggcaacccgcaatctcgtcatcaacgatccggtcggcattcacgcccgtccggccgccatgttcgcgcaggccgtcaccgcttccggccagaccgtgaccatcgccaaggaaggcggcaacgccgttccggccggctccatcctgtccatcatgggtctgggcatcaagcagggcgacaccgtggtcatcaacgtcgaaggcgacaacgccgaggccgtggccgacaacctggccaacatcctcgtcaacgccgagtgacgcaccgcgcataacgcgctgacgcactgacgtacgaacgtttcgaccgcccgccatattcgacgggcggtcgttctattcttaataggttcttcgcggctcgaaccggttcatcagaccagacctttgaccgagaagcacacaggggttcagggcaccctctagggcattttgaaaaacacttagggagccggcaaacgcaagccggacacgacggaaaggacagcgcatggcaggcagaaccgacagcggcagctcaatcaccaacgtcgcggcgacggccggcgtgtccatcgccaccgtctcacgcgtgctgtccggcaaacgcggcaaggacgacgatatcgcccgccgcgtgcgcgaagccgccaaacagctcggctattccgtcaactacgcggcgagcgcgctgcgcagcgacgtgacgaaaaccatcggcctggtcattccgagcgccacggaaccgttctccgcgcaactgctcgacgagatcgagccgaccatcgacaccgaatcgcaacagctgctgctgggcatcggagccacgcaggaagcgcaggcggaacgcatcgaatcgctggccaaccgccatgtggacgggctgatcgtggtgcccgcggccggcgctgaccttgccggaacgttgaaccagtacgcgaacacgctgccgatcgtgcagatctgcggacggcagaccgcgccgcgcgtgtccgtggtaggcatcgacgagaacgccgcgatggaggcaatcgtcaaacatctggccgagcagggcatcgcgtccgccgcatacatggccggcaacgagctgtctttcgaatcggcggaactgttcgccacattccacacgcatatgcgcacttacgggcttgccaccagcgaaaactggaaccagttcggcgaacgtaccgtgcagcgcggtttcgattgcgccatgcggctgttcaacgggccgctcgtgcagccggaggccgtggtctgcgccgacgatgcgatcgcgttcggcgtgatggtggcgttcgacgcgttgggaatccgcgtgccggaggacgtgctggtggtcggctaccatgattccgccatagcgcgtaccaccatgccccgtctgacgtcggtgcgtgcgccgtttgagcgtattgtgtcggaatgcttgcgattgctggcttccggtcctgccggaggcgcggctgagacggctgctgcgccaggcggcagcgtgcgcgcgccccgtgtcatgctcgccccgcagcttattgtgcgggattcctcggtgttccgccggtgaatcgcgaatcgaatcgccggtaattactggaaattacgaaaatcatggaatcagcgcgcagaacagcgcttcgaacaccaaaaccggattgccgttgccattgagcctgcggcgcgcggtggcgatgtcctccagccggcgcacggcccccgtacggtcgagccgtaccgacaattccgtgatggcggaacggttttcgaggttgatgagtcccaccgcgtcctcggcgttgttctgcagcaccgccacgtcacggtagatgctggcggccgaattgagcgcacggtcgagcacgtcacgcgtgagtctggtggcgcgtcgtttgagctcgtcttttttggcgatcgcattgtatgcgccacgcagtttcgggggtatgcggtctttgggtccgagcccgttgatgcggcggaaatcggcttccgcttcggacgctttgacgttgacttccgcttcggcctgcgccttcgcgttgtcgatgaggttgccggccaatagcacggcatccgacgcgcgatgcaagccgagcacgccgacgatgagctcgtcgcggtccgtcatgatgcgttcgtccttggcatacaggctcgcgatgccgatgtgcccctccgacaatcgtgccgcacgcgccgcgatattcggctcgaaaccttgcgattccaagaatttcgccaccgcctggttggacggtacggccaagttgacgatgcgcgtgcgcgagcggatggtcggcagcacgtcttgggcgctgggcgcacacagcagccagatggcgtgcgggctcggctcttcgatttccttcaacagcacgttggtggtgcgttccatcatgcggtcgacgtcttcgatgatgatgatgcgccacggcgcggtgccgggcatctgctcggatgtggtgatgatgtcacgcacctcgtcgatgccgatggtcactttgttggtggccagcacgctcacgtcgggatgggtaccggcaagcacctgctcggtggttttggtcggctcatcgttcaggccatgatcggggctttcgagcgcggcggcgaacgcgcgggcaacgttggaacggcccgatccgggagggccgcaaatcagccacgactgcgcgatggccttcgggtcgccgctggcgatggccttcagctgttcgaccacctgcgcttggcctactatggagttccacacgctcatgcgatacccccgtcagcggtgctcacggtgtcgaaatcggctttgatacgcgcccacacgtcttcgatggactggcttgcgtcaatgacgtggaaccgttccggctcacgttcagccaagtcgaggaacgcgacgcgtgtgcgacgctggaagtcgttgccggccgcctccatgcggtcttcggcatgctgcagccgcgcatgcgattgcgccggatccatatccagcagatacgtgcgttccggcagcagaccgttcgtggcccacatgctcaggtttcggatttccgcggccgtcagctcgcggccgcccgcctggtacgccaaagaggaatcgagataccggtcggtgatgaccaccgcgccgcgttgcagagcgggcagaatcacttccgcgacgtgctgcgcgcggtcggcggcgaacaacagcgcctccgtacgcggggcgatgtcggcacaatcgttctcatcccccgtatccacgccgtgcaacagcattttgcgaatcgccacgcccaatgcggtgccgcccggctcgcgcgtgaccacgcattcgcggccctgagattcaacatatgcgcgcaaccgttcgacctgcgtggtcttgcccacgccgtcaacgccttcaaacgagataaaagtgccctgcatgcctttcactgtaccgtgcgcccctgccgtgcccggccattcggcccacagcttggtgtcgcacgatgccgattgtcttgcggaacatcagatcgtgcgacgtttccgcaccgcgtaacgtcagcgtgcgggaacgacttcaggacgcgcgtagccttcgttggcggtcagccagtcgacgtcagccttcacggtggacgcggtggaaccgatctccttcgctatacgcgtattcgcccaacccttgtcggccagttcacgcaccttggcacggcggtcggcacgcgcctgttcggtcgcgctcaccttcttcgcggatttcgctcctttggcagcgcccttcttggctcccttcgcagccgtcttgcggccacgacgcttcgacggcccctgcgcgcgcttctccgccagcaggcggaacgcctcggccggttcgatcgattcgggcgcatactgcttcggcagcgtacggtttgtctcgccgtcggtgatgtacgcgccgtagaagccgtccttgatggtcacgtgcttctgggtttccggatcggtgcccaagtcgcgcaacggcggcttggccgcgccacgtccacgaccgcgtccatacttcggctgcgcgaacagttccttggccttctccaagtcgacggtgaagatctcgtcttcggaagccagcgaacgcgtgtcggacttgccgtcggcaccggtcttggtcaggtacgggccgtaacggccattgttggccatgaccgtaaccgtttgcatttcgccggtttcggcgttcgcctcatcgtaggagccgacttcgcgcggcaggctcagcagtttcagcgcatcctccaacgtcagcgattcgggactcatcgtcttgaacagcgacgccatcttcggacggtcggaagccgccttcttaccgccggaacgcttcgtcttgcccgccttgcctgcggcggactcgacagcggtatcgccggcatcttccgcgctcggcatgaccaacgccacgtacgggccgaaccggccattgcgtacctcgacggtgccgccggacaccgggtccttgcccagttcacgcggcccaccggaatggttttcaatcagatcgtggccgacctcgacggtcagctcatccggagcgagcgtatccggcagcgaggcgcgcttcggattgccttccgcatccagatgcttcatgtcctcaagatacgggccataacggccgacacgcacgtgcaggccatcgccgatatcgatggtgttgatctcacgcgcatcaatctcgccaagctgcgccacctgctgctgcaggccctcatgcgcctcgtcggcggactgggccgcaccatcgccggaaccgaagtagaagcgggtcagccacgccttgccggtctcatggccaccagcaatctggtcgaggccggtttccatatcggcggtgaactcgtaatccacatacttcgggaacttcgtttcaagcagtttggtgacggagaacgccagccaggacggaatcagcgcacggccacgctcgtacacgtacccgcggtcgatgattgtggagatgatgctcgcatacgtggacggacggccgatttccttctgttccaacgttttgacgagcgacgcttcggtgtagcgcgctggcggctgggtctcgtggccgtccgcggcaacgtccacggcggcaagctcgtcgcccggctgcatcggcggcagggaaacgttgtcatcgatcttcttcgaagccttcgcactgccggtggtcttcgagtccaccttcacgcccgccgcttcggcgctcttcttcgcgtcggcaacgctacggcggccctcgccggtggccttcatgaagccggggaattcgatgacggtgccggacgcctggaacatggcctcgccgtcggattcggtcggcgcggacagacgcacggtggcggtggaaccggtcgcatcggccatctggcaggccagcgtgcgctgccagatcagggtgtacagcttgagctggtcggccggcactttggtggcgatttcagccggatcgcggaaatgcgcgcccgccggtcggatacattcatgggcttcctgcgcgcccgccgtcttcgtggcgtactgcttgggcgcatcggacaagtacttttcgccgaagtgccgcgacaccgcttcacgggcggccgcgatcgcctcctgcgacagcgtcaccgaatcggtacgcatgtacgtgatgaaaccgttttcgtacaggccctgcgcggcacgcatggtctggcgcgagctcatgccgaggcgattgccggccgtctgctgcagcgtggacgtggtgaacggcggcaccggacggcgacggtacggcttggtttccatcgacgagacggtgaacgtcgcatattccagcgatcgcgcgatcgcattcgcgtgcgtttcgtccagctgcacgacgttgtctttgatgccggcggcggtcagctggccatcatcgccgaaatccttggaaccggccaaacgacggccgccaagcgacaccatgcgagaatcgaacgcaacattgttgccgtcggcgtcgggcgcttccagcgtggcggcgacatcccaatagggggcacgcacgaacgccatgcgctcacgctcacgttccacgatcagacgggtggccacggactgcacgcggcccgcggacaggcccggaccgaccttgcgccacagcaccggggacagctcatagccgtacagacggtccagaatacgacgggtttcctgggcgtccaccatggcggcgtccacatcacgcgtgttgttcagcgacgccttgatcgcttccggcgtgatctcgtggaacaccatgcgcttgacgggcaccttcggcttcagcgtctgcacaagatgccatgcgatcgcctcaccttcgcgatcctcatcagtggcgaggtagagggtgtctgccttcttcagcgcgcttttcaggtcggcaacggttttcttcttgttgccgtccacgatgtaatacggcttgaacccgtcttcgatatccacgccgaacttgccgtatttggctttctcggccgccggcacctggctgggctgggcaaggtcgcggatatggccgaccgatgccatgaccgtgtatccggagcccaagtatccgccaatcttcttcgccttggtaggagactccacaataacgagcttgctgccggtagccatagccactccttattactagtgtttgcaacgcaataatactcactgaatacggagaaatggcaaaccgcccgtgtggcgcatggacggcagcatgcccggaaccggctgttttcagcgcttcggcggtgcgggcggcgctcccaccaaacccagtttcgtcaacggcgaggcggtcagctgacgcatggcgagcgttatgccaagcaccagcgcggaaacggcggccgtcagcagcgccgtggaaacgtacgcgccggcattcgtccattcggcgctcatggcgagtcccggctgaatctgccagatgatatacgcgccgtacaggatgcccaatacgccaatcgtcagcatcacactgccgacgatctgcacgcttgccgacgagacgcgcgtgcccggctcatccatgccgttggcgaacgtggtggcaagcgccagcaacgccagtccgccgacgatcagcagcgccataatcacgtcggtcggacgatgccattgcgccgcgatcaccgacaaaccgaccagcaccgtatacgcccagccaatcaccgccaccagcgcacgcagcacgcgcggcacggcgcacagcagcatcacgcttgccgcagcggcaaggatgacatgcccggaaggcgcggaattattaggattcgattccaaattaataagatacgggcgtggcagcagcggcttcaacagttcggccgcggcgaaacacaggcctccgaatacagcgagctgcgcgatcgacagccaccgtttgcgcacgatcagcacggcaaacgcgattgcccccatgatgacgctgacggtgatgaccactgcggaaatggcgaagacgtgcacgaccggcgccagccaacccggcaacgcggtatcgagtttcgaccagacgatatcctcatagctttggccgtccatggtacgcacgccaagccaccagacgccggcggaagcggcaagcatcagcagaccgaacaccacgcacagcacgatgctggacacgcgcggatggcgggtcagcggatccgcctgagccaagcctttgttgacatcctgcggagaaagcaccgcctcgacttcgcgcatatcagggaacgacaacgattccaacggttccgcaggcgttgctgccgtgggctgctgaagcatgttcacaggctgctgtggatctcggacaagtggcttgaattcgttggtcatagtcaccgagaatacggcatcgcccctactgtggggaacgaatcggagaagatatagaaaaacctccacgcacccggaagaggccacttacccttgctgcattcctgccctgggggagttgggtgacataccgccacgcggaggctcttgccatattacaccatgcccggacctcgccgcaccgactagacgcacgggtacacttgagaaggaatcgcacgccacccctgtgcgtttgcgtggctgcgataagcatcgataacgtttggaaggttgttttgttatgactgatgcggtggagtatcccgatctggtggtatcatcgtcccatggacgggcacgaccctaagtgcgcaaaccttcgggcactaccttccgggttactccttcatctgtatatatcgtggaatagagcatatagtcctggccgatccatccgtgtgagatgagtcggttcagcagagaattgtctccacctagtaaagcataaagttcttgattgtgacatggtttcgccgcttcatagtgggtaataaattcccagtctcctgaccgaagtttttcgatcgtcagtgatgtattattcttctcatctataagtttttttctttatcttttcgccagtcggtgtctagtgatttacccatgatctttttaaaagtctttattgtggagctgaaatcaaatgatggattatcatagtaactattgagaaaagtaattcgaatgttgattcgattggtttctttacagcgagaaatgtcgtcccagagtttcggatcgtcggcagcatatgtattttgactgttgcttggaatatttatattaattgattggcatctatctgcttgctgattattcaaatcggcaagcagatagataaggtccgttcgaagctcgctagcgtattcttcagcggctctgccatttgagatttcgttgattttatattttagatttttgtttttgtaatctaatgcggaaatatcttcctgtattatctctcttatttccttatagatgtggtcaagcctgctccggccgttctgtaactttatggcatcatcaaggtaacagttcttgtatataaggattgcgagcatcttgacaggggacagtccaagattggtccttttcgggttaagcagctgctctttataaacaatgaactcattgcgaatattgatccaggtgcgtttatcgggaactgcatctgcaacgagttcaagaaggttaatcatttgggggtcattcgcatcaagaacatcttccaatgtttctagtgcgatttggtatgagttacttgccgatacgaatggcaccactggaatgatgatgtcaaagaactttgcacgggagaaggaatgagccaaagattcttgattggctatttgtgcgtcagctgaaacatattgattactgaatatcgcatcgtgaatagcgtatacgaactgtataggtgtactggactgagaattcttttcttttgcggaatgagagaaatgcaatcgttgactgattttctggattgttgattctgtgtgttgcagctttggatcattattgaggatctgattcagctcgcgtagtgaatcaaagatttgagcatcttgaaaacggtcaagatcttcaaaaaatacagttcgaatgcctgtcttttcaaagatatatatgatctcatcaagatactgatcgaaataagagtccgagttctctcccagggtaatgcctgctgttccgacatctattttggctagatggatgcgggttccgaaataatgaaatagtgcgaactgatagcaggcaaattatgacgatttcagcaagaattttggtaatgcttgttgggattggtagccatgtcaacggtttttgaatatagctgtaaggccattgatagatattaagaatgaacagtaacagcatgccgaaagcaagagaggaaagtatctgctttcctaatccgatttcgttcatcttatggaaatgtgatgccggaatcttttcggggtctgttccatatagaagttgcttaatgatctctttttgaatgagattggttatggatgaattgttggaagactttgggggagcgccggatggttctttcgaagtggacttatccttatccgagacggaatcgtttttcttatcatcctgttccttaagctgtgcagctaaaggcgccagtgagattgtcctagttgtatgagggcgctcttcctcaaggtctttaacgactttctcaagaatgctgcttttcccggaaccgtagacgcctgatagagctatgttgtgtatcttcgtatcctcgccctgcaacgccttttcaagcctcttcacatagggtgagtggctcgattcgtcatattgggggtatagaggcttgagctctggtatttcactttcagctgctgcattgctcttctcggtcatgttgtaccagtgtagctatattaaatgatttactctcttctgccggtagatttgttcggcatccgcatttgttgcattaagctgcgatggggaggtaaggattcgggaagtgataatcgaaagatgtagatgattccaagtatcaatgcacgaaaacatacgtgtatctaacattcatgcgggaaagcagaaggtttcaacccctaatgacatacaatatatgcgaaaacattgggattgagagcatatggggagcacacggcaatgaggcatggcgcacattcggaacgagaactgctttctcccggcatgagagtgctgatccgcggccaggagtggcttgtcgataaagtcgagccgaacagtcttggcaaccatgccgtttcatgcaccggtatctccgctctggtgcgggacatgacggccacgttccttgatgatttggacacaattacgcctgtcgatccggtgaagacccgcttcattcccgacacctcggcaagagctgcgaagtcgcatctgttcatcgagagtctgttacgtgccactgcgccgaccgatgcgaggattcatgtcggcaacaaggctgccatggactccctgccgtaccagctcgttccggcgaagaaggcgctcgcccaacctcgtcagcgaattctcatcgctgacgccgtcggccttggcaagaccttggaagccggaatcctgatggcggagctcatcaaacgtcacaaaggtcgccgtattctcgtggtaacagcgaaaagcatgatggtccagttccagaaggagatgtgggaacggttcaccatcccgctgattagtctggattcctcgcgtatccagcagattcgttccgagattcccgcgaacgccaacccgttctcctactacgacaaggtgatcatctccattgatacgttgaaacgggacatccaatatggcgcggcgcttgatgcctcgtattgggacatcatcgtgattgatgaggcccagaatgtcgccgaccgtgccgtcaacggccgtagcgcgcaacgtgccaagcttgccaagcgacttgccttacgctctgacacgttgattatgctgtccgccacgcctcatgacggccgcgctcgtagtttcgcttcgttgatgaacatgctcgacccaaccactctgcccgatccggagcggtacgacaagaaggatgtcgaacacctgtacgtccgccgtttcaagaaggacgtgatggccgaggtgtcaggcagcttcccggagcgcaaggtgacgcaggagaaatgcatggccaccgcagccgaggaagaggcgttcgattacttgaccaatatgaaactcgtcatggatatgcatcagaagagaagcaattccttcctgttcaagacgatgcttgagaagagtctgttttcatcgccggcagcgtgcatcaagaccatcgacgagcgagtgaagcggcttgccaaaaaagatgcgtccgaccagaccggagacatcgacaggcttgaagggctcaaggccgctttagagaaaatcggtccgatgcagttctcccggtaccagagactgctgcagcttctgcgcagcgccgattacggttggcataacggcgaagacgccgatgaccgtatcgtgattttcacggaacgcatcgagacgaagaactatctcgaggagcacttgcggcaggatctcaaactaccgaagaaggccatcgtctccatggatggcggcatgagcgatgtggaacagcagaaaatcgtcgaggatttcggtacgaagtcctcgcctatacgcattcttgtggcctctgacgtggcctctgaaggtctgaatctgcactatctgagccacagactcatccatttcgacactccatggtcgttgatggtgttccagcagcgtaacggacgcatcgaccgttacgggcagcgcaaacagcctgatattcgtttcatgatgattaactcgcgtaacgcaaagattcaaggtgacacgcatattctcgagatcctgcagcagaaggaagaccaggcacgtaaggatatcggcgatccgtccttgctcatgggcaaattcgacgtcgatcaggaggaagattttacccgcgaagcgattgaatccggcgaatcagcggagaatttcgcagctagactttgtattcctgatgaggacatcgatcattcggacgaacgttccggagacgttgagactgtggcggatgacgatgttttcgatccattgagttttttcaacctcactacgccggatggttccgatactacgagcactgaggaaaacgagtccgcaggggagagcacggctgggagcgccgacgatggcggcatagccgattcctctacgctgatgtcggattacgagtatgtggatgaggggctctcctgcgaggagttccggcagtcggctggtcttaaatcgaaacgtcagttgcgtgatgctcatggattcgcggtggagttccaaggggatagcccgttgcacgcgtggctgcgcagacgtgtgccgaacacgcaggtgttgcgagacaacatcgctgaatggagtgatgacgcgaaatactgcgaagaccaagccaacggtctgctggcccgtatcaacgacgagtcatggagtcgggtccaatacctgtgggaattgaatccaatcacggaatgggtcgggttgaaggcttcctcactgctgtaccaacgtgacgaggccccgattattggcgtgaccaacggaaacctgcatgcggatgagacgattatgctgatgaacggcatggtcgccaacaggcatgcatccccggtgatcgatgaatggttcggtgtacggtatctcgatggcgaatgcatgggcatactgccacttgaggaagtgtggcgtatcaccggatatcgtgggaacttgattccgggaaccactgaacgtcgttatgtgaatcgagaggattccgcggccagctccgaacagatagatgcggcacaactgctgttggaggatgcggtatcgcgcggcaagagcatgctcagcgattgcggtgaacaatatcgtgcgcaggcagatgaagaagtgactcagcaaatggaccgcatcgagcattggtcccatacacgcaaggcactgttgcaatcccaaggcaaaaacaccaaggaaaacacaaaacaggttgatcggatgctcgaacaatatgccgactgggttcaggacacattggacgcttccggtgagccggtgatccgcattgcggccgcattcgtaggtaaggaatagagggggagaccatggcgaaggaactgaacgagacattcccgggcatcgaggcggtcaacgacttctacacgccgtactacatgaaggaatacttcccggatgaagtgaagaatgcctccgcaccttggaaacagcttcctcctgagaaacgcccagcgcgactgctgaaggacatgcgccagtcgttcaccgaagtcatcaacaacaacgagaacgatctgtttccagctgaacgggtacggattttcatcgacggcatgctcgccgcactcggctatacgcaggaggggaatcaagccaaagacgagggattgcccgaccggatttcagggaagtctgttcctgtctactatcaggtcaatgattccgatggggctccgcgcttgcaagttctgatgagcctgtccgataatgcggaggcaggcgttctggaaagccccatcgaagacggctctggcaaggacgacacctcctgtgaggaatatgcacgtatgctgcttgccgatttcgacgagccggcacggtggattcttctcatggggttgcatcagatagcgttgatcgaccgctgtaaatggaatgacaagaaatgcatgctgtttgacctggacgagatcttcagccggcatcaggatcatgtgtatacggcgatggctgtgctgttacgtcgtgatagtctctgcccgaacaaaggtgacagtctgcttgacacgtttgatgacacgtctgcgaagaacgcggttgaggtgtctgacaatctgcgttccgcgttacgtgaatgcgtggagatacttggcaacgaggtcatccacgactggacctgcaacaaggggcggagcatcgacgaaatcgacgcgggcgacctgacagtgcaggcgttgcgatacatgtaccgtctgctgttcctcctgttcattgaagcaaagccgtcgctcggctatgcgccgatgaaatccgacatctaccgtaccggctattcgctggacagcttgcgagatattgcggaacagatgcgtggccgcatggatgaggctggcgattccacctatctagcggacaccttgcgtcgactcgacgatctggtgttcaacggttacccgaagacggatgaggatttcaaggggttggctggcgaggaagccatcaatgcggtgtttatggttccgccgctcaaggcacacattttcgatccggagcggaccgcgctgattgaacatgccgcactccgcgacagcgtgatgctgcgcatcatagacctgatgagcgtcaccaagacgggtaaaggagtcaaacgcaggcagcgcatctcttacgcggcccttggcatcagccagatgggtgccgtgtatgaggcattgctgtcctaccgtggttttatcgccaaagagaggctctatgaggtcaaacgagccaaggattcctacgaccctttgaaagtcggctacttcgtgccggaacgcgaactcgtcaactattcggagagcgaacgcgttcgctacccggacaaaagcccgcatgccggcgagctgcgcacctacgagcccggtacgttcatctaccggcttgcaggccgggaacgtgaaacgtcggcctccttctatacgccggacagtcttgcgcaatgcctggtgaagtatgcgctcaaggagattgagccacgtatccatcaagccaccgatattctgagtctgaagatctgcgagccggctatgggctccgcgaccttcctgaacgagaccatcaaccagctggccaccatgtatctgaaccgcagggagaaggagcgggttgccgaggaaggacagaaggcggccattcccgcggaacgcaggcaagctgaactgcagaaggtcaagatgtacatcgccgaccacaacatctacggcatcgacctgaaccccgttgcagtggaattgggggaagtgtccctatggctcaacaccatttgcgaaggatccttcgtgccatggttcggaacccagctgcaatgcggcaattcgctgattggcggccgccgcgttggatacttggagtcggacttgtccagcaaaaccaagaaccgccactggtatgaggtcgagcccaagcatatcgggttcaaccagagttcgtcatctatcaagcgcatctaccagttcctgaccggagatccggacatgtgcaagtatgacgacaagaccatcaaaagcatagaatccgaacatctggaaaccatcaaggcctggaagaagagattcgccaagaagccctattcccaaacggagattggcctgatgagggcgttgtcaaagaccgtcgacgaactatggcgcggccagatcaaggcacgtcggcaattggaaaaggcgactcaagacgatctgattatctacgggtttgacgcgaacgcctccaagaagactgcgaaggctttggaaaaccagcagaaatatgggcagggctcgcttggcttcgaaagcgaatacttccgtggcaacaacctcaccatccgtgaaaaggatgagatgctccgcattgcctaccattcggaaaaggccgagaacgccagcgaatacgctcgcttgaaacttgccatggactactggtgctcgctgtggttctggcccatcgaccaagcggacctgcttcccacaagatcgcagtacctcacagaaatgtcgctgattcttaccggcgaggttccacaggaagagggattcacgctgatgtcgatggataacgatcagcccacgcttatggacaccatggatgatagtcatgaacgcgactacatgtatgaccataccgtggatctcgacgagctttgcagaggtgacggggaacctgcgcaaaggcttcgcttggtgaaggaagtcgccaagaagcagcggttcttccactgggagctcgaattcgccgacgtgttcaaagacggcggcttcgacttcatggttggtaatccgccgtgggtgaacgtgcagtggagtgagacggatgccgtttccgatgcgaatccttattttgcgattcataagcttacggcttccgatttgagtaagcgtatgggtgaacttctaaagaactcacgtatacgaactatgtatcttcgggagtatgtgaatattgccggtgctttggcattctatggttcagcggggaattacccgctactacagggacgaaccaatttgttccgctgtttcctgccgaatgcttggagctatacgcgtgcgcagaatggcgtaagcgcatttgtccatccagatgaggtttatgcggacacgaaggctccacttcttagaagagaaatgtatcgtaggatatgtagccatttccattttcagaatagacttaatttgtttgcgggcgtggatagcaatgcacagttcagtctcaatatctatagaaataaaattaattcaagcatttcatttgattcgatttggaatttgtatgcgccgtccactatcgatgaatgctatgcatctgatggtagtggggacgtaccgggaactaaagatgataattggaattgggaggtaaaaggccacaagaatcgtattatccacattgaggaatccgagcttaaaacttttgcattgttgctaagtgaacaggggacaagttcgtggagaaacaccccgcttgttgctgtgcatgcgcaagagctttttgatgcaatttgtaaaatggcaagtgtatctcgttgcttacgtgattatggggaagacataacttattcgagcatgtggaatgaaactaacgcacgtaaagacggtacgatatgtgacgaagttcattttcccagtgtcgatgaaaaaataatttattccagtccattccttggcgtcgccaaccccattatgcaaggtgcaaaaagaaattggaagacgaggaatgactatgatttgcttgatttgatggaggtaaatgattcgtttgagccgagaacgaaatacagacaagcttgtaccgattttgagtaccagcagagactcccgaaaatgtctgacggaagcaatttcgatgctgtttatcgcctcgcatgccgtcgtatggttaatttagttagtgaaaggacgctgcaagcgtcctgtgttcacccaggcgcagcctgggtgaacaccataacaggttatggtgtgcacccagagcgctacgcgttgctcgcgctcatgagcggccttgaagccgccctgccgtacgattttctcgtacgctctatcggcaaaatggatattcatagctcaacgctgcagcttttcccagttccggaaagcgtcctcgctcccgaaatccgtctccgaggtctactgctcaactgtctgaccaagccgtatgcggatttgtggcaatcctgttgggacgagtcatacacgtctatgagctgggcgaagaatgatcctcgacttaccaccgatacgttcacctcattgacaggcgaatgggaatggcatacgccattacgcacggactatgaacgccggcaggcattggtggaactggacgtgctggcatccatggcgctcggtattaccctgaacgagctcatcgacatctaccgcctgaccttcaccgtgctgagtggctacgaggatgacacttggtacgacgcgaatggtcgtatcgtgttctccaagaagaactatggtgatctgactttcaaacgtcctgatttcgagaagatcaagaatgcgcctgcgggcaaagtgttcacccgcaccatcatggacgacacccagccgggtgggccacgtgagcgaaccatcgaatacgtggcgccgttcgacaaatgcgatcgcgtagaggattacaaaaccgcgtggaagttcttcacgcagaagtacggagatgccaaatgattcccatggtgcttgcacggcatatccagtctggactcgccgattacgtggagactacgttccccatgaccaatatgccgttccgcggctccatccgcaaactcgcccatcaggagggcatgctttcccaggagccgttcgtatcggtcaaactgccgtttcgtgtggtcggcaaacatgcggaattcccgttcccatgcctgcaccccacgtaccggccatatgcgcaccagatgcgcgcattcgaacgcatctccgccggtgaatccacactggtggccaccggcaccggctcaggcaagaccgaatgcttcctgtacccaatcctcgactactgttatcggcagcgcaggctcggactcaagggcatcaaagccatcctcgtctatccgatgaacgccctcgccaccgaccaggcgaagcgactggcagaactcatccacaacagtccggaactgcgcaacaacgtgaccgcgggcatgtatgtgggccagatgagccaaggcggcagcgacaaggacaaccacgccatgaccgccaccaacatcgtgaccagccacgatgagctgctcaaaaacccgccggacatcctgctcaccaactacaagatgctcgactacctgctggtgcgccccaaagattcccggatttgggacagcaacgatccggacacgctcaaatacttcgtcgtggacgaattgcatactttcgacggcgcgcagggcaccgacttggcctgcctgctgcgcaggctcaccgacaggctgaacaccaccagcgacgatatgtgcttcgttggcacgtcggccaccatgggcaccgaagagacagtacgtgacgtctgtgagtatgccagccaaatcttcaacaccacgttcacgccggaatccgtggtgactgaggatcgtcttcgcgttgacgaattcttcgtcaccagcgactataacgacaccatgcctactgccgcgcaggccgatcggctcatcgaactcgaagaggacgtcgaccccggtaaataccttgcctatgcggcccaagcgtggcttgacgacgcccccacagagccggtctccgcggacaaggcacgcatccggctcgccgaatccctgcgtcattcaaggttcctggccagcctgtcctcgcttatctgcgacgaacctcagcgaatcgatcgcaaactgctggacaggctcgccatcatggatgcaaggttcaacgccttgcacccacgccagcagaaggcctgtgtagacgcgctgatagcgctcgtctcccgcgctcgcaacggttcggaggggcacacacgtccgttcctgaatgtacaggtgcaactatgggtcaaggaacttggccgcgtggttgccaacatcaccccgcaggaagggagcatcgactaccgtccggtcgtcgaactgtccaaagacgacctcaagacccgcatgccggtgattaactgccgtgattgcggagggaccgcatggattgggcttgccggcaaagacggcggtatcagcatgggtgacccacgaacgttctacaacgagtatttcgcctaccatgccgacaatgcgttggcgactttgcaaccctgcaccatggattatgttcttgacccgcatgccgacaacggagccatggtctggttctgcaatgcatgcatgaaggaacaggccgtagaacatttcgaatccacggaacgtgaatgcccggcctgtggagagcagcgcatacccatggtcgctaggggcatggagcttgtatccggcaaccgcaaacactatcagtgtccgttctgcggcagcgaacaggacattgccatggtcggtgtgagaaccaccacgcaggtcagtgtgatgctcacccaactttccggagactccttcaacgacgatagcaaggccatcgtgttctccgacagtgtgcaggacgcctcctaccgagccagcgtgttcaactcccgcacctggcgattcgccctgcgcaactccgccatggactacatgcgcgaggaacacaaggacggcgtttccctcgccgaatatctcaacagccagaacgactactaccatcgccgctatccggacgacaacgaatacatcgtgcgattcatcgcgccgaacatgacatggatgcgcgaatacgaagccgtattgcaaggcaatcccgcagggcccggccggcgtcagctgctcgattggatcgagcgcagactccgactggaatcgctgctggaattcggcatgcgctcccgtaccggacgtacgttggagaaatccggctgcgccgcaatagcattcgaccagattctcctgaaacgtgtggcacagaccgttgccgaacgttgccataacgagatcggattgcacgagaattccatcatggagactgactggctccgactgattatggcgttcctcgaccagctgcgcacgaaaggcgcgtttttcgacgtgacctatgaccagttcctgcaaaacgacggcaacaagttcctgctttccaacacgaacatcaaatggatgcccggcatgtacgcggatggtatgccctatttcctgtcggacaaggagccagtgcgcaaaggcgttttcaataccctgaattcgccggcataccgtcagatcgtcgaccggtacctcaccgacggcgcccttgaaggcgacatccaccacgagctgttgggaatcgtgctcgaagagtgcatagcagcaggattcatcacgcagcaacgttatccaagcatgaaaatggaacgcaccgtgtacgggctcaacgagtccggctgcatggtcagtggcaaggtaacgcagttgatctgcgacacgtgtggacggagctattcgtgcgctacgcagaaccttgacgcgtggaacggagcacgttgccgtatccgcaaatgcccgggcagactggtctccggcactcccgaagccgaagccctggaattgcgctactatggcaagctgtactgcggggagccagccgatcgcatccacgctgccgaacacacggggctgctcaatggcgatgaccgtgccaaggtcgaagaggaattcaagcgcaagaaccgcaagcccggcgacgtgaacgtgctcgcctgtacgccgaccctggagatgggcatcgatatcggagacctctccacagtgattctctcgtcaattccgcctacccaagcccagtacatccaacgtgccggtcgtgcagggcgacgtgacggcaactccttggtgctggcggtggccaataccaaggaacacgacacgtacttctaccagcgtccgaaagatatgcttggaggcgcggtgaacccgccgcacatcttcctcgacgcgaccgcagtgttggagcgtcagctcaccgcctacgcattggatcgttgggtgcatgccatgctggatgccggcagcgaaccggccgatgtggtacccgacaaattgaaaaactgtttggataatgtcaacggcagcggctccagcgggttcccggtgaatttcctgaactggacaggccaacattccggcgaactgctcgacggattcggaagaatgttctcattctccgaggaactccgaacgcagctcgacggattcgtacgcggtacggaagatggcagcaccatggccagacgcgtctacgatgtgttccaaaaaaccaacgataccgtcagaacgctggaatcgcagaagagcgctgcgaggcagctgctcgacgagctcaagaagaagccctccgactcatcgttcgaagagcagcagcgcgaatgcgaagatgagattcacaatcttggccgcatcgtcacaagcattctcaacaccaacacgttcaactacctttccgacgaaggcatcctgcccaattatgcgttcccggaaaccggtgtgaccctccacaccatcctcaaagaggacaaggaaccgtccgatgcggcacacggaatcgagcctgccgcgcaggacaagacgaaacgcagggggaaggccacgcgtgatttcgtgcgcccggcggccacggccatcacggaactggcgccgggaaacacgttcttcgcgggcggacgcaaatacaaaatcagccgcgtgctatgttcgaaaggcggtgccgacgacgaactggcaatgtggcgcctatgcccgaactgttcgcacgcggaacccgcctccagcaccgagaacctcgccagctgtccctcctgtgggtcaatgcagtgggccgataacggccagaaaaggccgatgctgcgcatcgacaccgtcatatccgatgagacctacagcgaaagcctgattgaggacacctccgacagcagacccaagactcagttcctgaagaatacgatggtggacatcgatccggcggacatccaatcgggatggcagttcaagggaatcacgaacttcggattcgattacacgccgcagggtacagtccgtgaaatcaacttcggacaggtttctgataggggagcctcggtggaaatcgccggtagcaaggagatacgtaacggtttcaacgtgtgcctgaaatgcggcgcgttgctcggcgagcgcgaatcacggcacgcctacttctgtccggaacgcaagaaggcgcaggaacagcagttggagcaatcggagcggaacggcacgtgcctgttcctataccgtgaggtcaaatcggaagtgctacgtatgctcgtgccagggcttgccgatgcccaaggtgcggacggtgctgcggagtcgttgaccgccgcagtgatgcttgggctgcgtgaacgcttcggcaacgtggaacatctacaggcgacactcatgaacgagccgttgccggataactccggactgcgcaaaacctatcttgctctatatgacacagtgcccggaggaactggctatcttaagcagctgtccgatccggatacgatgttcgaggtgttttccagggcaaaggaagtcatggagcattgcgaatgtgcaaagaacggcggcgacgggtgctacagatgcctgtatgcatacagacaaagccaggacctgaaacttatttcccgtaagaccgcgctggcgatgctcacgggcatcctcgacccggccaacaaacgcagtcgtgtgacaaccgtttcgaagatcaacacgaacaaactgttcgacagtggactcgaacagcagttcatcgaagctctccggtgcatgcatgcccatcccttcgcggaatccgacgatgccaagggacgtcgtgccatcgtcaaggacgaattcatcaatagcaaacctggatattccatcaccgtgaacggaagcgtgtggagcgtcgagccacaagtcgcgttggggccggccgatggggtcgcgattccctgcaagcctgatttcgtgctgacggtcagcaatatcgatgaatctggtgacgtggttgagcatgacggaaggaagccggttgccatcttcaccgatggcctgcaataccatgcaggcatcgtcgcccaggattccctgaagagggaagcgcttcgtcaggcaggctatcgcatatggtccttggattatgacgatgtgatcggatatgtgcagggcaaggatgtggcgcagctcgccgatccgatgctggcacccaagtccatgccgtctccggtggcttacaagagcacgatttgcaagaggactgacgaattcaaccccagcgaagtttcggcaatggccatgctggaatattatctcgcggaaccggatgccgaacggatattcgccatccaagcgctggcaatgagctatgctctgaatccgcgaaacaagaacgttgaacctcaggccgtggatatgctgcatcggaatgaagcgttgcacggcgagaacgaatcgacattcatgatttgctcgtcctggaatccttcgaactgcacgagactgaaattccaatccggtttgtgcattggagaggatatgcggaccaccgaaccccacgtcggcatggtgttctcggacattcaacgtgatgccgcgaaagcaaagaacgatgattataatccgttggatgctttggacgagaacgaggcagaggcgttcaaaacgcagtgggcagccttctggcattttgcgaacgtgatgcaattctcggaatacttccatgctatcggtgatgctgcgctacgtgacgaatccatgtacgagccgcttcgcaacggcctgcggaacgctcctgatctgcagaaagacaatgattccgaatggaacgatattctggcggatccgacctacgtgtattgcgcggatgaaaccaaggaggtcgtcaaacggtttattgagtctgacataccggcaccggatgcactcggatatgagctgctggacgagaacgaggaaatcattgcgcagtcagagctcgcatgggaggatgggaagatcgtgtttttcccgtcctacgacttgcaatccgaccgagagaacgccgacgaattcgtcaagcgcggctggactatcattacggaaaacaacgatgaccttgacaaggtgttcgcttcattgacggaaggcatggaacgctgatggcagatatacgtacgatgaacaaacccgtggtcgcactcggcagcgatctcatgcgcagcctgctcgagctgcctaagaaagcgcagaaacatgccacgacgtttctgacaaaattccaggcgaatcctcgatcatccggaatcaatctggaacgaatcgccaatgcggcggacgaaaaactgtattccgcgcgcatcgaccagcgatatcgcgccatcatcgctttccagaaaagcagcaacgtgtacgttttgctgtacgttggagaccacgatgacgcttacaaatgggcggaaacaaagcgaatcagcgtcaacccgaatacgagggccatccagctgtacgatatggctcctcaagaggaaatcgacgcagcgatgcatgaggattcccaaaacaaagttggatgggggagcgttgccgcaaacgcgccccaatcagattccgctgcgtcggaatctgttccccagcccacggaagaccatgccggcacgaatcacggaatagcttcagctattgcaacttcagctgtgacggacaagacgccgcagatgccacagcaagctcccgaacctcataccggtccgcttccagacacttatcgggcattgacagataatgacatgcgccggttcggcgtacctgacatgtatgtgccagtcatgtgcacgagaaagacgtgggaagcgtttgaacggtggggggccaggctcccaaaggatgctttcatgtaccttaccttcgttgctgaaggacttcccaagtccgaggtcttcggactgctcgatgaaaccgaaggcaagaccagcgacaggctggggctggagcagcagatgtctgcctcgtccatcgaatctggtgaagaggccgatccggaggacttccgtgccgccctgtcaagctatgcatcgcagcagtctttcgtggtcgtgcagggagaagcggatctcaaacgtattctggatgcgccgctggaacagtggcgtgtgttcctgcatccatcgcagcgtctttatgtggaacatgattaccatggtccgttccgcctgctcggcggtgccggtacgggaaagaccgtggtggccatgcatcgcgcgaaacgtctcgctgcaagactgctgagaagcggtagccgtcagaaagtgctgttcaccacatactcgcgtaatcttgccaccgatattgcatcgaacctgaaactcatctgcacgccagacgaattcaataccatcgacgtggtcaatctcgacaagctcgtaaaagatctgctgacggggcatggctattccggtgagatttggtatgacggtatctccgactatggcaacgatcttgacaccgcgtggcgtaaggctatcgcgtccatcggcgtgaacgatccgaaactcacggtttctttcttcaaaagtgagctcagccaagtgattgtgccgcagcaggtacggaatgctgccgattacatgcgcgtgctacgcaaggggcgtggcacgagactgaaccgagcccagaagcttgtcgtatggaaagttgtggaaacgtatcggcgcatcatgcaggcgaacgacgcatatgatgtggacacagccatgcagaacgtcgtgtcgttgcttacgcagggtgatgcgccgaggaaatatgcgcatgtggtggtcgatgaagggcaggatttctctgtgccggcataccgtgtgattcgtgctctggtggatgagggagacaacgatatctttatcgtcggcgacgcacagcagcgcatctacggtcatactgcggtgctgtcgaaatgcggcatccgtatccagggacgtgcccgcaaactgcggatcaattatcgcaccaccgaacagattcgtagcgccgccgactccattttccgtagttccggcgccgatgtcgcggattcggtgtttgcggctgttcgcggcatcggagatgcttcgccggccacaacgttcgatgacctggacggaggggagagcccgaccggcgacagccggtcgctgatgagcggtcccgttcctgaaacgcggcgattcgcctctcaagcggatgaaatggatgccgtcagggaatggatttatgaattatgtggtccggcggaagatacggtcggcgacgagtccgatggcgagcgtgtcgatccgcgtaacgtatgcgtggcggcgagaagccgctactgcatcgaccagtggtctaagacgcttgatgacggcttgccgtatggcgtgtaccagcttggtagggatgcagaaaacaggcaaaggcaaggaattcgcgtcgccaccatgcatcgagtcaaaggactggaattcgactatgtggtggtagtcgacgtgaacgatggtgtatgcccgccgaagcccgcgctgcaatctgccggtgccgatccggctgcgttgaacgaaatctacagggaggaacgaagcctcatttacgtagccatgacacgtgcaaaaaagggtgtgctgctaactggcgtctcggcgcatgtgaggtaagggaagaggagcaccatggacgctggcaagaaaatcctgctggatttatttaccggttcgcttcggttcgtggttccggtgtatcagcgcagatactcatggggcgaagcacagtgccagcaattgtgggccgacatcgtaacggctggcaggcatcctgagagaacccatttcaccgggtcgatcgtatggatgcaggaaggtggcatcggtccagatggtgtcagccgatgccagctcatcgacggccagcagcgccttacctccgtgacccttttgcttatcgcactggccgaatacgctcgcgaacaccctgagagcctacgattctccgcagacatgctcatcgaccgtggctatcttgtcgataagtacgcaactggtgaaggacgctacaagctgacgctttccggtgatgatagggaagtgctgcacagcatgtgcgaccatgtggtcgctcccgatcgcccgagccatgccgatacgggttcccggttggaagcgaaccttgatttattccgttcgctggtcgcggccatcgacgatgcgaacgtggtatggaacggtctgcagcgccttgaagtcgtgtccgtcactctggaccaagggcgtgacgaacctcagttggtattcgaatcgatgaattccaccgggcttgatcttgagacttccgacctggttcgcaactacatgctcatgggatgccccatggtcgagcagaacaccttgtatgccgattactggctgcctatggagcgtactctcggcaatctctcattcgatgcgttcctgcatgattggatggtcgtcacgctgaagaagcccgtgcccaaaggccgtgccatgtatacggaattcaaacgtttcgcagccgacagctccttgtctcgtatggagcgcgcgcacggccttctcgagaacatgctggaatatgccgggtattacgccgttatcaaaggcgttgcggccgccggcagcggtgacatgagtgtggatcgtcggctcgaatcgatccaaaatctggacagcacggttacggattcattggttatgtacatgttcgcagcatggaagagccatcgcacaaaccgcgacggattgctgcgcatgctcgcggatctggaatcgtatctgttccgcagaatggtctgctcggtatccagcaacggattgaacaaactcgtcccatctctgattgccaaactcgaatcagacgaacatgatttggccgaaaccttcgccgcactgctgctcaccgaaaccgccaaagccacacgcatgcccacagacgaacaattcaggcaggcgctgctcggcgaggatctgtaccgcccggctccgcgctgcaaacatctgctcgccggattggagaaccacaaccatcccaaggatccgcgatccttcaacgaatacaccatcgaacacatcatgccgcagaacgctatgacgcatgccgaatggcgcaatatgctcgccgaccccgaccgattcccactgctggtgaacagtctgggaaatctgacattgaccgcatacaactcggaactttccgacggaacgttcgagcagaagaaaaaccgcatgattggcggatatgacggcgaatacctgtccatctccgcggaactgcacgatgcttcgcaatgggatgagctggcgatcgcgcggcgcggcgcgcggcttgccgatcttgcattgcaggtgtgggcacgccccacagcgggggaagaggttatgcagactctgcgcaatcggaatgcgaaccagggggaacgcgaacagaatgccgttgatttcgctgatctatgcaaacggggcattcttgcagctggagccgcgctggaaagccggtatgccggcataaccgccacggcgaccgtaaccgaagaccaccgcatccgcctgtccaacggcgaaatattcggcagcccatccggcgcattccgccgcgccagaatgctcgaaaccggcgaggacaagcagatcaacggttggacagtgtggaaagtcgcggacggcagaaccctggacgaactgcggcaagtcagcggtaatatctcgttgcggcgcagcttctggaatggcctgtacgaatatgccgcaacacgagccgactttgttgctgtatacggctacccatccggtcgcaagacgaacagcgatacatggaccagcttcggagtgggatcgggtttctgccacccggatggggcgttgaatattcgaggcggctatattacggtcgacctgtatttcaccgacacgttccagtacgcgaaactctacgccatgagggattccgttgaacgaatactgtctgatcttggcgcggtgagctgggacgagccggacgcggacaagaagaaccgccaccttttggtgcagcatgatgtggatttctccggcgacatgacggacgcctaccaatggatgacagacggactgctcgccatgcgcagcgtatacgatctgctggtctgattacttgatctgcaacgtgttcagcactgtatagaatgagcataaccgttcgaaacgagaccgccatgaaatacggaatgagaaaacccagctggaagaagagcctgtccgcgcgtacgaaaggccgtgccacccgtgcggtcaagcgggcgctgatccccggctatggcaagaagggcatggggtggttgcatcccaagcgcaagctgtacaacaccatctacaagaagaccacgttcagcctgttcgacctgttcaagtagtcggtaatcgggtaatcgctagaacagatcatcatgtgacccggtccgtgtgagcacgagttgcagctcctgcttctccacacggtaaatgacgagccagtcaccctcgatgtggatttcgcggtatcccctccagcttccggtcagctgatggtcgcggtattttgtgctgagcaactgtttgtcttgggccatgagcgtgtcgatggcctgtctaagcttatcgggattgtaatgctttttaagcagagccttgaaatcctttttgaattgcgttgtacgaaagaccgatttaagcatccagcagatccttcatcaacgcatccgtgctggtgaaggattctccgtcatgggtttccgtctggcggcgtgcctcaatgctggacggattgtccctggtgatcttgaaaggcatgccgttttcacggattgactggcgcagaaagatgttgatcgccgtcgacagatccatgcccatgtcggcatacagttcccttgcctctcgtttgatcgctggatcagtgcggaaactaatcgtcgcagtgtcgctcatggttgctcctaatcatatgcaggtaacagctacaagcaattgtagtgcgaatgtcatgctgttgtctatacactagatcatgccatacgggagcacattccgtatagcggaatcttctacgttcgtaatatcgcatttatacttcgggaaagggtgatcaacgttttggaatccatgctggcaagcgttgcggtcattcctgcaacgtgaattggaagggaccgtccgccacggaaccgacgcgcatgcgggcgccgaaccggccctcacacacggggacatcgcccgactgcaacgcttcattgaaacgaatccatatcagattcgcatgctcatcatcggcatcatgagataccagctgcggcctgccgaccgcgggacgccgcagtatggtgagtggctgtggaatcgacagaatctcgccgtgcatctcctgaacagacagcgacagtctgccctgcggaccatcgaaacagcgtaacgtgagcacacgatgcgccatccgtgcaagcgttccctcatcatcatcgggctccacttcgacggtcaacaccaatccgggcccgatctgcaccatgtcgaatgtcggatccggtgtgcccaactcgttcaatacgatggcgctcgcttcggtcacgcgttgcagggaaactttcataacgaccaagtgtacggcagcggatcggacggccattgcacggaaaaaacggctggacgccggtagattggggtgttatctaccggcgtccagccgtttttccacgagtcggatggcgtcagctctttgcgtcgaacttctgcgcttccggcacggaacccagcgattcctcgttgttgttccactcggtggaccagccgtccacgaacgcgctctgcaccttgtcccacttgccggtgccctgtgcgtattcgaccagcgcggaggcgatgtcgtcttgccactgctgatccggaatggtgaagctgcgcacttcggtcttgccgtcattgctgtaggctcgggcggcctcggtcagaggattgtccggctggtagtcatcggtgaacgtggtgaatggcacggagaatcccatgtccttggacaggatcttcttggcttcgttgtcggtgatcatccacttgatgaagtcgagcgtggccttcttgtccttttcggaggcgttcttgttcaccgcccagctcgcgtcatacactcctacggggccgcaatcctcctcgcccttgatgcccatgtagtaggggagcatgcccaggtcctcatcggccacgtcattgcccttgatctgcgaatacgcccacacgccgttcgggtagaacgccacctggccgagcgcgaattcggaggtcacgtcatcgtaggtcttggagctcaccatgcttgcctcggttgggctggtcttgagctgcaggtcgaacatgtccttgtagttcttgagatacgtgcccttgatggtcttcgagaacgtggtgttcgcgtcccgatactcgtagtagagcggcagacgcgtcatatgcgcagcgaatcggtacgtgtcggaggcatccaagcccggggtggcgaacgcgccgtcgacgccgaggtcgtccttgtgctgctcgatggattccgccacctgcttcaaggtcttgtagtccttgatgtcatcggcggacttgatcaccgcataacttttggcgcaatagtccttgatgatcttcttgttgtagatgatgccgtaccattcggcggcgtacggcagggtgtacgaattgccgtcgatggtgtacgagtaagccttgccggtatcgttgagcagtttgaacacgtcggtgtcctgcagcggttcgacgtacttctggtacttggcgaactggtcgaagccggcgacgttgaacatggttggtgcgttgtccttggccaattcggatttcatggtggcgtcatacgtgccggcggctccggtctggatgtccacctgcacgccggtcttcttggtgtacatgctggccatttccttgtactggtccacgacctcggccttgttgttcatgaaatacacgtggcccttgctggaatcggcgctgctgccgccgcaggccgccagcgatgttcccatggcgagcgtcgccgcgatggcgacgattcgtgtgatgttgcggttcatgatgtgctcctttgcttggttgttgaatgcgaattgcggttgatggggtccggtcagccgagcgcgatccacgcggtggtgtcctgcggcagacgtccgtcgtcggtgaggggtccggagacgagcaggatatcgcctgccggcagttcggccggttccgcaccgaagttggtgacgctggcccagccgttggccctacggaaagcgatggtgccgccggtgtgcccctcggcgccgtccggcttgccggaggaccggtcgcagtcgagccaggtcagggtcgtgtcggccgtcatccattcgtgacgcagtccgagcgccttgcggtataggttgagcatggagccggagtccgtgtcctccctgtctacggcgtagtcgacgaaccattgcggttgcggaagatgcggcttctcgcacggatcgcccgcctggctcgcgtccacgccggcgccttcatgcttggtggcgggggagaagccgaaggtcggcgtcccggccttccaaggcagcgggacgcggcagccgtcgcggcccttttcgatctggtctcggacgcggttgaacgcggtcggatcctccaactcgtcccacgggatgtcggcgacctctggcaggccgagctcctcaccctggtagatataagcggaacctggtagcgcgagctccatcaggatggccgcacgcgcacgcttcgtgccgagctcgcgatcctcatggtaagaggtaccgttgcgcagcagccaatccttggcaagttggtggtgggctgcagccggcacctgcggcagcccatagcggctgacgtggcgggggatgtcgtggttgctcattacccatgtggaggtggagccggagcgttccgcagcggcgatgccttcttcgatggcgaggtgcatgtcgttgcgaatccagtctttcttggcgaattcgaagttgaacacttggccgagttcttcgggcgaagcataccggtattgatgctccggaggtacccaggcttcggcgacggcgaatgccggcggatcatactcgttgaacaccttgcgccattcgcgatagatgtcgtgcacttcgttcctgtcatacagcggatgcgtgccgtcggcgcaatgcatctcgcctccgatgattttgaaatcatcgagatcgtcacggtcgagatccttagtcaggccgtgcgccacatccacgcggaagccgtccgctccatggtcgagccagaagtgcaaggtcttgatgaaatcggcgcgcacgtccggattcttccaattccaatcgggctgttcgacggtaaacatgtgcagataccattgtccgtcgggcactcgagtccaagcggatccaccgaagctggcaatccagttggtgggtggctcgtcgccgttcggtcctttgccgtcacggaaaatataacggtctcgttccggtgagccggggcctgcggcaagcgcggccttgaaccattcatgctggttggacgagtggttcggtacgatgtcgacgactattttgatgcctgccgcatgtgcggttttggtgagatggtcgaagtcgtccatggtgccgagtttcgggtcgacgttgcggtagtcgtccacatcgtatccgccgtctgccagttgagacggatagaacgggctgagccagatggcgtccacgccgagtctttttagatatgggatttgttgtgcgactcctgcgatgtctccgaggcccgacccggttgtgtctttgaacgaacgcgggtagacctgatagacgaccgcctgcttccaccagagtgatggatcgtcagcgatgtgccgctcgttggcttcgttgctcattgggttgtcttccttcattggatgcattgtgattttgttatggctttttatggaagcgttttcactagttcattctggtgagaacgctctgttttgacgattggaatcacttcgttctcgtcttcgtattgcttaaaatgatagcgctttcattctgtgaatgcaataattgttttgttatggcgtgtctgcttgtgaaatcaacgattctgctaatatgaaagcgctggataaacaatgggaaactggagtggatatggcacgagccaccatcgccgaagtagcggaactggcgggagtatctcaggcgacggtttcgcgggcattgcgaggtgctggcaaggtcgctccgaaaacgcgtgccaaagttgaggcagctgcggaccggttgggctttaccttatctaaaagcgcatcgtctttggcgtccgggaaaaccatgcgggttgtcctgctgttttccggcaaactcaacgaatggttcaacgccaacgtgttgcagggcgtgtgcgaagtgttggaaccggaaggctacgacgtgtcgcccacatttgtcacaggcagacaggagacggagcgttacttcgcacaattgcctaaaaatcgcaatgctgacgcgatcatcatttcgtcgttccaactcgacgaatccgcacgtgagaaactgcgtgtcaccgatatgccgacggtcggtgtgaacattccagccgaatcgttttgcgacgcagccatcggtgttgacaactacgatggcatgtccaaggcggtgcgtctgctcaaatcgcttggacaccagcgcatcgctttcgtcgttgattacattcccgacgacatggtctacagcaccagccagcgtatggaagcgttcttggaagcggctgaacaaaacggttacgacgatgagtatgcctacgtcataaccgcggacgagcatgatgcgccattgtcgaaagcggaccttgctgcgcaactggtggcgaaattactgtcattgccacacatgccaaccgccatctgtgccgaaaccgatcaagtggcaatcgcagtcatcaaggaactcggcaagcaacaattgcatgttcctgaagatatctccgtcatagggttcgatgatgccgacatcgcacaggcgacgaatctgaccaccgttcgacagaatccgctggaaatgggacgcaacgccgcccgtaagacgttgtcccttctgcgtggacagacgccagacgcatcctatgaatcgcaggaggccacgctgatgttgcgtgacaccaccagacgcgtggcgaccgaccgttcgtgacggttcttccgtattctccgaacggaatgaacgcaatatggaaggatatgggcccatgtagcctatgcgccctatgatgcgttgaaggaaaccggtcttcggaaaaccgagacggtggtcgaaccatacgaagacatcgaaagacattcggcagggcatgggcaaaatcaacgaaaacagcgcaaagtcaacgaaaacgaagaatgtgacgcccgcggtcacgccatggggcaagaaccgtgtgaagaacaccgaaacaggcaagcacgtactcatcatgccgggcatcggctacaccgtggacaggccgctgctgtactggtcggcgcaggcgctcgcggccaacggctggttcgtggaccgtctcgacctgaaactgacggaaagcgtcgagtttccggaaatgatcgcctgcatggaacgcgtggtcgacgaatggcgcaaggcggcgctcgaacatgctgccgaatcgggtgaggagctgcagttgctggtcgtcaccaaatcgctctccacactctcatatccgcattccgcaaagctaggattgcgcgtggtgctgctcaccccggtactcaatccgccgccattcgacaagcacaagtcggtcattcccgcgccgctgccgggtgcggtcggcagtccgatgccgttgatctgcgccggcgacgccgacccgtatttcgatgatgccaaggcgcatctgctcaccgaccatgtgcgcacgtacgctggtgccgaccattccatcgaagtgccggacgattggcagacgtcgctcgactacctgaaacaggtcacgcaagccatcgtcgactacgccggctgaaaagaacgggacggaatatgcgcatcgtattgcagaaggtcagcgaaggaaccgtcgacgtggtcgacgaggtgagtggggaagtcgatgccacgttcgaaccgcagcgtatcggcgtcggctatgtgctgcttgtcggagtggaagacacggacggagcgaaacaaatcgactggctcgcccgcaaaatcgccaacctgcgcgtcttcgaagacgagaacggcaaaatgaaccgttccatccacgacgcggacggcagcgtgctgtccatctcccaattcacgctatacgcggacgtgcgcaaaggcaaccggccaagcttcgtgaaagcaggcgcgcccgcgcacgccgaacagatatggaacggattcaacgacgccctgcgcgcgcaaggactcgaagtaaaagaaggacgattcggctcccacatgcgcgtgcggctcgccaacgacggtccggtcaccatcatccttgacaccgacgaactcggcgtctgacccaaaacccaacgtgaaaccctatatccgacgattgccatagggtaaaacgcatgggaatatggaacgaccgcaaactgatcgtcaactgcctgccgttgaccgaatccgaacgtgcgcaattcatacgtgccgcgaaagacataccacaggaattcgtcggcgattcgacccaacggggaagcatgagctggaccgccgcagtaccggaggaactcaaagccaaagccaccgcggtcatcggcaacatcgcgcccgaggaatgcgcgcaatgccccaaactcgaatggcttcaaacttggagtgccggcgtcgacaaataccagcaccccggcatcctacagcccggatccatgctcaccaacgccaccggagcctacggacaaagcgtctccgaacacatgttcgccatgatgtgggccatcatgaagaacctgcacatctacgcggcaagcaacccgaacgccatgtggcaggacgcgggccgcgccatcagccccaacggaaaaacggcgctcatcatcggaaccggcgacatcggatcacacttcgcacgactctgcaaaaacgtcggaatgacaaccatcggcattcgccgtaatctcgccgtcgaagcgccgggcatcgatcatatggtcggtttcgattccctcgacgacgtcctgcaatacgccgatgtgatcgccatgtgcgtaccatccaccccgacaacgcgccacctgctcgatgcgaaacgcatcagcaaactccaaaacgacgccatcatcatcaacgcgggccgcggcgacgccatcaacagtcaggcgctcgccgaagcgctcgcggacggcgcaatccgaggcgcgggcatcgacgtgaccgaaccggaaccgctgccggaggaatcgccattgtggagcgagccgcgttgcctggtcacgccacacgtggcgggcggcaaccatttggagtccaccgagcgccgcgtcatcgccatcgcattgggcaatgtacgctgctacgccaacgggcagcctctcaacaacctcatgcccctcaaaggctgacggtcgcgcgcgggggagacccgtatgatggcagtcgggaaggaaggaaagggtatgacattgaacaaatggcgtcgtgcgacggaatggttcatgacggcattggcattggtgttcctgttcgcgtattcgtgggaagtgctggcgagaacgcatatcgtattgtgcgaaacggtgatcaacatcatctggatggcgttcatcgtcgactacgtcgtttcgatcctgctggcgaaggacaagaaagcctggttcaaagagaatctgctgatgctggtgtccatcgccttgcccatcttcagaccattgaggctgctgcgattggtggcggtgctcaacgtgctcaaccgtaccggtggcatggcggtgcgtggacgtatcacactgtacacatgctgcagcgtgacactgctgatgtatatcggcgcccttgccgaattggatgtggaacgtggggttccaggcgcttccatcaccgatttcggcgaggcgatatggtggtcgttcgtgaccgtcaccacagtcggctatggcgatttgtctccggtgacatggcagggaagaagcatcgccatcgggctgatgataaccggcgtggccctgatcggcatcgtcaccgcgacactggcctcatggatagtcgatcgtgtccgtgacgaaaccgacaagcgcgcggacgaggcggaatcggaaacggaacagttgcgccacaatgtgcgggaactgacggacaccgtcaaccagctgcgtgacgacatcgcgcggctgcgcagaccataacggttctcatgactgcactgcggaaaatgcggaaagaggctgaggcataggaaaagcgccggatgaataacccggcgcttttcctatgcctcaccgtcatacgtcttacaaccggaaaggcggagacgctgcattggatttattcgcaggcgactccgtcatggtcgcggtccagttgtgaacggtagcccggctggccctggtagataggcgcggcgccagcggctcgtgccgcggtgcagttctggtagtagacgtcctgctgtggcgctggttggggcgcgggagccggagccggagcgggttcgagcgcaggtgcctgtgtcgtttgttgagtctgctgggcctgctcagctgactgttcggtttgcgtctgttcggtttgcgtctgttcggtctgctcggactcggtggtcttctcggctgtggaatccttgacccccgtgtagtcgggcacggtttgcgtcgggcaggaggacagcaccttggccatggcttccttttcggcctgcgtgacccacagtgagtatttgtgcttcacgccgatctgacgcgccacgtattcgcaacggaaccccttgttggacggcagccacgtggccgcatcgccatcggacttcttctggttggcacgcccctgcacggccagcagattgtacggatcgttcgccaatgcggtgcggcgctcctcgctgagcttctgcgcgcccttctgccacgcatcgctcaacgccaccacatggtcgatctgcaccgcggtggaagtcttcttgcccttcttgaacttgatgtccttgccagtgtatggatcatgcagttttccggacttcaccacgcaattgtgcgtacgccacttgtgcctcacgccggtcagatcgcggttgaggatatcattgcgggtgtcgcagccgttgtggtccacgtcggcccacgccttgccgaattgagtgcgcttgtacccggttttcggcgcgcggcccttgacctccaacgaatccaacacctccgtggcggacgtgccggccccggtgccatccgtcggctcgtccgcatacgccgaaccgaccggcagtccgatggccagactcgcagccagcaatccggacaaaacaaccatcatcgaaccatgacgacgcatgatacgctcctcaccctaaaacccctcaagtagtacaagaatatccccggaacgaattcgaatcgcttatttacggcagatttttcggcatgccgaaaccagtatttcgcatccgtcaagacgtatggcaagaatcggccgtatgaccaacagcatcacagcaatcaaaccggaacgtctcgcacaatacgccaaagacttcaacgccgaccgggccaaccttgtggccgccaacgccgcggtgtcctcgggcgtgctcgaagccgccatcgactacaaaggccagcgcgcgctgccacgcgacttctccatcgaactgaaacaggggtccatcaccaaccagcgccgatccggccgctgctggatgttcgcatccctcaacaccctgcgttacgagctcatgcaccagtggggactcgacgatttcgaattctccgaaacctacctgttcttctgggatgcgatggaaaaatccaacacgtatctcgaaaacgtgttcgccacgctcgacgagccgaccgacagccgcctgttccaggagatcaactacgggccggccgatgacggcggttggtggcagatgttcgccgcccttgtagacaagtatggtctcgtgccgaagagcgcctacccggaatccgccaattccaaggactccgacgcgttcaaacaatacctcaacagcaggctgcgccagttcgccgccgacctgcgcgaacgttacgcagccggcgccacggtcgatgaactgcgcgcggtcaaggacgacgacatgtccaccgtgtaccgcatgtgcgccatctcgttgggcgagccgccggagaagttcgacttcctggcccgcgtgagcgacgatgacaagaaggacgataagaaaagcggcgaagacgaggccgacaagccgaaaaccggcaaggacgagcgcagacagatccgcgaaaccggcatcacgccgatggaattctacaagaagtacgtgccggtggacgtcgacgatctggtgacgttgtgcaacgtgccgatggcgtcccgtccgttcaacaagcgttaccgcatccgctacaccgccaatgtggccgaagcgggggatatggaattcgtcaacgtgccgctcgacgtgttcaaaaaggccgcggtcgaccagattagcgccggacacccgatctggttcgcctgcgactgcacccagttctcgctgcgtgcggccggctatttcgactgcgacagcgtgcgcgtggaccagctgttcggcaccgatttcgacttcgacaaggcgcacggcctcgaatacggcgacagtccaagcaaccatgccatgaccctcaccggcgtgaaccttgacgagcaaggcaagccgaaccgctggaaagtggagaacagctggggcaaagacaacggcgaagacggctactacgtggcctccgacaagtggttcgaccgctatgtgaccgaaatcatcatccgcaaggaatacctcgacgacgccacccgagcgctgctcgaaaccgagccggtggaactcgacccatggcagccgctgaccaaacgctgccgctgacgcaacacgggcgataacatgccgcggtccggatcgggccgcggcttttgctgttccaccgcgctggtatggttgcatgagaacaaacgtacgaacgatgggggttcaggtggcggacactctggcatggctttccgacgagctgcgcagcgaatgcagccagccggtactgcagcgcgcccgcggcatcgccaaccaatggcgttccaaaatggaggacctgcattgcctgaacgacaccgcatccaaccgcatcaccctgtatgccaccatacagggcaccacctcaccctccagccgttacgaagtgcaagccacgcttgatttcgccgacgagctgtttctggcacgctactgctcctgcccggcattcagcggttcgcagcgcggctacggttcctaccggaccttcgactaccacaacagtccgaaataccgcagcttcgacgatgacgacgactacgattacgtcgacgactacgacgatttcggctccggcagcacgtacggccacgtcaacgatgatgacgactcggcttcctccaccagccgccggtacaccggcatgtgcaagcacgtagccgccatgctgctgctgttcctgcagcagccggaacgattccggggattccacgccgcagccgcaacaccccgggccctcgccgactacatgcgctccctcgatgcgaaaagcaacaacgccggcgagaacgcccaactcgacgtgctgaaacgaatcatcaacgcgaaaagccgattgatcgaggaacaacgtggcgcctccggacagggagccgccaaaccgaaacgcaaatcaagcgcgccggtcgacgtcaaaccgggaagcgtgtacctcgagcccacgctgatcaacggccatgacgccctgcgcctgtccctgcgcatcggatgcggcgacgccgactatgcgctcaaaaacatctcaagattcgtggccgacatgcggacgggaacatacgagtcatatggcaaaaaactcgcgttcacccacactccggacatgctcgaccccttctcgctgaagctataccgcttcctgcagcaggtgatcgcatccagaacggcggcccaactgcaaaacggatactattacggcgaagcggtacgcgtcgaccgtgaactcgtcctcaccgattgggaggcatgcgacctgctcgacctgttccacgccgtgacacaggacgaatacaaggaacacgagtcgaaggcccgcggtttcctgcgcacgtcggacggtgacgggctgagacgattgcttatcgaggatttccaacgcaccaaggaatccgggccaagccgcatccacatggccaacgaaggaggcgagccgttcggccttgacattgtcgaaggcgaccccaccttcacgttcaaggcgtcctacgtgcatgagggcaccgcgtcgggcgtgcgcatcacatcgaaccaaagcatctccgatgtcatcaacggacgcaacggcttctacgttttcagccgcgaacgtcccgacgattccacggcgacggacaggataggcatcgacgggctcttccgctgcaccgataaactgcgcccggcattgcaggtgctgcctgacctgtgttccgacgatccggacggcgtgttcatcgccgaaaacgactggcccatgttcgcccgaaccatcgtgccgaaactcaccgaagcgggcatcggattcgacattccgcaggaagtgaccgaagcggtgggaaccgaatgccggatcgaattctatctggaccgcgatttgtacggcatcacctgcgaagcggtggcgaaatacggcgacttcaccttccaactggtgcccaccgccaaagaactgcgcggcgtgatcaaccccgattcacgttcaagagcctcgcaggtcaaacgcgacctgtcacgggaatcgttcgccgtgcaggtggtacgccagctgtgccctacatggagctccatcgacgtggcacgcgtcaaagaagaggatgagcaggctatcctgctcatgctcaccgacggcgtgcagatcctcaaatcggtgggccaggtcttctccacggcggcattcgatggcatgatgcagcccaacccgccatcggtgaaggtcggcttgtccatcgactcgaacctcgttgaaatctcaccgatcgccgacgaggtgccgatgaacgaagtcggcgcgctgcttgactcctaccgcagaaaacgccgctaccatcggctcaaaaacggcacgttcgtggatttgaaggaagccgacctgcatgagctcgaccaagtgtccacggacctcgacctgagtgaaaaacagctcgactccggcatcatcaaaatccccggataccaagcgttcctgctggactcccaagtggacgacgaaggcaaaagcgcctcgttcgtggactatgtcaacgatgtgaagatcgtcgatccgaaacgctacgaagtgcccgaacggctcaaaaccgtgctccgcccataccaggtggagggcttccaatggctgtccaccctgtgggacaagggcttcggcggcatcctcgccgacgagatgggcctcggcaaatccgtgcagctgctctcgctcatcgaagcgcgcaaaggaaacggtccgtcactcatcgtctgcccggcatcgctcgtctacaactgggccgcggaatgcgagaaattcgcgggcgatctgacggtggaagtcgtcgccggtacgaaagcgcagcgacgcaaggccatcgcgacggtggccgcgcaatcgcaggagaacgacggtgctacgacgaatggcgccacgacgtacgacggcaccgacgtggtgatcacctcctacgatctgctgcgtcgcgacgtggacgattacgcagcctgccatttcgcgctgatggcgctcgacgaggcgcaatacatcaaaaaccatgccacaaaggtggccaaatcggtcaaacaggtcacggccgaccatcgcttcgctctgaccggcacgccaatcgaaaaccggttgagcgaactgtggagcattttcgacttcctcatgcccggactgctcggcacctatacgaaattccgcgaaaaatacgagcagccgatcatggctcccggtccggaacattccgtcatggccgacaaactgcaggcattggtgggactgttcatcaaacgccgtctgaaaaaagacgtgctcaccgacctgcccgacaaattcgagaacgtgctcaccgtcaaactggaaggagagcagcgcaaactgtacgccgcacacgaacagcggctacgcgccacgctcaccaaggcgtcggacgccgacttcaacaccaagaagatccgcatcctcgccgaattcaccttgctgcgcgaaatctgctgcgatccaagactcgtatacgccgacgcgaagaacgcctccgccaaactcgacgccatcgccgaactcgtggccacatgcatgggcgaaggcaaaaaggtcctcgtgttctcgcaattcacctcgttcctcgaactcatcggcgccagactcgccgaacaaggcgtggaatactacaccatcaccggcgagacgccgaagaaacgccgtgtggaactggtcgacgaattcaacggcaacgacgtgcccgtattcctcatctcgctcaaagccggtaacacgggcctgaacctcgtgggcgcatccgtggtggtgcacgccgatccatggtggaacgccgccgcgcagaaccaggcaaccgaccgcgcgcaccgtatcggccaaacccaggacgtgaacgtataccagatcgtggccaaagacaccatcgaggaacgcatcctgaaactgcaggaaaagaaaaacgagctggcgcgccaattcaccgacggcaccgcatccggcggcgtcggcacgctcagcaaggacgatctgctcggcctgctgtcataacatgcccgctgtcgcggcgtgcgcagactgcgttccgaatcgcaagacgaaaacggaacgcaggttgcgcatatcgcatggcgggcgtatatatggacaagcaagtttcagggaaggtgaaaatccttactggcggtaacggcacgaccggcattcataacggccccataccgaagcccgcgacccgcgaaagcggctgatccggtgagaatccggggccaacggttacagtccggatggaagaaacggagctcaacatgagtgtatcctctcctagcaatacctccaataccgcagctgatcaggccgcagacaaaccgatgacccgtccggacaacgcgcactccacaggcgtcgccgactccggccgctggtccaccaaacgcatcgccatgtacgcgctgttcgtggcgctgtccatggccgtcagcttcatcgaattcccgatcatcccaggcgtgcagtggctcaaatacgacccatccggcatcgtctgcctcgtcgcgggcttcgcgttcggaccggccgcagccgtcatcgtcagcgtgctcggcttcgtgccgcacctgttcaccaacccatggggcaccctgatggccgtgctcgtggcattggccctgtccgtgccggcatcgctcatctacaaaaagaacaagacgcgcaagggcgcgctgatcggcatcatcgtcggcgctgtcgtggcgctcgccgtcgccatcgtcggcaacatcatcgtcacgccgttctacgcgcacatgaccaccgcgcaggtcgtggcgcttatcgtgccggcgctcctgccgttcaacgcgttgaagttcaccatccacggcgtggtcacgttcctgatctacaagccgatctccaacctgctgaaccgttgagcttcgtttgttcccattgaaatgaacatggagggaccgtccgcatccgccggagggttcctccgtcttgttttccccgagaattccatacagtgctggtgaaggaagattttatggttacgaccaatgcgccgatcataacgttacgcgatgtgcgattcacctatgatggcggcgcgacatgggcgcttgacggtgtgagccttgacatccgccgtggcgaacgcatctgtctgacggggccgaacggttcgggcaaatccacgctgtcacgtgtcatcgccggactggtggctcccgatgagggatatgtcgtattgtcaggcaatgtggtgttcgacgagtccggcgcgcacgccgacgagtatcgaaccgcccgttgcggcatcggcgcggtgttccagcatcccgaagaccaaatcgtcaccaccgtcaccgaagacgacgtggcgttcggaccggagaatcttgcgattgagcatgatgagatcggcctgcgcatctccggttcgctggacgccgtggatatgagcgactatcgcgcttccgatccgacgcgcatgagcggcggccaacaacaacgcatcgccatcgccggcatgctggcgatggattccgatgtgctcgtgctcgacgagccgaccgccatgctcgacccgcaagggcgcgccgacatcatgcgggtgctggacgaactccaggaccgcggcaccaccatcattctcgtcacgcaccatgcggacgagttggaacatgccgaccgtgtgattcagctggaagcaggccacatcgtaggcgatggccccgccgacgagcggcttcggatgccggttcaatcggtgggcctgccgaaacgcattgatgatgagtccgccgaaacgctcatcgaagcacgcgacatatcgtatcgttacgtggacgccgaacgtgacgtgttcaaccacctgtcgttcagcatcggcaaaggcgagacagtggcgttgatgggacgcaatggcgccggcaaaaccacattggcgcgcatgctgtgcgcgttggagaaacccacgacaggctcgatcgtcatcgacggcatcgccgtggccactgcgaaggcgaacggcggaacgaagcccctcaatcgcaaaaaccgtacgaggctgcgccgtacggtcggctacgtcatgcagcatccggaacggcagctgttcgccgacaccgtggccgaagacgtcgcatacgggccttccaacctgggattggatacgtccgaggcgatggaacgcgccatgcaggccatgcggctgctacatatcgaacatctgcgagaccgttcgccgttcgacctgtcgggcggccagcagcgactggtggcgatcgccggcgtgattgcatgcgagccgaaagcgttgattctggacgagccgaccgcaggtcttgacgaggaggccgccgcacgcgtgcacgggctcatccacgggctcaaatcacgcggcgtgaccatactgctcatctcgcattcgcaggatgaagtggacgagcttgccgaccgtaccatcatattgggcaagccggcgaaacgtgcggactctaaggaatccacggaatccacagtgaaagccacctgcgaagaggagccggatgcggaaccatccgtggacgccgccggctcggacaccgcgaccgtgggggagcggcggaccctgttggaacgcctcgatccgcgcgtgggcatgctgtccgcattggcgctcatgttctccgcgttcgccatcggctcattctggcaattgctgcttgccgtggtgttcaccggcgtgatcgccgcggccggacgcatcaatgtaggccgattggccgcttccgtgcgtgtgttcctggcattgttcgttttctgcggcctgctgaacatcttcttcgtgcgcaccggcaccacggtggcgagcctcgggccgattcccatcaccgatgacggcatccgcatcgccctactctacgcatgtcggttcgccgtggtcatcgtcatcggagcgatgttccttgcctccaccacaccgaccgccatgaccgacgcgttcgaatcgctgctgtcaccgttcgccagattcggtctgcacacgcaggagacggcattggtgatgagcctcgccctgcgtttcctaccgacgcttggtgtggaaacgaaagcaatcatcgacgcgcagtcggcgcgcggcgggagcgtcgaaacaggttcgttcgtagtacgcatcaaagcgatggtggcggtcgtcgtgccggtcttcgccgcagccatccgccacgccgacaacctgagcctcgccttggacgcgcgctgctatgaggaaggtgcgacgcgcacgcattggcgtgtcatgcgcgtcaccggcatggacgtggccgtggcgatcgtggtgctcgtctatctcgtcgcactggtcgtgctgggcgtgctgttatgaccggtgcgttgcgggcggatgggcaaataccgtcctcacgctaggcttgagcgggtatttgtagataggaatggaacacatatggcacttaccaaaaagcaggtcaagcagctgcgcggcctggccaccaaactcaatccgctcatccaggtcggcaagaacgatctgagcgaaaacgccgtcaaacaggcggacgagaccatcgagaagcgcgagctcatcaaatgctccgtgctcgacggttccggtctgaccgccaaggaggccggcgaaggtctcgccgaacagcttggcgcggaactcgtgcaggtcatcggcaaccgtttcgtgctctaccgtcgttcccagcgtgacgacgtggagcacattcgtctcgtgcgcgaatagcgagccgaacgttatatgagaagcggcccgccctccggaaccaatcggaaggcgggccgcttcatatggaaataaacaatcggaagagagcgtgccggagaatcagctctcctgatcccattcgggcttccacgtgtactgcatgtcgtacgcgctggaccagaacatgtactcgttctcaacgccggtcacaaaaatatcgaccagctcctgcttacgttcctcgctcacctcggcggcgagtttttcgatatgctcgatcagccaagccgaaccctgccagaactcgtcggtcttgtacatgtccacccagctcttgtactggttcacatcgagcgtgtcggcgaattcatgggcaagacgatatccgtaatccgcatacacccaggcgcaggggagcacggccacgagaatgtcgaggatgtccttgccataggcgatggaaaggatgttcgacgtgtacgcgcgggcgaacgccgactggcgcacgttgttcatctgctcgtcggtgatgccgtagctggccagatacgtgcggtgcacggtcgactccacattcaacgcgccgttctgcacgttgagcatgaacaccatgatctcaggatcgtctgttttggccagtcccaaagcatgcactctggcgtagtcgttaagataacggaaatcctgcagcagatagaacgcgaacttctcgcgcggcagagtgccttcgcccagttcgcggatgaacggctgcctgtagccttcctcccatacgaggtcggcggctttgcgcagccgctgcgcgaatgggggaagattggttcgcgtgacgcccttcgaagcgtcgaacgcggaatcggaattggttacggaaatcacatcagccatatggccatgcctccctacgctggtgtcaaccatcaggttcaaagggttcggacgtccacgcccatctcaatccgtcatacggattcccctgcatacgcggttcattatggcaaacaagttcgtgccgtgcaaggttctgtccatatttgtcgcggattatgcccgtgctcggctccatatcgaacatggccgatgtgtggttgagggccggtgcaagaatggaacgtatgactgaaaagcaagttgcgaagaagaccatcgaaaagctggctatcgtcgtggtgacctacaagcgccagcagctgctcgccaccctgttcgaatccatcgagaagcttaccgtcgccccgtggcgcatcatcgtcgtggacaacgagcacagcgacaagacccatggcatggtcgaagaattcagcgccaaactcaccgcgcagtggggcaccaccgtggccgacctgtccggcaacgagaaccgcgtggtctacgcgccgcagaccgacaacctcggtggtgcgggcggtttctccgcaggcgtgaagaaggcgtacgagctgggtgccgaatggttctgggtcatggacgacgacgtcgccgtcatgccggaaggcatcgagcgcttggccaagtggaccgatcggcacgacgtgattcagggaagccgctacgactatgatggcggtccgttttactggcagtacgatttcatcgtcccgctcggcattccgaacccgatcgcaccggctgcgttcggcccggctggctatcgcgtgatggacacgttgtgcttcgaaggcggcctgttccgccgtaacatcgtcgagaagatcggtctgcccgacccgcgtttcttcatctattgggacgacacgatgtacggctatcgtgccagcaaggtcaccaatccgatcgtcgtgcccgacgtggtgctgcgccgtacgcgcgagatcggcaattgggacatcgccggcgtgcgccagctcaactccacttccgacatgaaccgctaccacatcatgcgcaaccgcggctacatggcccgatacttcatgacgtacggcgattaccgtccgctgttgttcggtctgggtacggtgctgaccgcggtcaaggaagtgattcgactgacgatggtggaccgcgagcatttcaagaccggcatcgttcagatcgccaagggatggtgggattcgcgcaagctgctgcatgatccggaatggcagccgatgccgccgctgaagtaacaccgtggcccacgcgtttcccaacgcgcggcgatcacgcgattgacgattcgtcccacgtcggagcctctaccgacgtgggacgaatcgtttgcaaaacaggcgatgaaatatttactcggttaagtattacaatttgtgcaatcgttctcaccatttgtgcatgtcgcgcgcgattttgggcatgttgcgagttaccataatacgtaccggttcgaatacacccgtaacataccttgatagagaggttgaagatgattgagactgcacaggcattcggcgttgacattggtggctccggcattaaggccgccccggttaacctcgagaagggcgagttcgccgaaccgcgtctgaagatcctcaccccggaggtgtccactccgaaggccgtcggcgaaatcgttcgccagcagctcgagcatttcgaggttccggagtccgctccggtcggcatcgccttcccggctccgattcatgtgggcgagaagcttggctacatggccaacctggaccagtcctgggtcggcgtggacgtcaccgaagtgttctccgaagcttgcggtcgtccggtcaccgtggtgaacgacgctgacgccgccggtcttgccgagcagcagttcggcgccgcgaagggccaggatggcctcgtcatcgccaccacgctgggcactggcatcggcaccgcgctgattttcaacggcgagctcattccgaacaccgagctcggccatctggaactgctcaagggcaagggcgacgcggagaagtacgccgcatcctccatccgcgagaagctcgacatgggctacaagaagtgggcgaagcgcctgaccaagtactactccctcatggagttctacttcgacccgcagctgttcgtcgtcggcggtggcgtgtcccgcgtctccgagaagttcctgccgtacatcgacatcaagaccccgatcgtcgcagccaagctgcacaacgaggccggcatcatcggcgccgcatactacgcgagcaccaagcagaagtgatgtgttgaccgattaggttgtcaaaaggccgtccgacgaatcggacggcctttttcgttgttccatgtgccgcagatggaagacggcagtccatggagtagggtggagagcatgcgtttttcctcaagagtcgacatcagtgagctcaatcccatcgccaaggcggaagccaccgccaaaacagccggcagaccgctcggcaagctcaacgactccaatccgacacggcacgcgctggctccggatcttgtgccggacatctactccgccgacccgcgcggccaacgctacgcgcgtgaggcgctggccgcgttccttgacatgcaggaaatcggccattgctcgccggacgacctgtacatcctcagttcaacttccgaagcctactcgtggcttatcaaactgctgtgtgatgccggtgacgccgtgctcgcaccgaaacccggctatccgctcatcgaatcgatcgcacgcctcgaatgcgtcgacatgatcgaataccaacaacgattcgacggctcctggtatatcgacgtggccgaactgaaaaccgcgctggaaggcccggacggcaatcgcatccgcgcgctggtgctcatcaaccccaacaatccgaccggttcgtacgtcaaaccgtcggaacgcgaggcgatcgtccgcctgtgccgggaccacgacgtggccatcatcgccgacgaagtgttctacgattacgatttggaaccattcgaaggcaacgcacgactcgcgggggagcgtggcgcgctcacattcgcgttggacggtttttcgaaaatgctcgccgcaccgcatgccaaagtcggctggatccaggtatcaggtcccgccgaagacgtggcggaagccaagcgtcgtctcgacgtgatcgccgacgactatctgcccatgagcgagatcgtcgcaaaacaaattcccgcactgcttgaagcggcgccatcgcagaccgcgcgcgtgcaggaacgtgtgcgcggcaatctcaaagcactgcatgccatgctcgacgcggatgagcaaggtcttgtcagcgtattgcgtgccgaaggcggatggaacgtactgctgcgcgtgcccagcgtgctcgacgagaacgagctggtgctgcacatgatcgaacgccacggcgtatccggacagcccggctacttcttcgacatgacctccaacggctatctggccatctcactactgcccgaaccggacgatttccggcataacgtgcacgtggtgatcgacaccgtcaacgaactgatcggctgaacggactgccgagtccgaaatctcttctacgccctgtcgcccttcgccgcctcatacttcgaacgaaccaaatccgtgtaaaaatcgaccgcctcacgaggcgcgccgtcgaacaccacacgatggtcgtcgacaacgagcacgcggccgatcgcatattccggacggacgatcagatccgtgtcatgcgtggcgaacaccacctgcttgtcatagctgaacagggccttcgccacgcgcgtcgacgacacctcgtccaatcccttggtcggctcgtcggcgacgatcgcagcgggggagaagctcaacgcggccgcgatcgccagcagatgccgcttctcgctatccaaagcggaggccggctcgcgggccacggaagccaagtcgaaatgcgcgaacagattgccgatgatcgcctgacgttcgctttccggcaccttgtgcttcttcaacggcaggtcgatcgcctcacgaatcgaagccgccttgtagtaggcgttcggaatctcttcgcgccgcacgcggccgaccagatcctcgacatgcttcagatcgcgtttcacggcggggtcgtatgcggtaccgtccgcttcgatgcgggccgttccggacgtggcggtcaacgctccgtccagcaacttcagcagcgtggtcttgcctgcgccgttcaagccgattatcgccacacgcttgctgtcaggtgtgatatcaagcgtggtggcttccaagccgatattgccgtcctcgtacatgtgggcggcctggtcgagatggaacgtgacggacgaagccggtgtggaatgtttaccggcgaacagcgaatcgaagaaacccataccgccgattgtaacgaaccgcaggcgcaaccgcgcgcaggttcaccggcagttcatccgaatcgtccgtgcccgcatgcgtggcggacgccttgtaatcggcgaacaggctgccgaaatccaacagtcgcgtcacactgctggtttcggcatcgagtttgacgatttggtcctgcacggcgttgtcgtcgcggcccagttcggtggtgagcagcacgatgtcgcctttggcatccgacgtgcggcctgaggatggttgcgtggcggcgaaagcggtttcatggtcggcgacccccggaacataactcaaagcaacaatgatgacaatcactatgattgccgatgaaactcagagcaaaccggaaaaactgctatatgaatcaggaaagaaacctgaatttttactggatgtagcttatgtcggacgtcaacccaacatgaaccaggactgcacgtcgagatagagggcgggattgttgcgcaacatctcatcgtcacgcccgggcaggaacaacgacatcagcgcgacaaccagcgtgaacagcagcagcgcgaggaatccggcacgacatacccaacgcagacgcggcttgccgcaatcaagtacgatcagcaacgaaggcaacgcggccaaggcaaacagccatccgaaatcggcgatgtaccgccatcccaaaccagccatgcgggagtcaatcaccacaagcagcaatcccaatgccaggctggatgtcaacaacagccatgtgttcgtgcgcccggccttgcgcatacgccggtagaggaacgggcaggccagcgcggccaacgtcaacggagctatcgtgaataagccgccaggcattgcctcggtaaatccccaagtgggaagaggcgccggattgacggcgaggaacggaaacgcatccgtgaaccgcaacggcaggaacaggtaatatgcgacggtcagcgcaagattcgacaatggctgccgataactggtcatatccgtgaccgtcatctgatatgaggtgccgaagtcgagcggtgatccgaaccggaccacgttgtacgccagcagaggaacgatcacaatcaacgcgggaagcaatgcggccaacggcgcgcgcatcagacgccagaccgacatatggggaagggaggaatcattggaggcgtgacggaaaatcgactgaatctgcggccagaatattacgaaagccagcaacgccacgagaatgaactgcggacggcaccccagattggccgcaatgcacatcgagcctgcagccagatggggcaacgacaacgactgcgtgccatcaacctcacgaatccgatcgcctgacaccggcacccgcttggcggcgcccaaccacagccacaatcccaacacgctcagaaacagggaggcggcgatcggcaccgaatagaaattcgtccgataccacagatacaaaccattggaagccaacagcatgaacacgcacagcatactgaccgcagccaacggcgcattcggacgaattcgggatatcacacgaatcaccagcagacatccgaataccagaaaaccaagcatcagcagcggcacggccgcaccgcagggcatcatcagcccgccatcgacgaacaacgatgtgaccgcccgatacggcaggaacaacaacaacgcgggaaccacaccgaaatacgaataccagtgcccctgatagaacgcgtaatcccaatacactgggcttacgccatcggcaagcaaccgctgccgggtggccacatcatacggatccgccgcgtcacgcaacgcatccggcacatccaaatccaaccacgcgtgaccatcaagcagcgcccttgccacgtaatcgtactggtcgaaatcatacgtgtacgtgcctttcgtatggaagctcaacggagccgcctccaccagctgccacaccacaacggcacaagtgaccacaacaggcaccgccagcagcgcccccagccacgcacgctgcctcacactcgtcgtatccaacggcatccgccacaaccgcgaaccaggcctccacaccagtaccatcgccaacacggccaccatcacgccgatacgcaacggattcaacgcgaacggtacacgcacattcgcacgcaccgcatcaaacggaatcagcgaacccttcggctcgacaatccgcacgcacaccgaaccacctgcagccgccgcatgcacatacagcgaacgcggcgaagacaccgacaccgaactgaccgtaccggccctgcgattgacatcaggacggacacgaaccgtgcgcaacacctgctccgattgtctggctgccttatccaacgccttcgaagacaccgggtccatacgaacatattccgacgagccatccgcatcgacctgcatatatgcctgcgtcggatcggtgaccttcaacaacccctcgtcagtacgttcgagcccagggcccagcacgttgtacgcggcggcggaatcacccgatgcggtcaaggaacgccaaaacggcatattgcacaacacgcactcgaccgccaccatcaccgcgaaagcgactacaatggctgcgcacatacgacgacgtgcctgaaaacgctgcttcgaaaaagtcacgtcattattctaatagcttcatgtcgcattggattgaaagaatggcacacatgtctcaccgcacaccatcagacccggccagccaaccggaacataaccggaccatgctcgaacgcgtcaggcaaaatgtgcggcgactcgtcaaccaggccacgccgcgccacatccacgccaaccccttcggcaaggcgcttgacaagcccgacgacatcgtcgacgaactgacccgcaacgccatccggcttaatccgctcatcaaacgacacatcatcgacggattcgaaggcgtgcccggaggattccgcctcggatgggcccaactgccgcagacccacggccatgccttctccatcggattgttcaccgacagcgaccacttcgcccaaatcgcgctcgcggacggcaaagcgcgtgtcttcgccggcaccgatccggacatggacacgcaggaactcgaaccgcggttcgtcttcgtcaaagaggaaacccttacgttggcggacggtccaagactcggccatgcggccagccgcaatccgaaaacggtgcgcgccacgcaaggcggcgtcgtgggacgcatgccgggcggtcgcatgatgtggctcgcctcatggctcaaaaccggcagccgttacacgcttgagcaaatgcgcgccaacctgccagcgaatatgcggttcgacctcgaatatcgggacgccatcaccatcgccttcttcgccgcctacatgctgccacagatgaacggcctgctcgtcggcttcggttccggcaacattttccgcaggctcaaccgcgaagcgcccataggcgccatccgacggtccatcagagacaccatgagcgcccggtcgcatggcatgcgcgcctccggcctggaagactacttcgccgatctgatgcgcgaagcccacgcgctcgataccgatcaagggctcgaagctgtgcacggagcggaaccgctgcgcctgtacacatccagctattccggatgctacttcttcgcatgggattcctccctgccgttctcggcagtgctgtgcgccctcaacatcgagggcaacctcaaccgcttcgccgccgtcagctcatggctggaacgtaacgcacgcatcggcactctccccacggaggacacggtgacgcgtgccgaagccgcgcagatcgacttcgccctgctggagaatccgacgctgatcgcgttgaaaccggacgaccggttcggcgcgatcctcgacccgaaccgggaagacggcatccaggccgccagccgactggcggatatcgcggccgacttccggcgtgaagtcgctgaatcaaccaaggacaacgtgttggaaggcgattccggcgccgacggaggttccgaatgggtgtaccggcagaccatgtcccgtctgctgcgcagcctgcgtctgccataccgtttcgacgttgacttccggtgcgacctcagcgacggcgaagtcgcaatcggcttcacttctgctggagtgtccatgatgccgttcacccgatacgacgtatcgcgccgcgcgtggatcgacctgaccgacgtcgaacgcacgcgtatgagcgtcgattacaatctgcgcgtcggactcatgatggccgcgctgagcttcggagccgatccgaatgtcaaacgcgtgtcgatgcacatcgattcgattggtctggaagaggccgtagccgaacaggattccgccatcagcgagttgatgagcgaggcgttaagcgccttcgaacgcatccgtaccggagacatgaggccatccggatccaaagccgctccaaaggacggcgactaccatggcgatccggctcggcccgtcactccgagaaccaccgatatctcatccgaatcaatcgattccgacgattcggctggctcggatagcgttggcactggagacgatacggtggacggccagttcgaagacctgatgaaagacatcgacttcgacgaaatggcgttcgcggtaccggacggacgcgccgacgatgacgacgcctccatgcgggacgacgccagcgacaaaacggagtacgacacctacctcgatgatgatgacgacgatccgatggcgcagctgcgcaaaaacccgaccgtacgcaacttggtgaccgtcaccttcacccgcgacgagttcctgaagcggctcgacactgacggattggcccatccgaccgccacataccgcatgttcgacgccgaaatggacgtggacggcaaaggcgcgctcaaacccatcgacgcggccttcgaccttcgtgacagccgattctcaccggcgggaagccaagaagaacccgaactgtccgacattcgttttgatgacggcacggcgcagttgttcggctgtgagaacatgatgggcctgtccatccagcgtgtcgacctgttgcagcgcgccgtgggggagttccatcgtcttgcgcaaagcgacggactcgaatcggtggccaaagccaaacagtccatggacatcatcaattccatatccgatccggaattgaccgaattggcaccgcaggtcaccagcgcgctgatcgacggcgaagacacgcccgacttctcattcgaactggcacaatccctcgatgacgaacgtctgaaggcacgagacatgctgttctccggagacgtcgagcgggccatcgaatccgcccagtccacactcgaacgcatggaccggatcttcgctgaaaatccgggcgtgccgcggtacttcaattcatatgcggaacgcgtcatctacaaccgcatgttcgccaccgaaggcgaaagaacggtgctcattcccgacaacctgttctacatgcatatggagcttgccgacctgctcgcccaagtcaaaggcgtcgatgccgcgctgccgcatctgaacgccatggtgcgttacgcccccgcatacccgctgtcgcacctcaagctcgccgtgcagctggggcgtgccgaggactgggatccggcacgtgcggcatgcctcaacgcgctgaacgtcgcgcttgaccgggaagacgcctcattcgcctactatcgcctcgcctatgcggaatggatgtgcgaccacttcgaccttgccgccgcctcatacatcatgagcgaggagatcgcccccggacgtatcgccatgctcgaaagcgaactgcaggaactgatcggaagagcgcaatcgcagtgcattccggtgccgaccaacgtgcaggaagccatccacgtgctcgccgacgccggactgccggtatggccgaacacgccggtcgcgcccctgatgcaccaagcggcccgcgtctgcgtggacaaaggcatgttcgtgcccgcacgcaccctgtcggtggccgcgatgcgcatggattacgaagaccatgacggtgccgacgtggtgcaggtgcagttcctgcgctctctgaacaactaacaaaacggtcgaacatttgtgcgataatcggtgctggcgtggacatccgcgcggcatggcggaaatgatgggaaagcggtgacaatgacgaatcgtgatgattccgaacagttggcatgggatttcgacgcgccggagagcgacggtagttccgcggccgtcgtggccgatgaggggctggcttcgctgactccgggcagcgaacgttggattgccgcgttgcagccgaccgatgccgacgccatgcgcctcgacaaggttgatgtggcttcgatgagcgccgaagccgcggccaggctgtgggcgcgcgtggccgcatgggtggaatcagaccagatcgcatactatatcgacgatgcccccgtctcatccgacgcggcatatgacgcaagattgcgctgcctgcaatcgcttgaggcgcagttcccatcacttgactcaccgcagtcaccgacccatcgtgtgggcggcacgttctccaacgacttcgcttccgtacgtcatccatcgcgcatgatgagcctcgatgacgtgttctccatcgaggagctgcgcgaatggtacgacggcgtgctcaggggattggattggcccgaatcgaagccactgcccatgacctgcgaggtgaaaatcgacggtcttgcgctgaacctcatctaccgcaacggcgtgcttgaacagggtctgaccagaggcgatggcgtgaccggcgaggacatcactctcaacgtgcgcaccatctccaccattccgcagaaccttgccggaccggaggaagacattcccgaattcgtggagatccgcggcgaagtgttcatgcgatgggacgatttcaacaagctgaacgccgagaacgaggacgccggtcgcgcgccattcgccaatccccgcaacgcggccgcaggtagcctgagacagaaggatccgcgtatcaccgcaacccgtcgcctgagcttctacgcgcacggcatcggatcgctgcgttggggtgcggggcacgccggcaacggccatgatgtggtcaacgaccaatccgaagcctacgaattgtataagaaatggggtgtgcccgtctctccgcacaaccgtgaggtcacgtcgttcaaggaaatcctcgacatgatcgactattacggcgaacaccgaggcgacatcgaacacgcgcttgacggcatcgtcgtgaaggtcgacgatttgggattgcagcgttcccttggtgccacatcgcgtgcgccgcgctgggccatcgcctacaaatatccaccggaagaagtcaataccgagctgcttgacatcactgtgcaggtggggcgcaccggacgtgtgactccggtggcggtgttgaaacccgtgtacgtggccggttccacagtatcccgtaccacgctgcacaacccctttgaagtggaacgcaaaggcgtgctcatcggcgacaccgtggtggtgcgcaaggcgggagacgtgattcccgagctcgtcggtccggtgctggagcgacgcaagggacgtgagggccagatccgccggttcgtgatgcccacgcgttgcccgagctgcggcgcggaactcgctcccgccaaagagggagacaaagatatacgctgcccgaacgtggaatcctgcccggcgcagctgaccgagcggatcatcaatctggcgtcccgcaaggcgttcgatatcgaacatctgggcgaccaatcagccattgcgctgacgaatcccgaagaggacaggcccgattccatcgacacgtatgcgccgaacatcaccgaaatcgtggtgaaacccggtgaggagcctgaaccgtacgagccggtggcaggactggaactgccgcccatgcagacacctgtgctgtccagcgaggccgggctgttctcgttgacgtccgcagacctcaaggatgtgcgcgtctggcgcgaggccccaatcatcgaaatccacgagaccgtcgggtcaaacggcaagatcaagaaagtgcgcaaacgtgtgggcggatccggattatggcatcaggtgcccgcattctggaccgcgcctaccgccgcccgcaaacgcaaggaagccgacatcgacgagaccgcggaatatccgcaatacgtggtgccggatgacgccgtggtgatccgcgaggaaatcaaggtatcccgtggaggcacgtccagcgtgcagccggtgtacattcgtccggcggaaaacacccgcaagatgctcgacgaaatggacaaagcccgccatgccgacctgtggcgcgttctggtggccctgtccatccgcaggctcggaccgcccaccgcacgcaccatcgccagcgcgttcggtacgttggatgccatcgaacatgccagcgtggacgaattgtcccaaatcgacggtattggtccggaaattgcggaatccgtagtcacatggttcaccgcggcccgtgagccgggcaattggcgcggtgccgtgcttgacgcatggaaggccgccggcgtaggagtcggacaagcccaagccagcggactaccacagacattggcaggcaaaacggtcgtggtcaccggctcgttggaaggattctcccgcgattccgccaaagaggccatcgttctgcgcggaggcaaagccgcaggatccgtcagcaagaaaaccgattgggtcgtcgtaggcgagaatgccggctcaaaagccgcaaaagccgaggaactgggcatccccatgctcaacgaagaccaattcaaacagctgctcgacacaggaacagttgaataatcgccacaccatctggcaagccgtgccgcgaaccgctactgtggtacgcggcataaggaggaagcatgagcgacgagcacaccatcgaagcgcgcatctacgaacggctaagcaaagtgattgaccccgaactgggcaggtccgtcaccgacttgggcatgatcgcagccattgacgccacgccagtggcaggcgaaaccaacacgtacgacgtacgggtgcgggtcgaactgaccgtggaaggctgtccgctgtcgcagaccatcaccaaccagatcaacggcgcggtcgcctcctatcccgatgccacgttgattcccagcatcgaagtcggctccatgagccaagacaaactcacccagctggtggccggcctcaaagcggaacgtaaacagaacccgttcaacaaacccggcatcaaaacccgcatcttcgccatcgcctccggcaaaggcggcgtgggcaaatcgtctgtcaccgccaatctggcagccacattcgcggcgctcggctacgataccgccgccatcgacgccgacatctacggtttctcgctgcccaggctattcggcgtgcaatcacagcccacgaacctcaacggcatgctcatgcccgtcaccgcatggggtgtgaaactgatctccatcggcatgttcgccggcgcggacagagccatcctatggcgtggtccaagactgcaacgctccttggaacaattcctatccgacgtatggtggggcgaaccggacgtattgctgctcgacctggcgcccggcaccggcgacatggcgatttccgtggcacaggcactgccgaacgccgaactggtggtggtcaccacaccgcagccatccgcctccgacatcgcggtacggtccggcctggtggcattgcaggtgccgatgaaagttcgcggcgtcgtggaaaacatgagctactacgagcacaaaggcgagaagctacgcatcttcggcgaaggtggcggcgcacgcgtatccgaacagctgacccacagcctcggctatgaagtgccactgctcgcacaactcccattggagcctgaactgcgcgaaaccggcgaagcaggccggcccgcagtcctaaccaaagagggcgcgttgcggtcggacggtatcggagaaacattcaggaatcttgccgaatcgctgatgagactgcctcaataaaatcaccatacggttggagcgttcctccaaaacaacacatcggaatgcgactcagccacggaatacggaatccgttatgagacaaaaccgacgtaaatcgtgggtcctgtgtaatatcaggcgcagacacgggggccgaatggctgagaggaagcaaccgcttcaaccgtatgaacgtataccgggtaatgccggcgcacggacgtctctctatttcccgtgccttgacgaaaagagaaaggcacatatcccatgactgaagaaaaccagtcttccgcagttcgcaaacacaacaacaagtggcgcgtggtcgatatcgtcgtcgcagccatcatcgccgtcgcatccggcgtgatcttctggggctgggacatcgtctgcaccgcgccgctggccctcttcgaggcggtgactccaggcttcgaaggcctgcttaacgctttctggctgttcgcaggccctctggccgccatcatcgtgcgcaagcctggagccgcactgttcgcggaaaccctcgcggccgcgctcgaactcaccatgggcaaccagtggggcgtcggcggctcgctgatcgtcggcatcgtgcagggcctcggcgccgaaatcggtcttgccatcttcgcctataagaagtgggacctgctgtccaccacgatctccggcgcacttgcaggcgtcggctgcggcctgtactactggcttaccaatccggcttggagcgcgctacgcgtcagcatctatctgattgcctccgccatttccggcgcggtgctcgccggcgcggtgatgtacctcctgcaggtggccatcgccaagaccggcgtgctcgaccgcttcgaatccggtcgtacgcaggaactggtctgattgtccgatgcaagcaaatcccgcatcacatcaaggtggtgcgggattttcttgtgatggcgcatcgcatgacaacggcatacgaaacaacagcatgacaatcagaagaaagaacgacgaatgaccactgacgttcagaacacaacagcggccggcgtgaccgcacatgattggggatggagacacgcctcacgtaaggatttcgcgctacgacacgtcgacttcgacatcaaaccgggggagcgggtactgttgcttggcgcgtccggcgcaggcaaatcaaccctgatgtccggtttggccggcgtgctcggtggagatgacgaaggcgagcaggaaggcgagctgctcatcgacggcgtcgacgccagacaagcgcgcggacgttgcgggctggtgcttcaggacccggactcgcagacgattctcgaacgtgccggagacgacaccgcattcggctgcgagaacctgaacctgccgaaagatgaaatctggaaccgggcacgagccgcccttgacatcgtcgggctcgactacatggcgttcgaccgctccacacgaggactttccggcgggcaacgtcagcgcctcgccttggcgggcgtgctggccatgcaccctggcctgctgctgcttgacgaaccgaccgccaaccttgacccggacggtgtcaaggaagtgcacgacgctgtccgccacgtcctcgaacaaacccatgagacgctggttgtggtggaacatcatatcgacgtgtggctcgacctggtcgaccgcgtcatcgtgctgggcaaacccgaagccgattcgaacgtcggcggcgtaatcgccgacggcactccagacgaagtgttcggccacatgggtcaggtgcttgccgacggcggtgcgtgggtgccgggccgcaccatcgaaagccatgcgcccaaaccggaacaaatccggcaaccgcaggacgtcgtgctttacacgcgggatctgagcttcggctatgatttcccgctcggcgagcatatcgacatcgaattccattccggtgaggtgaccgcgttgaccggcagaaacggcgtgggcaaatccacactcggactcactctcgcaggactgctcaaaccgatagcaggacgtgtatgcatggcggacgatctggtacctccccatcgcgaaaacaatgtgatcacatggaaaagccgcgacttgctgggacgtatcggcatggtgttccaagagccggaacaccagttcgccgcatccaccgtgcgagacgaggtggccatcggccccaaatccatgggcaaaaccgacgaggaggcgtattccatcgccgacaggctgttggaacgcctgaatctttcccgcttcgccaaagcgaatccattcaccctatcgggcggtgagaaaagaagactgtccgtggcgtccatgctggctgccgcgccaaaagtgctggtcatggacgagccgacattcggacaggatttcaccacgtggaccagcatggtccaattgatctccggtgcgcgcgaccaaggttgcgcggtcatcatgattacgcacgatgagccgctcatcgaagcgctgggcgcacgccgtattttggtcagagagggggagtgacatgctcgaaaccaacaaaaacagtgggcgcgacggcaatgaaaagctcgaaaccattaccgtggtgccacacaaggaacgtcgtaacgaaacgaagccggcgtcaccgtcatggttcgtggcgaaaatcaacccggtaagccgtttcatcggtgcgttgatcctgtgcattccgatgttcttcaccctcgatgtcgtttcggcatccgtggcgtttggtttggaaatgctattgttatggatcggcggagtggctccttggacggtcttgcgcaagacatggccggtatggatagcggccacaggcagcttcgtttccgtggcgttgtacggcaagacatccggcacggtgctggccaagctgggcggcatcatcgtcatctcccaaggatcgctctatctggcgttggccacattcctacgtgtcgccgcaatcgccgtgccgggtgtgattctggctttgggactcgacccgaccgatctggccgacggactcgtgcagattctgcgcctgccgcaacgtttcgtatacggcggccttgccggcatgcgtatgttcacgctgctgcaggacgattggcgtgcactcggccagtcacgccgctcgcgtggcctcggcgacggcagcaccatcaaacgcgtcttctcgcaagcattcagcctgctcgtcgtatccatccgacgtggaacgaagctcgccaccgccatggaagcgcgcggattcggatccgacgcgccacgaagccaagcgcgcgaatcgaaactgcatgcggtcgactggctgttctacgccatctgcatcgcggtgccggcaatcgcgttggccaccgcatactacaccggctactggcattgggcgttcagcaacgtgtccaactaatggatgatgattccccaatcggcagctaaatgataaagctctctgtcatacgttccaatcggaatcgtatgacagagagctttatcctatttcggcaagccttacacggcttcttacttggcgagcttatccagcagcaacgcttcggtgatgacgttgttcttcaacgccggcaggctgatggactcgttcgggctatgcgcgttggccttcggatcctccggaccggtgaccagcacctgcgccttcgggaagatgcgctgcaattccggaatgaacgggatggaaccaccctcgcccttgttgaccggagccacaccgaacgcttcctccatggcgtccatggcgtccttggtggcctcagcgttcggatccatggcccagcccatgccgttgtcgagcttgtcgacccacacttcggcaccgaacggcgcatgctccaccatgaacttggccaacgcctcctgggcctcttccgggcgctggttcggcgcggtgcgcaagctcagacggaacgtggtttcaggagagatgacgttgaaggatccttccaccggatgcgcgtcgaacccgatgacggtgacgctgggcttcgtccacagacgcgcggcgagcgaaccggtgccggcaagacgatacgattcgacgatgcccgcgtcggcgcgcacagtcgcctcgtccatatcacgctgcaggccgccaaccggttcctcggacgcaacgcccggcacggccaaatcgccattggcgtcgtacatggaggaaatcaacatcgcagccagcgtgttcgcgtcaagaatcgggccgccatactggccggaatgcaccggatgttccaacgccttgacatgcacatcaatatcggtgttgccacgcagcgacgtggtcagcgacggaatctcagcggaccagttgcccgaatcggccacaatgatcgcatcggaagcgaactcgtcccggtgctcttcgatgaacggaatgaagctcggagaacccatctcctcctcgccttcgatgaacaccttgatgttcaccttcagatcgtctccaagcgctttcagcgcaccggaatgaatggcgattccaccgccgtcgtccgcggctccgcggccgtacagacgcgtgtcgatttcagtgccgacgaacgggtcggtgttccacacgttcggatccggcaccggctgcacgtcatggtgcgcgtacagcagcaccgtcggcgcgtcctcgctgacgtttttggaaccgatgacctcccaagcgcccggcgtgccgtcgggattgtgcgactgcaccaccttcgtatcgacaccaacctcgcgcagcaggtccgccacgaattgcgcggaacgcttcatatggtccgcggtgatgcccttcgcggaaatcgactgcaaggcgatcttctggttcaacacgtcgacgatgcggctgaaatccgactcgacgcgcgtgcgaatctcttcggctcctaaagctgtcataatccttgatgctccctatatatgcgtgtgtattacgcggattgaatatcgtgtgacgaatgtccattgtatccgttctttgcagaccgtccgaccgcagcttgaatcgcagcttgaaccgcaacgcagacggcaccgcgggcggcatcgagcgtcgatacgtcaccttacgctctataggcatgagtttgtttaccaagaaggaagaaccggcgcaggagaacgtcgagagcaaggctgcacagccgacctccggcaagggccgtccgaccccgaagcgcaaggacgcccaggcgcagaatctccgtccgctggtccccaaggatcgcgacgccagccgtaaggcggccaaggcccgtatccgcgaacgtgagaacgccgaatacgatgccatgcaaagtggcgacatcaaccacatgccgaagtcggaacgtctgccgtggcgcatctacatccgtgactacgtcgatgcccgcttcaatctgggcgagttcttcatcccggtcgcgttcataatcctgatcggatccatggtcgtcacctacaagtggcctgcattggcgttgccgctcatgctgatcatgtatgtctacttgttcgccgtgattatcgacgtggcggtcatgtggcacaagctcaagaagaagctcatcgagaaattcggtgagcagtccgtggccaagggcatgcgttccggttcctatgcgtggagccgtgccatccagattcgccgttggaggcttccgaagcctcgttacccgaagcgtggacactggccggagtgatcggtatcgagaaccgccggtgatttttcaagccgtcagcgaacaactgacggcttttccattaccatggaaaacgattgctcgcatcgaacaaaagctcacttcacgtgcgtgcaaacgaatcaatgaggaacgaattgggattcaatatggttcaacagcatttcgacatcgctatcatcggagccggccccggcggttactctacggcactgcgtgccgcggaactcggcaaatcggtggcgttgatcgaacgtgacggtacgctcggtggcacatgcctcaaccgcggatgcatcccatcgaaggcattgttgaccgccgtgcatagcgtcgaaaccatccataacgccgaacgcatgggcatcaacgccacgctgcagagcatcgatttcggcagattacgtgatttccgcgtctccaccgtggaaacgatgacgaaagggctgacgggcctgctggcgcatcgcggcgtcaccgtattccgcggttgcgcggcattgcagaacgcgcatacagtacgtgtcacgccggctgagggggagacgcaggtatcgcggtccgtggaagccggcgtgttcgaaccggttgaaacggaacttgcgatcgatgccgacgacatcgtgttggcaaccggatcgcgtccgcttgcgttgcctggaaatccgttcgccggcgcgctgatcgattccacccaggcgttggagctgaataccttgccctccagcgcggtgattatcggtgcgggtgcggtggcattggaattcgcgtcgctgtggaatgccgccggttgcgaagtgacactgctgattcgtaaggaccgcgtgctgtccacatgggaacgccgtgcttcgatgatgctgacacgtgagctgaaacgcaggggagtgaacgtgatcgcacgcaccgcggtggaccgtgtcgacactggcgcgaacctaggggccactgtgcactatcggcagggcgattccgatgaggaccgcaccgcttacggcgaagtggtgcttgccgccatcggacgtgtgcccaataccgacgccgactggttccgctccagcggcctgaagctcgacgaacgaggatacgtgaccgtcgacggatacggacggacgaaccttgatggcgtgtgggcgctgggagacatcactccaggtcatgcgctggcccaccgcgcctttgaacaaggcatcaccatcgctgagaaaatcgccggagccgatccaaaacccgtgattgacgacaccgtgccacaggtggtgttctctttccccgaagcagcaagcgtcggattgacgctcgaccaggcaaaagcgcgcgaagacgtggtcgagccgaaggagacggcatacccgatgctgtccaacgcgcgcatgctgatgagcggggaaggcggatcgatgaccgtcgtcagcggtgcgtttgcgaacaatcctgatatgcaggtggtgttgggcgtgcacatcgtcagcccaatcgccagtgatttgatagcggaagccgaacagttggtcggcaaccgtgtcccgcttgccgatgcggcacggctcatccacccgcatcccacgttcagcgagacgctcggtgaggcgttgctgaaagcggacggacgcccgctgcatacgagataggcggagtagaatagcgcagtcgcaccataaatggcatggttcctgatagactatcgtcccagtgtgtgtaaccgaaccgtcaagcgaggaagtcgatggcagataaagcagagaaaaagaagcagaagaagcaaggcaccatcaaccagatcatccagatcttcaaatacacccaagctgaggataaggcgcttccgtggctgtgcggtggcgtgttcgtggcaccgattatcgtgttcgtcgtactgggcgtcatattcaagtggcatgtgttcagctggatcctgttcatgattcttgccgtcatgctgggcgtgctgttcgccaccatgatgctcaccaagcgtgccgacaaggtcggctacgccaagatcgaaggtcgtcccggtgccgcagtaagcgtgctcggcaacatcagcaaggccggcttcaacttcccccaggaaccggtgtggattgacccgaagaccaaggacgccatctggcgcggtaccggttacaacggcatctatctgctgggcgaaggcgattacaatcgcgtcaagcgagccatggatcgtcaggagcagcgcatcaagggcgtgaccgccggctctgaaatcccggtctaccgtatgtacgtcggcaccggcgcaaaccagacccgcctcaaggacgtgcgcaagacgctgctcaagttcaagagctaccagccgacccatcacaagaacaagctgatggccgccatccatccgaggactcgtttcgtgctcaccaagaccgagctcacggtgctcaacgagcgtctgcgtaccctgcagctgaagaacggcatgagcgtgccgaagggcgtcgacccgatgcatccgcagcgcgtgagccgtcgcgccatgcgcggccgctgacggtggaatcgcattattccgttgaaaaagctccaatcgcgtcgtgcgattggagcttttcctatattcgaagccatacgtgtccattaattgacacgccgctgaagggcatgacgcgaccgttcgtaacacttgaatccccatttttcgcgaaatcgcacttcgaatatgtcattacgaaacattctcgtaacccaaatggcgagtgagcgaaactcgcgaccatagactaatagcctgtaagtaacttattcgaaaggagcggtcccgtgactgcacttgaaaccaaggctgatgctgaggcccttatcaacaaggaaggcattgagtatgtctccgttcgcttcaccgatctgatcggtgttcagcagcacttcaccgtgccggcaagcgaattcctgaaggacgccttcaccgacggcatgccgttcgatggctcctccgtggaaggcttccaggccatcaacgagtccgatatgaagctggtgccggacgtttccaccgcattcatcgatccgttccgcaagcacaagaccctcgacgtggcattctccatcgtcgacccgctgaccgacgagccgtactcccgcgacccgcgtcaggttgccggcaaggccgaggcttacctgaagtccaccggcatcgccgataccgcttccttcgctccggaagccgagttcttcatcttcgacaaggtgcgtttcgagaacagcatgcagcgctccttctacgaggtggactccatcgaggctccgtggaactccggcattgacaccgaagatgacggcaccccgaacatcgccttcaagaaccgcgtcaagaagggctacttcccggttccgccgattgaccacacccaggacctgcgcgacgacatggtcgccaacctgcagaaggtcggcctgattctcgagcgttcccaccacgaggtggcaggcgctggccagcaggagatcaactaccgcttcaactccctgcagcatgcaggcgatgacctgatgaagtacaagtacgtcgtccacgagaccgctgccctcgctggcaaggccgctaccttcatgccgaagccgattgcaggcgacaacggtaccggcatgcactgccatcagtccctgtggaaggacggcaagccgctgttctacgatgagaagaactacggcggtctgtccgatctcgcccgctggtacatcggcggtctgatcaagcactcttcctctgtgctcgccttcaccaacccgtctctgaactcctaccaccgtctggttccgggcttcgaggctccggtcaacctggtgtactccgctcgtaaccgctccgccgccatccgtattccgctggccggcacctccccggctgcgaagcgtatcgagttccgcgctccggatccgtcctgcaacccgttcctcgccttctccgcacagctgatggcaggcctggacggcatcctgaaccacatcgaacctccggcaccggtcgacaaggacctgtacgaactgccgccggaagagcacgctggcatcaagcaggttccgagctccctggctgaggccatggacgcacttgaggaagatcacgacttcctcaccgcaggcgacgtcttcaccgacgacctgattgacacctggatcagcatcaagcgtggcgagattgaccaggctcgtctggccccgaccccgctggagtacgagctgtacttccacatctgacgggcataacccctgagccctactggcgactgggtttttaccctgtcagtatagctcaggtctagttatggtctagttgtattccgaaaacacgacccccgcacgactcgcaagagccatgcgggggtcgtgtcttttccgtttaccgcggccgttcggacaggccggcgatccagtcgtccaggtcgcgccgccggatacgctcggtcgacgaatgcaccgggcgatgaggttgtcgtgcttgatggccgtacgcactgctttcccgggtgatccggcgttgtcattttcttccttacggatgacgctttttcgcgcatggtcagggacatgacccctgacaaagtagcgtcgttctttcttcggcaacggtcacattgtgtctgctgatcccgcaatgcgtcgtttacgctcctatactcggccgtatgttgttccaagccggatctttgctactcgtcatcatcagcgtctacctgctcaaacgcatccatatcttctccgacaaatcctataaagtggttcagggactggtattcaacctcactctgccatgcgccatcatcatgagcttcgccacgaacaagcatccgatgagcctgctgtggcttgtcgtattcggcttatttgcctgcctgattccgttgttcgtcgtgtatttcggatcgcgcggcgacgagccacgctaccgtgcttatcagatgctcaacgcgtcgggactgaacatcggcgcgttttgcctgccggtggtgcagaccttcatggggccaagcgccggcctgccggtcatcatgcttgatatcggcaacgccatcattgccaccgctgcatccctgaccatcacccgttcgttgctgcacttggggagccccgccaagaatctgccgttgagccttaagatcaagaacatcgcgcacgatttctactcgtccatctcgtttgactgctacatgcttatgctggtattcatgtttgccgggtggagcgtcccacattggatcgtcacgcttatcacgccgttcgccaatgccaacgcgttcgctgcaatggccatgatcggcctgatgatggagattcccgacaatcacaaggaccgttcggaactgggcaaggtcatcgcatggcgtttcctgttcagcgtcctcatcgcattggccgcatggttcctgttgccgttggacgaacgtgtccgcgaaatcgtggtcttggccgcattcgccccggtgacgattttctctacgaaattcaccgactcgctgacgggcaatgccaagcttgccggcttctcattgaccgttaccgcggtcatcggattgacgatcatgacgattctgcacgccgttctgccggtcgcctgacttagacttgcgggcgtgcatgccgtccgttaggcctgatgtgtggcgatgatgtgttcgatttcggtcagattcgacgcgaaatagatgccgtgctgacgttcggacgtggagaagcccacgttgatcatccgctgcaggaacgccttcatatcatcgtagaaaccgttgaggttatagaagatgcacggttgggacagctgattcaggcagatcttcgacaccacttcgctgacttcctccaatgtgcccgtgccgccggggaaggcgatgaacacgtcgcccagttcgatcatgcgggtacggcgttccgtgatgtccggcacgatgaccagttcggttagtccctgatgcgccacgccttggtcggcgaacatctgcgcttcgatgccggtcacctcaccgccgtgcgccagcaccgtatcggctatcacagccatcaggccctcatccgagccgccatacacgagacggttgccattgccggcgatccatgcgcccaattcctcgacggccttcctgtacgacgggtcgttgccctcatgggctcccagatatacggtgatgttcatttatcgcctttccaacgtgattgccttgttcgatccgttgactgtcgtgccgacgattcggtaatgcctggtttcggtgatcttctcgccgccacggacaagataggtcactctttcggtgtccaggtcatcgatatgacgtacttgcgcgggactgccgtgcagcggcgcgtaaccgccgcgcgtgctcacctcgccgtccttcagaaaatggtagttgacgcatgagcggaaatagtatagggattcaatatagtcgaattcgctggatgccaccaccgcgttatccgcgtcgcaggccacggtgcgtgccgtccgcgcggtttgcggcgtggtctgctgttcgtagatgtagtttccttggaacgcgaagccgatggaaccgcctgcgagtaccgcgatcgacagcagccatgcgctccaacgacgcaggaagcgggtggctttgccgcaaaagcccccggcaccggtctcccgcgtgccaaggacgatgcgcgagcacagcaatcccaggaacatatagctgaacggggcgaatgggcacacgtagcggatggtgaagaatccataaggtgcggtaaacggttcgcggactgccgcgaaaaccagcagcagcgacaatgggacgaacgcgaaaaacgccagatgccgtgccgcgcgtccgctgtcggcgcgatcttcggcggccgccaccgacctggcagctgatggttccatgccggaccggaccgtggacccggccgtatcgcgcaaacgcgacgatcctgcgatcaacaccgccaacattgccagaagcgccacggtcatccccgaagtcaagcgtttggcatcgaagccggtcgtgagaatggaaaacaccgaagtgagttcactcagattcatggtctccttcaacgggggcaaagccgaggaggcgaactggccgaccgcggaaggaatccatggaatgtacagcgccacggcgagcgcgtagggaatcagcatgcgtgggaaacgacgcgcatggccatgacggcgtaacgcgacgtacagccataacacgtgtgtcatccacacgaatgccatcatgtattgcgagtacatgcccaacgccaccactatggcgtaggcgatccaccatcgtcgatcggcaatcctgcgaagggccgtcgaacctcgtcccgaccgacgccgatccggacgcatcccatcctcgcgcatcgcgcgcagcagcagatacgtgcccagcacggacaggaacgggatcaacgaatacatgcgaatctcatacccgtaccgaagcatcagcggcgcgaacatcacaaacggcgaagccaacagggcatggcgctcgcaggccatgaaacggagcagaaccatcgacatcagaacagtcaacccgcagaacactcagctcatcgcacgcaatgccatgacatccgagccgaacaccgaaatccacatgcgcagcagcagataatagagcggcggatgcacgtcgaccttcagcagatccatcattcgggcgaatggctggctctccacaatgagcgtatacccctcgtcgaaccagatggaacggccgacgcccagcgcgaacgacccgcaggctgcggcgatcgcgcataccgccgtgacacaggcaaaacgatgcttcgaaacggattgtcctatcgacatggtgtggtttcccttttcattgtccaaacatatggtggaacgtcggtccttgagaatgccatggccatggtcggaatcggcgtatcccatcattcccatgccgcatggcgtatgcggcatgtcagcgcatcaccagaccgccgtcgacatgcagggtctgtcccgtgatgaacgcggcatcgtctcccgcgagcatggccacggcgccggcgatgtcctcggcggtggcgagccttccaagcggcgtggaggcgatgatgcgctcgcgcatgtcctcggtggtggcccgactcgaatcggtgcccacggtcagtccggccgcgatggcgttcacggtcacgccccaagcgcccgcctcctgcgccaaggaccgggtgaagcccaccaacgcgcctttggccgcggtgtaatcgtgataaggcacgatgggggagtcgacgaggttgctggatatgttgatgatgcgtccgccggcctgacgtcgcatctgcggcagcacggcctcgcaggtgttgtacgcgcctttgagacagccttcgagctgcgccgcgtaatcggaccatccgatcgagccgaaggttttgcggttgcgcggatcgaacgagtaatgcgcgaacgcgttgttgacgagaatgtcgagaccgccgaacgtggtgaccgtggtggacaccatgccgcgcacctgctcggcgtcggtgacatccgccttgcatgtgatcacgcgaccggccgcatcgcaatcgtccatgatccgttgcgcgcactgccgggcacgctcgtcgttgctgacataatcgatgaccacgcacgctcccgcacgcgtcagacggcgtgcgatcgccgctccgatgccacggcttgcgccagtgaccaccgccacacgtccggcaagcggcgcgttttcagactgctgcataatgaggatttcctttcgattcggaaaaacgtttcgtaagaattcgcgcgatcattcgacgtccatgtcgaagccgtcgcaatacgtgtcggtattgcgttcgatatcgacggcatgcaccagatcaagcagattgaagccgccgtcgtgatgccagccggatttcgcgcgattcatctcgcctaccgggcagatgcggtcgatgccggtctcgccgacgcgttgcgccacgtcgaacagccggtccggagcgagcgccacaccgcaggtctgcaaccattgcgcgtaagggcgcagcgtgggcagcgcgtcctcgacatggtccaccgccacgatgttgacggtgcggttcagtggtgtggacagcgagtcggccatgccgatggacggatagtacagcaccgtccagtcggtgcccgaacgcgactgcaccacgaacgggtcgtcggacggcgcatcatccgcgttgccggccgcggcggccatcgggccggcgcccagcatcagcgctttcatctgcgcggtggaacgcaaccgctgaatcgccatggactcctcttcggacggtgtggaacggggatatttgcgctgctgcccgtccaattcgctggcaagcagttcggcgacctgcgccggagacatcgcgccgccacgttccacgaacatggtttgcggcgccagacagctttgctggtcgtatgtggccacgtcgatcgccatacgatgcacggtgccggcatacagatcggcgcgaagcgcctcgcggccgatcagcgagaagccgattttcgcgccgtagctgaggaaaggctttccggcacgcacgcgcgggcgaatcgcctcggtggtgtgcgacgaaccgtacgcgaccaccgcatccgcctcgccaatcgcggcatcctccaaatccacggtgccgccacgccaaggcacaatcgccaaagcgtccgccatatcggggtcgacgcttgccagggaacgggcgaacagcaccggcatcagcggctcgtcgaacgacgatttgccgagaatcgcgcttttcgtcagcagacccatcgtcatgctccacactggaatgcccggcacattgctggaaaacacgtggaacgacaattccggaccgtacagccgcgtgtatccgcccgaacggttcgggcgatactcgtcaagcatctgcgggcaattcaactcgtcatccacgaaacgcagcagctcacgccgacggaacatgcgcatgtaccgcttcaattcgatacgcaccatggacgcgtcatagccggtgaccgcgggaatgagccgctccgcaagccgacgttccggatattccggatccgtccacaattctacggcgcgcgcgatcacgtcgacgatcccgtccgtggaataccgcgccagtttctcggcgcgatgccgccgcaccgacgccgccagcgcatgcacggcatcggcgtcgagacgggggaaacgcaacgtcgccgtgccgccatcggacgccgtgacgttgcgtgtgtcgaaatcatggaactcgaaatcccgcggcgcgtggaaaatgtcgacgtcgctcatgcgttggccgccatcacctcgtcgacggtgatcgaacagccacgcgcctcggcgcccttcgcacgaccgttcagcacatagccatgttcggtgcgcacacccagatcctccgtcagaatagccaggcacgaattccaattcgccagatcataatgcgcgatcacaccctgctcgccatcggcgaccggcgtaagcgaagccggatcgaggaacaccgaacgcacccacgacggcgtggctttgagataattcgacgaaccatccgtgtaataggacaggatgttctgatcgtagatctgcgaactcaactccgtcatgccatacatgttcacgcaatgcgagcgcttcacgccgaacactcgttcgaacgccgcatacaggtcgtcgaccgtcatgtcggtgcgcgtgcttttgaaaccgcccgtatcgaacacgcgggaatcggcggccagagcgtaggtcttgccctgcttgtccagataatccagcagatacaggtaggcggaggaggcgcccataagcatcaccggttcgccgtcggccgcggcctcgtcgaggaagcgctcgacgcccgtgaaatcaaggccatcctcatggaagaagaagccgctgccttcggcgccgcactgctccacggcgcgggtcagatatcgggacagcgacgaatgctcgttcatgtcccatgcgggggagaggaccgcgatgcggatgcgctcgcggtcgggcatgatgaaatgcctgaacggcacgatcatcgactcgtcccacacctgcaggtcggggtggaagttgcgcccgcgttgaccgggatgcgtggtaccgctggtggtgaacaccgcttcgcaatcctgttcgggcacggaggtgagcgtcagcattttgaagccgtccaccggcatggggggaatctgcatccagttggcgagcgtctgcggcgtcacgcgtttggacatgcagtaggcgcggtatgggaggttgcgctcgaattgaaaggcgaagatatgcttcgccagcgtgtcgaacgcctcatcgggcgccttgccgcagccgtattgtgcgatgaagtcgagcacctcccgtttgatggtttccttcgtctcgtcgatgttcgtggattcctgcgattgccccatgctcatgccatgtcctttccgtcgtatggttgtcggattattcggatgctttcgattattccgcttgtttcgtccgctcgtctgcgtgtcgtgcgataaagttcggcaggtcgatgatgagggccttgagaatcacgacgctgaacgcgccgaccagaatcgaattcgagaagaacacgtgcgctccttcttcaagaccgctcaacgcgttcggcagggcgatgccaagcagcagggaaaggccgatcaccacttgggtgcggtcgtcgctttccaccttgcgcagcgtgttgaagccggtgctgatgaggcttgcggcggccggcaggaagatgccgccgatcacgggggatgggatgagcgacagcgctgcgcccgccttcggaatgaaaccaagcaccacgaacaccacgccggcaatgatcaccggcacgcgggtgcgggtcttgccttcgtcggtgactttgagcagcgccacgttctgcggatacgcggtggtggtgaaaccgccgatcagcgaggagatcgccgaaccggcggcctctccggcaagaccgtaacgcacctggcggtcctggagcttcgtgccttggatctccgtggccgcctgatacacgccgagggcttccatgatggccaccagataggcgatgaagaacggtacgaaaatcgccgcgttgaaatcgaaaccgccatacggcatgaacttgggcaggccgagccacggcttggaggccaccgcggagaagtcggccatgccgaacgccagagacagcgcggtgcccacgaccagtgagatcagatacgacagagccttcaccatgcccttgccgaactgggaaagcaccaccaccagcacgcaggtgatgatggagacggccagcgtcttcggatcggcgaagcccttgtctcccggcgcgccgccaaggaactcgctcaatgtgaatcccgacagggagacgccgacgaggaagatgatcacgcccgatacgatcggggcgaacaggaaccgcagcttctcgatcacacgcgtcaggcacagcaccaggaaaatcagcgagctgatgaagatggacgtgccggccgcggcaagtgatccggcggtgccggcggcgatcatcagcgcgtcgaacgccgcggaaggaccctgaacgatgggcaggcgcaccagtttcgtggcctggataagcgtgaccaggccggagacgatgaaaatggcgttcaccatgttcgacgacaatgccaacggcagaccgatggcgcccgccacgaacaccggatcaagccacacgtttgatacgagcacatgctgcaatcccagcagggcgttcttcggcgtgaccttcttttcggctgacgaaccggcttccgccacgctcgtttcggttttctttctggttgcggcatcgccgtgcgtctgcgtctgcgtcgatggcttttcgttggccatggtgtcccttctcgacttccattgggtgccgaaatacaacggagatcgtctttacgggacgcgacgcgttttgccggtactgttcctacgcaagcattaccttgatcaggtcaagggtccgggcggtcgcccgtctcagccgtattcggcaccccctgtacttcgacgcgcccaatcataacgccaccgtccaaccgaaacaggaaaaaatacggcatgcgtgtccgttgcatggggacgcatgccgtatttcttttcgagaagctgccgacgcttatctgcgacgcctgatgggagccagctcgaacacctcgtcggacgtcttggccacttccggactgtgcgtcacaatgatgacgcaacggtgctcgtcatgcgccaacatacggaagatgcccatgatgtcgtcctgcgtggccggatcgagattgccggtcggctcgtccgcgacgatgatggaaggaccatagcttaacgcgcgggtgatcaccacacgctgctgttcgccgccggacaggtgcagaatccgctcgtttgcgtattccttcggcagatgcacctgtttgagcaattcttcgacgattgctttcttcggcttgtcgaacgatttgccggacgcgtccatcgacaggatgatgttctccgcgaccgtaaggttcggcagcaggttgaagctttggaagatcacgccgatgtcatggctgcgaaaacggtatcggtctcgttccgacaggtcggtgccgtcgaccagcaccatcccttccgtgggattcgccagtcccgagatcagtgatagcagcgtggttttgcctgctccggacggtcctgtgatggcatgcactttgctggcttggaaatcgtggctgatgtttttcagcacgcgtttgccgcctttggtgtaggcataactgacgttatccagctgcagcgtaggcgggtcggtctgctgcgattgtgcgccgttggtctcgacggcttcttttgcgattgccgtattggcggtattcgcggaattcgttgtcatgggaggtcctttccaggaaaaacgtgcgattggattgtcaggaacggtcggtgagcgatttggagatgatggcatcgccatcactgctcgcgtcatagccgaacaccttgcccttcaccatcgtgaagctgccattggaggcgttggcgacggcctcgtcgctggagaagccgattagggagaaatcgccgctgaccatgcccgcgccgtctttgctgcccgcgacgtcgcccatttgtccgtcggagccaccggactgttcatcctgacgggtgccgttatccgtaccggcggtatcagacgaatccttcatattggacgagccggacgagctggaggaatccgaaccggacgaatcggtgaccggctggaaatcgtcggtcgccgccaaccccgtggtctccatataatagtggatttcaccgcggatgaagccttcgcgtacttctgatagtcggcaagcgaaaactgcttgtcggccaaagcggaacgcatggcgtcgaagtcaggtttggcggaagcatcggacgaatcggaatccgacttggactgctcgcgcgattcggaaatgagtttgccgcgatcaaggctgatctgcgcggtggcggtggtgttatctaatccgctgcttcttgcggtggcagccgcctgccggatggataggccgattgtggcggcagcggcgatgatggtcacgatgacgatgatgagcatattgcgtcccttgttgcgggtgacgcttttccatgcgtttttgacgacgaacatggctgtttccttatgtgtttcgatagatatgagcgattgatggttccgcgccgctcgcgatcggcgtttatgctgatggtaaaagttgtatctggcatacaacagaaagacgctttgttcgcgctgggatgcggctggatgttttctggacgcctcgaaacatgacatggccgcgtcgccaaccgcttcgaaggtgttaggctaacgcgtatgcctatgaaatccgaagtcattgcaaacccaagggccgaacgcgtccgcagggtctccgaacttgccgacaggaaaggccgcaagcggtccggcaggttcatggtggaaggaccgcagtcggtacgtgaactgctctcctggcatcccgacatcgtcgaggatctgtatgtggaggtcgtctccgccgaaccggacgcggctttcatcacgcccaccgtggcgcagatggccggcaaggccatgcaggccggcgcttacgtgcacaaggtgacgcattccgtcatgcagcacatgagctccgacgcgcagggagtgctcgccgtcgccgacatgcgcgctttcctcgattccgccgtcattgatggcgatttcgacgaacgtacgatggtcgccgcgttctggcaggtgcgcgatccgggcaacgccggcaccgtgatccgttccgcggacgcggccggttgcgcgggcgtggtgctggtggacgactgcgtggacatcttcaacccgaaggtgattcgttccactgccggctcgctgttccatctgccggtcgtctccatgggcacggacgagtatttcgattggtgtgcggaacgcggactcgccgtgtacgccgccgacgtgtatggtaccgacgcacggccgccggaaccgcttacggacgtgcttgccgtgccgcagtcgcttgcacaggccaagacggtgctgttcggcaacgaggcgcgcgggctgacccaggatgtgttggaacgcgtcgacagaatcgtgtcgattcccatctacggcaaggcggaatcgctcaatctcggcaccagcgcggcggtgatgctgctgagcttggctatgtcgagtcatgttgaaagaatgtgaagtcgtaaaaacgttggaattgcgcgttttatgcgtaaaacaaacggttgataagaaaggtatctcgtggcagagggtgcggtattcgacgcccaagcggtaaccgatgcggttgccgagggcatcgcgaaaatcgaaaacgcctccacaatggaggaattgaaagccatcaagacgcagtacgccggagcggaatccgcgatgacgcaggccagcaaggccatcggcgcgttgccgaaggaccagaagaaagacgccggcaagctcatgggcaagcttcgcgccgacttcggtcgtgcgttcggcaccaaggaaaagcaagtcaaggccgaagaagaggcccgcgagcttgccgccgaaaccgtggatatgaccctgccggtcaaccgcaagccgcttggcgcccgccatccgctgccgaagctgatggaggatgtcgaggacttcttcatctccatgggctggcagatctccgacggtccggaagtggaaaccgaatggtatgacttcgacgcgctgaacttcggtccggaccatccggcacgccagatgcaggacaccttctacgtcaagggcaatcaggccaaggacgccgcgggcttcgtcggctccaacatggtgctgcgcacccagacttcgtccgatcaggtccgtggactcatcacccgtggcgtgccgctgtacatcgcctgcccgggccgtgtgttccgtaccgacgaacttgacgccacccacaccccggtgttccatcaggtggaggccctcgccgtggacaagcatctgaccatggccgatttgaagggcgtgctcgacaagcttgccgtggccatgttcggcccggaagccaaaacccgtctgcgtccgagctacttcccgttcaccgagccgagcgccgagctcgacctgtggttccccgacaagaagggcggcgccggttggcttgaatggggcggctgcggcatggtcaacccgaacgtgctgaagtctgcgggcctcgatcctgaggtctacaccggcttcgccttcggcgtcggcgtggaacgtaccctgctgctgcgccacgacatcaacgacatgcacgacctggtggaaggcgacgtgcgattcagcgaacagtttgtgatgggggagtgattgacccatgccaatggttgacattgattggctcaaggaccatgtcgaggttccggaaggccttacgtatgaacagcttgccaaggatctggtgaaggtcggcctcgaagaggaagagatccacacctcccaggtcaccggcccgattgtcgtcggctatgtggtcgacgccactccggaaccgcagaagaacggcaagatcatcaactggtgtcatgtggacgtcggcgacgaatacaacgagaccgatgaaaacggcaacaaggtgccacgcggcatcatctgcggagctccgaacatggcagccggcgagaaggttgtcgtgaccctgccgggcgccgtgctgccaggcgatttcaagatcgaaccgcgcaagacctacggccacatctccaacggcatgtgcgcctccgagcgcgagcttggtctgggtgataaccacgacggcatcatcctgctacgcaagtacggcttcaccccggaggaatacgaaaagctccagccgggcgatgacgccatacatctgctgcacctggaccagccgctgctggaaatcaacatcactccggatcgcggctacgcgttctcctaccgtggcgtggcccgcgaataccaccattccactggcgccgtctacactgatccggcaaccgccctcggcaagaaggcgcccgtcactcagggtctgccggaaggtgtcaagagcgacatcgaagtgatcgtcgacgacaagaatccgattcacggtgtggtcggctgcgatcgttactacgcgcgcgccgtgcgtggtttcgacccggcaagccacacgccgaactggatgcgccgccgcctaatccgcgcaggcatgcgctccatctctttggcggtggacgtcaccaattacgtgatgcttgatcttggccagccgatgcatgcctacgatctggacaagattgaaggaccgatcgtcgtgcgccgcgccaacgaaggtgagaagctcaccacattggacggcaaggatcatgacctgagcgtcgaagacctgctgatcaccgactcgccgaacggcgagcgtggctctcgtgtgcttggcatcgccggcgtgatgggcggcctgtatggcgaggtcactgctgaaactaagaacatcctgctggaatccgctcatttcgaccaggtgtcgatcgcgcgttctgcacgtcgtcacaagattccgtccgaagcgtcccgtcgtttcgagcgtggcgtggatgatcagctgcagccggctgccgcccagatggccgccgagcttctggtcaagtatggcaacggcgagccgagcgagcacccgactgattacaacactgtctgcaatcgtcgtccgattctgttcaaggcgtccgaagtggcccgcgtggcgggactggacactgacgtgaacaccatcagcgacattctcaccgatatcggctgcactgtggccggcggtggcaacggtgagttctccgtgactccgccgagctggcgtccggacctcaacgaaccgtgcgatctggtggaggaagtggcccgtctggtcggctacgatgagattccggtcaccgtgccgccggcaccggtcgaagccaaggtcggactgaccgccgagcagctgcgcaagcgccaggtggccgacgaactcgccgaatacggcatggtggagaccctgagctatccgttcgtgggcgacgaagactacaagaacttcgcacttgacgccgacgccaccaagaaggtcagcgtcgaaattgccaacccactggccggcgatcgcccgttcctgcgtcgcgacatcatcccgaccctcgcgcagaccgtgcagcgtaacctgcgccgtggcgtggaaaacgtgtcgctgtacgaaatcggacacgtctacctgtgggatccgaacgctccggccattccggcattgccgggtgccgtcaagccaaccgacgagcagttggccgcgcttgacgcaggcctgccggaccagccgatgcacgtcgccggcattctgaccggcaacgccgtcgactccggctggatgggcgatcgccgtgccgtggactggtccgacgcagttgaagccgtgcagcgtatttccgaccgcatcggcgcaaagctcacgttggaccagccgaaggctgaggacgtacccgcgcagtggcatccgggccgtgcggcacgtgtgatggcaggtgacacgttcgtcggcatggtcggcgagcttcacccgcatgtcaacgaggcgttgggcttcccggcccattccgccgcgttcgaactgaacctgaccgcgctgttcgccaccttgagcggcaagccggtgcaggccaagccgatttccaccttcccgccggtcaagcaggatctggccttcaccgtgtcgacggacgtcaccgccgccgaacttgagaagaccatcgtcgaagccgccggcaacagcttggagagcatcgacctgttcgacgtgtacaccggcgaccagctgggtgagggattgaagtccctcgcatacgccgtcacgttccgcgctgaggacaagacgctgacctccgaggacagcgaagccattcgcaagcgcatcgtggatgcggccgcgaagctgggcgcgcaactgcgtgcctgacacgtcaagtccatcgaagtaaccaaaaagataaagaggacgacatgaacgaaccggagcagaaccagccgatcaaccccgacgaagggcaggaggcggccggggctgctccggtttcgtcgtcttcgccgtcggaccagtcggcacagccggaattcggacagtacaaccagcctgaatatggcgcgatgtccaaccagtatccggcgaactacaatccatacatgtatggggctcccgaccagcccaagccggcggacgatgcacaacaaacggcgcagcggccgcagacgaatccgtatatgcagaacgggtatccggcgaatccatatgatgcatcgggacggcagcaatcaggccagcccaatggctatcagtatggaccaaatcaatacgggccaagccagtatgggccgaatccataccaacagcccggcatatatcccatcaacccgaatgatcccagccagaaccccctgtacggccattgggatagctatgcgatcatctcgttcgtgttcgcactattcctgccggtaccggtcatccctgcggtgatgggcgccatcgccatgtggcgtaccaaaaaactgcatatgaaaggctacgcgcttggcgtggcagcgctgattatcaacgtgctgtacaccattgcggtgatttggatgacggttcacggcatttccacagccgatttgtataaccagatgatgcagtacatgttcggtggcagtggacaaagtggtgattccagctcgatttccgcctgaaaccaatctttttatgttcgtctgaacggtcccgttatgggcggtgaccactatccgacacgattgaactgcataattatgcaatgtagtgcataaagtgtatgctgaatgtgtttcaacgagtcaaggaaaagagacgtgacatggccaaatacacggtagccgtggccggcgcgactggatacgcgggtggtgaggcgctgcgcatactcgcggcacacccgaatttcgaagtgacctgcgtcgccggacattcttcggtgggggacaagcttggcaagcatatgccgcacattccgcagttggcggacctcgtggtcgaggacaccacgccggaagtgctcaacggccatgacgtgatcatcctggcattgcctcatggcgcttccggagcattggcctcccagcttgacccgaatgccgtggtggtggatttgggcgcagaccaccgtcttgaggaaaagagcgcgtgggacgcgttctacggcggtgacttctaccagcattggacctacggcatgccggaactcatcaccggcgtcgcggctgacggctcctacagccgtcagcgtgaagcgcttcccggcaccaagcgcattgcgggaccgggctgcaacgtcactgcgaccacgctggctttgcaaccgggcattgcgcagggtcttgtcgaatcgaaagacatcgtggctgatttggtggtcggttattccggcgccggcaagaacctcaagcgcaccaatctgcttgcggctgaggcgtttggttccgcactgccgtattcggtaggcggtacgcaccgccacattccggagatcctgcagaacttcgcgcacgcggccggcaagagtgctgcggaggcagacgattacaccctcgccttcacgccgattctcgcgccgatggcgcgcggcattctcgccaccgtttccgccaaactcaccgataaggcgcttggcatgacggatgccgagatccgccaggtctggctggacgcatacgaaggccaggatttcatggtcgtgctgcctgaaggcgtaatgccggccaccgccaacatcatcggttctaacgcggcccacattcaagtggtcgtcgaccatcatgccggccgcctgctggcattcgcggccatcgacaacctcaaccgaggcaccgccgggcaggccgtgcagtcgctgaatgtggcattgggacttcctgaggatgcaggattgacgaagattggagtggcaccgtgagcgtaacgttcgcacaaggtttttccgcagctggcgtggcagctggcatttccgcggtcgaaggcaagaaggatctggctctcgtggtcaacaatggaccgcttgacgccgctgccggcgtgttcacctcgaaccgtttctgcgcggcccctgtgcagtggtcgaggaacatcgtatccgacggccatgtgaaggccgtgattctgaactccggcggcgccaacgcatgcaccggcaagccaggatacgagcagtccaaggccaccgctgaaaaggtcgccggcctcatcggcgccaaagccgaagacgtggccgtatgttccactggtctcatcggcgaattgctgccgctcgacaacgtgctgtccggcgcggacaaggcatttgaaacccttgccgataccgccgaagccggagccgatgcgtcgcacgccatcatgaccaccgacaccaagccgaaaaccgtcgagctggaaggttccaacggcttccgtatcggtggcatggtcaagggttccggcatgatcgccccgcagctggccaccatgctgtgcgtcatcaccaccgatgccgtcgtgaccgccggacagcttcaagccgccttgaacgccggagtcgaaatgtcgttcaaccgcatcgacgtggacggctgcatgtccaccaacgacaccgtgctgctgctggcttccggcgcgtccggcatcgaaccggacccggacgagttcaacgagcttgtggccaaggccaccgcctcgctcgcccgccagatcatcggcgacggcgaaggcgcaagccatgacatccgtgtcaaagttaccggcgcgaccaccgaagaagccgctctggcatgcggccgcgcggtcgcagcgtccaatctgctcaaatgcgccatctccggcaacgatccgaactggggccgcatcgtcagctccctcggcaccgtgccgcccgacgtcgcaccatacgattccgaaaaggtcacggtggacgtcaacggcgtacgcatctgcgaaaacggcggagccggacgcgaccgctccgaagtggacatgaccccacgcgaggtgcacatcgacatcgacctgaacgccggagaagcggaagcgaccgtctggaccgacgatctgacccacgaatacgtacacatcaacgctgactacgaaagctgatcgaataggaatggccaaagaactcaaaggacctggattccacttcgacgtgcacaccgacctgcgcgccgaccagaaggcggaagtgcttatcgaagcgctgccgtggctggaggaattcgccggacaacgcatcgtcatcaaatatggcggcaacgcgatgatcgacgatcatctgaaagcctgcttcgccgaagacatggtgttcctgcgccaggtgggactgcacccggtcgtggtgcacggtggcggtccgcagatatcccaaatgcttaaggccctgggtatcaagtccgaattcaagggcggattgcgtgtcaccactccggaagccatggatgtggtccgcatggtgctgaccggcaaggtgtcccgtgaactcgttggcctgatcaacgcgcacggtccattcgcggtcggcctgtccggcgaggacggcgccctgttctcggccatgcagcgcaaaccggtcattgacggcaagcccaccgatatcggcttggtcggcgacgtggtgagcgtcgacgcgtccgccgtggaggatctaatcaacgccggacgtattccggtggtttcctccgtggctccgaatgaagacgatgccactgaagtgctcaacgtgaacgccgactccgccgcggccgcccttgccgcggcccttggagccagcaagctggtcgtgttgaccgacgtcgacggtctgtatgccgattggccggaccgtgactccctgattggccgcatcggcgtggagaatctgcgcgatatgctccccgacctggaaagcggcatgcgtccgaagatggaagcctgcgtgcgcgccatcgacggaggcgttccgcgggcccatatcatcgacggtcgcaaaccgcattccatcctgaacgagatcttcaccaccgacggcatcggcaccatggtcgtgcccgaggacggtattgaaatgaggagttcctatggcaactgaacaactggaaacactcggcactgaagatgccaagtggctgggagagtactcccaggtgcatatgaacgtgtttggcacgcccctgcgcgtgatggaccacggtgagggcgcccacatctgggatgtcgacggcaatgaatatctcgatttccttgcaggcatcgccgtcaacgcgctcggatacgcccatccgaagtgggtgaaggccgtcagcgaacaggccgccaaggccgcgcatgtgagcaactacttcgccaccgaaccgcagatcaagctcgccgccaaactcgtcaagctcgcgggcgctccggaaggttcccgcgtctacttcggcaattccggcgcggaaggtaacgaggcggcgctgaagctcgccaagctctacgggcgcaccctgccgggcgcgttgcctgagatcggcggcaaaccggcacgcatcatctccatgacccacggcttccacggccgcaccatgggcgcgctgtccgcaacgtggaagcccgccatccgtgagaaattcgagccgctggtaccgaacatcgaattcgtcgaagccggcaacgtcgaagccttgcacgacgctttcgccgaaaccggccaaggcaagtacggcaaagggccggtcgcggccgtcatcatggagcttatccagggcgaggccggtgtgatgccgctcggagcggactatgtgaaggccgcccgcaaactatgcgacgaacataaggcgctcctcatcatcgacgaagtgcagaccggcatcggacgcaccggagcatggttcgccttccagcgtgaggatctttccggcggtgtgaccccggacatcgtcactttcgccaagggcgttggcggtggtttcccgatgggcggcatgatttccttcggcgccgaactgtccgcgctgttcaccccgggttcccacggctccactttcgcaggcaatccattgggcgcttcggcggcattggcaacgctgggagtcatcgaagaggacaacctcgtggacaacgccgaagaacgcggcaagcagctgcgcgacggtatcgcctcctgcggtaatccgctgttcgtctccgtgcgtggccgtggcctgctcgacgccatcgaacttgcccacccctgctcgcatgcggccatgaactgggctttggaacacggtctcatcgtcaatgcggtggctccgaatgcgttgcgtctcgccccgccgctggtcatcactgctcaggacgtcgatcaagcggtgtccatcctcgccaagattccgtccgacctgcctaacgactgatctcggacgaacccgaagaatttgaaaggagcctctataccaatggcaacccctgaactgcgccatatgctgcgcgatgacgatctgaaccacgaagaacagaagcaggtgctggaactggccatcaagttccacaagaaccgtttctatcaccagccgttcgctggcccgcagggcatcgccgtgattttcgacaagcccagtacccgtacccgctccagcttctccattggcgtggccgaactcggtggctatccgctggtcattgacaagtccggctcccagctgggccgtggcgaaccggtggccgacacggctcgcgtgcttgaccgtatggcctacggcgtggtgtggcgcacctttggtcaggaccgtgttgaggaaatggccaagtactccacccatccggtggtgaacgcactgaccgacgaattccatccgtgccagattcttgctgacttccagaccatctcggaacatcgcggcggtgtagacaacctcaagaaccagaccatcgcctatcttggcgacgcggccaacaacatgtccaactcctacctgctcggcggcgctgtggcgggcatgaacgtgcgtgtggcaggaccgtacggatacctgccggatccgcagatcgttgccgatgccgaagcgattgcctctgagaccggcggctccatcctcgtcactactgatccgaatgaggctgttgccggagccgattgcgtcttcaccgacacgtgggtctccatgggcgaggaagcggaatacgctgtccgttccaagccgttctgggattaccaggtgaacgccgaactcatggccaaggccaaggacgacgccatcttccagcactgcctgcctgcatatcgcggcaaggaggtcaccgccgaggttatcgatggtcctcagtccgtggtttgggatgaggcaggcaaccgtctgcacgcccagaaggcgttgctgacctggttggccggcaaggcccgtggcgatgaaagcctgctggtctgatgactgaccacactcccgcgttgcagcgtcctgccacacgaaccgctcgactgagcgccattgagcaggcgctgctgacgcgcatcgtcacctcgcaatcgcaactgtcgcagattctcgccgaccagggcatcgaggtgacgcaggccacgctgagccgtgatctcgatgagattcacgccacgaagacccgtcttgccgacggaaccgtggcctacgccgtcggcaaacagaacattgatgaacatccggtttctaacccggacgccaaaaccgagcagcagattagccgggtactgtccggactggtcacatccgtggccgcggcacgtaatctcgtggtcgtgcacacgccatccggcgccgcgcaatatgtggccagcgtcatcgataagcagcccatcgaaggcgtgcttggcaccatcgccggagatgacacggtcatggttatctgctccgaggatgatgtcgccaaacggcgtgcgcaatggctgcttgatgtcgcttccaaagcgtgaatagccatatagtggacacgacgcaccaaatatgcataaatatacagagctgtgcatatactgatgaataacgttggatgttagaaagggaaaccatgagcgatcagaatcgtctcgtcctggcgtactccggtggtcttgacacctccgtcgccatttcgtatctgaaggaacgcaccggcaaggatgttgtggccgtgtccctcgacgtcggccagggcggcgaaagcctcgaaaccatcaagcagcgcgcgctggcatgcggtgcggtcgaagcctacgtggtcgatgcccgtgatgaattcgccaacgaatactgcatgaaggccctgaaggccaacgccatgtacgaaggcgtgtacccgctggtctccgccatctcccgtccgctgatttccaagcatcttgtgcgagccgcccaccagttcggcgctgacaccatttcccacggctgcaccggcaagggcaacgaccaggttcgtttcgaggtctccatcgcctccatcgacccgacgctgaaggccatcagcccgattcgcgacctgtctctgacccgcgacgtcgagatcgccttcgccaaggaacacaagctgccgatcgtgcagaccgagaagagcccgttctccatcgaccagaacgtgtggggccgtgccatcgagaccggtttccttgaggatccgtggaacggtccgaccaaggactgctattcctacaccgacgatccggcgttcccaccggtcgaggatgaggtcgtcatcgaattcaagcagggcgtcccggtcaagatcgacggccatgacgtcactccgctgcaggccatcgaagagatgaaccgtcgtgcaggcgcgcagggcatcggccgcatcgatctgatcgaggatcgtctggtaggcatcaagtcccgcgagctgtacgaggctccgggcgcagtggcgctgatcaccgcccaccaggagctcgagaactgctgcctcgaacgcgagcagcaccgcatcaagcgcgacatcgacaagcgttgggcggaactggtctacgacgcgcagtggttctccccggcaacccagtccctgaacgccttcatcgaagacacccagaagtacgtttccggcgagattcgcatggttctgcacggtggccgcgccgtcgtgaccggccgtcgctccgacagctcgctgtacgactacaacctggccacctacgattccggcgacagcttcgaccagaagtcctccaacggcttcatcgacatctatggtctgccgagccgtgtggccgcagcccgcgacgtcaagttcggcaacggcatcgaggttccggagaacagcgtcgagtaagcatcatccggattcacgttgtgaatcgtcttgataatgggggagagcgtaccgtcgggaccatcctgactggtaagctctccctcagtcatatctgcaaggagatttggaaaaacaatgaccgagagcactactaatggtgagcatcttgccctgtggggcggccgtttcaagtctggtccgtcgccggaactcgcacggctgagcaagtccacccaattcgactggcgactcgccgatgacgatatcgccggttcgcgtgcccatgcccgtgcattgggccgcgccggactgctgaccgccgatgagctgcagcgcatggaagacgcccttgacgagctgcagcgccgcgtggattccggagcgttcgctccgatcgaggatgacgaggacgaggccactgcactcgaacgcggtctactccagatcgcaggtgacgaactcggcggcaagctccgcgccggccgttcccgcaacgatcagatcgccgcgctcatccgcatgtggctgcgccgccacagccgcatcatcgccaaaatgctgctcggtctcgccgcaacactgatcgagcagtccgaaaaagccggtcgcaccgtcatgccgggacgtacgcatatgcagcacgcccagccagttctgcttgcccaccagctcatggcccacgtgtggccgctgctgcgtgacgtggaacgtctcgccgattgggataagcgcatcgacgccagcccgtacggctccggtgccctcgccggcaacacccttggcctcgaaccggtggctgtggcccgtgagctgggcttctccaaggtgaccgccaactccatcgacggcaccgccagccgtgatctggtcgccgaattcgccttcatcgccgccatgaccggtgtcgatctgagccgcctgtccgaagagatcatcatctggaacacccaggaattcgcgttcgtgcgtcttgatgacgcctactccaccggctcgtccatcatgccgcagaagaagaatccggacatcgccgaactcactcgcggcaagtccggacgactcatcggcgacctgactggcctgctcgccaccttgaaaggcctgccgacagcctacgcgcgcgacctgcaggaagacaaggaagccgtattcgaccaagtggacacgcttgaagtgctgctgccggcattcaccggcatggtcgccaccatggtcttcgacaaggaacgcctcgaagccgaagccccgaccggtttcgccctcgccaccgacatcgccgaatggctcgtcaagaacggtgtgccgttccgtcacgcgcacgagctttccggcgcatgcgtcaagattgccgaagacctcggccaggagctgtgggatttgaccgacgaggacttcatcaacgtgttcaaggacttcctgccggcggacaaggccccgcaggtgcgtgaagtgctgtccaccgaaggctccgtctccgcccgcaacggcaagggaggcacctccccgctgcgcgtgcgcgaacagatcgtttccgccaagaccaccatcgagcagctacgcgccttcgccaactccgtgtccgacggttccgcatacaagtcgcccgaatccctgctcaagtaatccctatcaagcaaggagcaaaaagcggtgctgttgacgcgcacgcagatacgacggctggtctacgcgcacggccgggagattctggaacatgaccacatggccatcgaaagggtctgctaccagcatggcgtggtcaccacattcgcccattccattcgtgtggcttgtctgtccgtctggctggcagacagactgcacctgtggaatagggttgatctacattcgttgattcgcgccgctttgctccatgattacttcctttacgattggcatgactgggacaacggcacccatcggctacacggattcacacatggtgaaacggccatgcgcaacgccatacgggatttcaaactcaaccagatcgaacgggacagcatcgaacatcacatgttcccattgactccctatccgccgaagtacatcgaaggataccttgtcaccgcggccgacaaaatcagcgccacgaaggaaacgctctctttcgatcgtttcgacaaacccgcatccggacaaccgatggacaggagctgatggctgtggcgctcacactcgaatatttgttcctttggttcctgttgtacgcctttatcggatgggtgtacgagtcggttctcgtgtccgtttcggaacgtcgatgggtcaaccgtggtttccttaacgggccgttgtgcccaatttacggatgcggcgcggtgcttgcgatcgtgctgttgcatgacttcacgaatcccatcgagattttccttatctcctcatttggcgcgagcatactcgagtacatcacctcttggggcatggaaaagctgttccacgccagatggtgggattacagccattaccgattcaacatccaaggccgcatctgtctgctcggcgcaatcgtattcggattcggcggagtattgatcatcgatgtggtccagccgcaggtcgaacggctcaccgccatgattccgctgcttgccgtgcacgtgatatgcgcggtcgccgccatcgtcgttatcatcgacaccatcgtcaccgtggtgggcatcgtcggcctgtccgagcgtctcgccaaattcagcgaagcggtgcaggatcgtgcggagaaggccggagactcctggcagtggggcaaagaggagttccgggaaaagatgcatgatttgtcggaatcgtcgcaggaacgtgtcgccaatatgcgtcagcttgtctcttccgcgttgaattggcagcaacgtcgtatgatccgctccttcccacgcatgcgttccacggactccaccaaatacagcaagatcatggaaaccgtgcgtgagatgctgcgccgaaagtaagtttccaccggccacacgtgtcgtatagcatgtgtccaaaaacgatttgccccgccaacctgcgttgcgcacgctgacgggcaaaatccctttatgcatcacatcggataggggctacgacacttgcgatgtggccgaccccttgtaatcggtgatgccggcaccaatgttcggatgctgcgccgaatacgcctggtccacacagtagaacgccagaagcacgacggccacaacggtgagctttcttgtatcgatacgactcagcaagttgtccaatgcaggagccagcagatacacaatcgccaaaccgcccaaaccaaacgtcagcagaccctcggcacagatacgaccattgagattgagaaaataaccggtgtaatcccaccagcgttgtcctccgtgggtcttctccagataccaggacgagaagtactccaacccgccacacaagaccatggcggccaggaactcgaacaagggcttcttcctcaacttcttcagcagaataaggataatcactccgccggtgccatagatcggcagccatggcccatgcagcgtgccacgattcacgaacgttccttcggaaatgaaggcgaggctcacctcccatacccatcccacgaaacagaagatgaagaacatcatgaccagattgaccaacgaatagctgcgatcggagctgacggtgcgggattcgcggaaccggaacgccatcggcgccggagccagacgaccaggatagatagcgccgtccagaatctccctgccggtatcgatctggtgcagttgctcgcgatactcctcatacttggtcaccgaccgcgcatgcaggatacgcacgcccaaccattcggacaggaacccgacgaaaccgtttggcttgtccactggaacaagattgctggacaactgctccaccgtttcggcaacatcaccatacgcggcatgcaatgtctcagcggaggccttgctgtacaggtattcgtcgctgagcagctcgcttccctccaatcccgaatccttggacaatccgcgcacatgcacgtaatattcgacgaaaaacgccgcgttatagccgttggaatagaagatgccgctcaagccgagcgtgaacagattgagcagccaccagccaaggaacgacaggtcggccacgaaacactcccacttgtgacccttcatcatgcgcctggacaggctgatggcctcccgtgccccgatattcggattttcggcgacgatgtagggcaccatacggtaggaatacggtttgatgaacgcgccgatgatggtgaacgtccacaggaacaggaacacgttctcgagcagcatcaccttcgccatcgacaaccatttgcgcgtggtgatcgggtagagaaaacggctcacgggaagtttgtcgtaggtccgcccctcaagcagcatgcgcatcatgaccacccggtatgtctgctggacgaacagccatacgaaaaggtaaacggccagggatacgacgattggtacggccacggcgacgccgtcattatgcacgatggaattggccgcatcggccatcgacagaatgaccgaacccgatgagaacgagttgagcagagacgcgaacacgccgcgtttacgccccatcatggcattggtgtcgttttgcacgatctgctcctgattgtgctccacttgcctgcgtgcctggctttcatcgccgacaagcaggttctccaacactttcgacacgttgtcggattgcgctgtgccatcctcctgcacggttgcggacggggaactggcgttcaccgaccatgtcgacgaactgtaggcgacaccgaacaccgaagcgaacaggcagatgacgactatcatccaatagtgtctcttataggctttccttgcattggccttcatgcctttgcgatccatgcaggcctcccttcttctcgtcaatgagattccgttttcgattttaaccggcatgttccgtgatcgctttgataaaaacatggaaaacggcacacgcggctgtctgtgtcttctgcgaaactgtagggtgcgtaaaacgcggtaatgtccacaattcgatagggagaaagcacagttatggctcacgtcatcgatttcaaggaggccggtttcgattccgtcctcgatgaactggaatggcgcgggttgatttcccagtccactgacagggatcgactcgccgaagcgttgaacggagagcccatcacctattattgcggcttcgatccgaccgccgcctccctgcacatcggcaacctcgttcagctcatcaacatgcgccacctgcaggccgcaggacaccatccgatcgcgttggtcggcggcgccaccggcctgatcggagatccgcgccagtcgggcgaacgtacgctcaacccgaaggacgtcgtggccggctgggccgatcgtctgaagaagcagatcggcggcatcctcgagaccgaaggcagcaatccggtacgtttcgtgtccaactacgattggaccgcttcgatgaacgtcatcgacttcctgcgtgacgtcggcaagaatttccgtatgggcaccatgctcgccaaggacaccgtggcccgtcgcctcaactccgaggaaggcatctccttcactgagttcagctatcaggtgctgcagggcaacgacttcctgcacctgttcgacgagtaccattgcgtgctggagatcggcggctccgaccagtggggcaacctcacctccggtctggatctgatccacaaggtgcgcggcgtggacgtgaacgtgttcaccagcccgatcatcaccgacgcgcagggcaagaagttcggcaagtccgaaggcaacgccgtctggttggatggcacgatgcttagcccctacaagttctaccagttctggttcaaccgtcccgacagcgagatggagaacctgctcaaggcgttcaccttcctgccaaaggccgaaatcgaacggcttatcgagggaagcaagaccaatccgggcgcgcgtgaggcgcagcgcaccctcgcatgggaggtcaccagcttcgtgcatggcgaggaagccactcgccaggccatcgaagctgccggcgcgttgttcggacgtggcggcgatctggcggacatcgatgagtccacgcttgaggccgctatcgacggcatgaaggtcgatggggaattcgccaaggtcgcagccggcgaccgtgtggccgaggctggtatgaaggcaggcctgttcaagtcgatttccgaggcgcgcaagaccatcaagtccggtggcgtgtacctcaacaacacgcgcgtggaggatgaggaacagacgttgcaggaaggtgacttcctgcatggtcgtttcgtgctcatccgccgcggcaagaaggcgctcggcgtcgtcgaacaggcgtgagacgcataggcaatcgtaagtaaataatcgcaagtatctcaagaccaataaggaacagcatggcagaagaacagcgcggatcgcgcggcaagtcctacggcaaccacaagtcctacggctcgggcaggccgggtaaccgcggtggcaagggattcaagccgcgcggcaacggcggcaagtcctacggacacaagtccggcggcttccacaacgatgaccgtaagggcggatatcgcaagggcaatggcggcggataccgtcgtggcgaccgcgatttccatcgcgatggcgaaggcgaaggtcaggagcgtcgtttccacaacggtccgcgcaagttcaaccgcgatggcgagcgtcgtgacgaccgccgcggcggctatcgtggcaatcgcggcgacaatccgcgctaccagcgtgatggcgagcgttccggcttccgtcataatgaccgtcgtgacggcgatcgcagggatttccatcgtgacgaccgccatggtgatggcgagcgtcgcaatttccgtcatgacggtgaccgtcgtgacttccgccgtgacgatggtgagcgtcgtggcggccgcaatttccacaaggacggcgatcgcagggacttccgccgcgatgaccgccgcggggagcgccgtgatggcgagcgtcgtaatttccgtcgtgatgatcgtcgtgacggcgatcgcagggatttccgccgtgacaaccagcgtcgtgacttccacaaggatcgcgaccagcgtccggaaggcgaggagcgccgcgaattcacccgtgaagagaagatggagtaccgcgaggcgaagcgtggtgaatacctgtcgaagccacgtcgcaattccgacggcacgatgagcttcccgtcgcaaaacccgtacacgcatcgtcgcccgggcgagccgaagatgccgaagggcatcgagtggagcatgctgtccaccgatgaccgtgagcgtctgcgtggcctgtccaaagaacatgcggagaacatcggcctgcacatcctcgccgcctacacgcttgaggaaagggatccggagctggcgctcgaacacgccaagtgggtggcgcatcaggcttcccgtattgatttcgcgcgtgagacccttgcgttcgtggcctaccgtcagggcgattacaaactggccctgcgtgagttccgcaccgcgttccgcatgaacggtttccttgactatctgccgttcatcgccgactgcgagcgtggtatgggcgagccgaagaaggccatcgaaaccgccatgagcgatgacgcgaagtatctgcgcggcgaatccaaggccgagatgttcctcgtgtacgcgggcgcgctgggcgacctcgagctgtgggataaggccattgagatcgtgcatacgctgggccgttccaagggtctggccggcgaataccgcatgcgtgcggtgcaggccgaacagtacttcctcgagcaggccggacgctccgatgaggccgtggccctcgaccagctgcttgacaagcttgagctgcagtacgccgatgccgaagaggacgagacctccgacgatctggtcatcgaatacgacatgcaggaattgaacgacgagcttatggacaagctcggcatttccgaagatgacgcccagtatgcgccggaagacgaggatgaggacgattccgaggccgtcgacgagaacggcgagaccaacgatgagacccagcttgatgccgaagcggccaaggaaggcgccgagtccgacgacgagcctgccggtgacggcgaaaacgcgggcgactccgaagacgaccagactgaggatgaggtcgaatccgcagccgattccgacaacgagtgaggtgcggcaaaacaatgctgaaatccacaacccgtccgctgagcgaagcctaccagctggcgctgcttgatcttgacggcgtggtctaccgtggcaagaatccggtggaacatgctgcagagagcatccgcaaggccgaaggcctcggcatgacggtggaatacaccaccaacaattcctcccgactgcaatccgtggtggccgaccagcttaagggcttcgaccttgacgtcgaaccatggcaggtcatcacctcgtccgtggtggctgcccgtatggtggcccgtgcggtgccgcaaggtgcgaaagtgtttgtgctcggagcacagcatctgcgtgaggaagtcgccaagcagggtcttgaagtggttgattccgccgaagacaagccggtcgcggccatccaaggctggtacccggacatgtcttggaaccagatggcgcaaatcgcctacgccgtagaacagggcgccacgtatttcgtgaccaaccgcgacctgaccattccgcgtgagctgggcatcgcccccggttgcggttccatgatcatggccgtcatcaacgccactggtgtggaaccggtttcgtccgcaggcaagccggaatccgccatgtatgacgaagcccgactgcttgccgcgcatgatggtgccgaaccagtggccaaggaagcatgcctcgccatcggtgaccgtctcgataccgatatcgaagccggcaatcgtggcggctatgattccctggccgtgctgaccggcgtcaccaatccgcatgagctgatgttcgctccggagcatctgcgtccgacctacatcgccaaggacctgaccggacttaacgagccggcccccgaagtcgtgcatgaggctggcgcttggagctgccgcgacgtgcaggcgtgcgtcgacggcgatcgtctttacgtcaccgacatcaccagcgtcgacggtcttcgtgcggcctgcgccgccatgtgggatgcggcggatcgcggacacagcgtcgacggcatgatcgtgccggaattccgaatcgcctgattgccgcacgtgcgtatgcgcaacatgaatgacgattccggtgccgtcgtccgactcgacatcgcgctggtggagcgtggcgtcacggacagccgctccaaagcacaacggctgatcgaatccggcaaggtccgggtgaacggcatcgtcgcatccaaagcgtcgctcaaagtcacggccgccgacacgcttgatgccgatctgggagacgattacgtctcccgtggagcctacaagttggtcggcgcgttcgacatgttctcccagacgggcctgcgttccgcggaaggattcgattgcctcgacatcggcgcgtccaccggcggtttctgcgacgtgcttctgcgacgcggtgctgcgcatgtgatcgcgctcgacgtggggcacggccagcttgacccgcgcatcgcaggcaacgagcgcatcatcgaaatgagcggcgtcaacatccgcgacgtcgaagcggatgatctgccgtaccggccaagcatgatcgtatccgacgtgtcattcatctcgttgacatacgtgattcccgtcatcgcgcgcatcgccgcgcccggcgcacacgtcgtgctgctggtcaaaccgcagttcgaagtcggcaaaggcaacctcggcaaaaacggcatcgtggaaagcgaaaccttacgcaaacaggcgctcgacaccgtcaccgcctgcgcgaaagccaacggactggatgtacgcgccacggcggtctcaccgatcgaaggcacgcacggcaacatcgagtatctgctgtatgcagtggcgtaaaccgttctccgccaatcgatagcgtaaaaatgaaaggccggcggcccatatgaaaaatcccatatggaccgccggccttttgcatgttccgtgggcctagcccctcaaaaacttgtcgatctgatcctgcttgcccatgatgatgagctcgtcgttacggtgcataatcagctctttcgaaccgtattcgaattccttgcccggcgatttgacaccgaccacggtgatgccgaaccgttcatgtacgcgcgcatcctcgatggagtaaccgacgacatgcgggggagtgtggatcttcaccacgctgtacgcgccttcaagctcgatgtagtccagatagttgccggacaccaagtgccctacgcgtttgccggcatcggtctccgcgttgatgatgtgccgtgcgccgatacgctgcagaatgcgcgcatgctccttggacaccgacttcgcccaaatgtcggagatgcccgcgtccagcagattgccggcggtgatgacggacgcttcgacgctgtcgccgatggctacgaccgccgtgtcgaaatcggaggcgttgatctgctccaacgccatcacgtcggtcatgtcggcctgcacggtggggatctgcgacgaccagcggttcaccagttcgccgtccttgtcgacggcgagcacatcctgtcccatcgtatccaatgtggtggctacggaactgccgaaacggccgagtcctaccacaagaacgcttctggtgttgttagccatgattgttcgcgtacctttcgatgttctgttccggattcaagtataggaagttgcgggtatagaaaccgtatcgacgaatccgctcagccgaccacgatctgctcggtggggtagcggaccggctccacattgcgcggcctggagatcgcgtaggcgatggtgagcggaccgagcctgccgatgaacatggtcgcggcgagaatgtacaggaccgctggactagaagcgctggccacgccgaccgaatagcctcccagaccgaacgccgagcaggtgtcgaacagcgcgttgctcagcgagcatccggtgatggccatcaatgtcatggacactatggtgacgagtgccagacatgaggtggtgacggccacggccgtcatgacggcttgcgaatggatgcgacgatggaatgcgttgacgtcatggcgtccggtgaacgcggcgcggcaggtcaacagaatcacggcgaatgtggtgacgcggatgccgcctgcggtcgaagtgctgccgccgccgatgaacatgacgatggacaggaacaccttcgtcgcgtcgctcacgcccggcatccatgacaggtcgaagccggagctgcggggcatgacggccgccaccatcgcatgccacaaccgcggttccacgccttcggtggcgaacagcagtttgttgttccattccatgaggaggaaccaggtgaacgaggcgagcacgatgcagaacgtggtggtcagcgtgagcttggtatgcaggctccaacgcttcggcggacgatggttgcgccatgagcgcatgaggttaagcaggacgggaaagccgagcgtgccgcagaacgcgctgacgaggataggcaggccaacagcccaattgttgacatgcaggccggcgccgtcaggggtgaagccggcgttgttgtatgccatgaccgcgaagaacaacgattcccacagcgtgtgccgcacattgccatgattgactttgtacaggccggggaacagcgccacgaacgtgatgccttcgatggtgaacgcggtggcgatgaccacggtgagcacgcccttgatctcgccgagtttcgtggtgcccagctcgttggccgtcagcagcttttgcgtggccttgagatggtggttcacggccaaggcgatgagtgaagcgaacgtcatgacacccaagccgcccatctgcacggagaagatgagcacggcctggccgaaagcggaccaatgcgtcgtcgaattgacgatggagatgccacacgtcgaaatcgcggagatcgcggtgaagaacgcggtggtgaatgtcgtttgctcgcctttcggcgtggcggtgggcgtgagcaggagcagcgtggacaatgcgcccaacatcatgaagtacaggatggtcagacgtccgggatgtgtggtgagtctgtgcattaggctgcgcttgcgcggcttgcgctcctccgccatggccttctcgaacgtgtccccggagaaccaccaggcatagccatgtgaggcctcgcgattggaggaggactcgtcgaagacgaggttggacatgctgttcctcgctccttgtctgtataaacggtcttcgtttccttgagctattgtagacggtagtgtgacgaacggtgcagagacataccattcggcctgttcggcggattcgtgggaaaacgacgaacaggttttgcgggtgggatgtacgtggctcgtgaacgaacggaaacgtctgcggcgtgtccggacacccgctaccgccattcgttcatttgttcgattacaatggtaggcatcggcgtccgtcgaggacgtggtatgtacgagagttctcggaaagggcttgcgatgcacggtacccggcatgcggtggtagtgacgcatacacgtctgcgtgaaagcggcacggtggtcgaagaagccgtcgaacagctgcggcgcgccgatttcgaagtgacgatcatcgacaatatcgaagcgcccgatttcggcagcaagacgccagtagtgccgaaaaacacggaaatcgtggtcgtgcttggcggggacggtaccattctgcgcgcggccgaactggttcattgcactgaagtgcccatcctcggcgtgaacctagggcatgtcggctttcttgccgaatttgaaagcttccagatgagcgaggcgatccgtcggatcgccgaccacgactattccatcgacgaacgtatgatcgcccacgtcgacgtatggctgccgggcgcgacggaacccatcgaggactgggcgttgaacgacatcactttggaacgtgcggaccgtggcaagatggtggaattgtccatccgtgtcgacgacgtggagatgagctcattcggttgcgatggcgtgatcgtatccacgccgaccggttccaccgcctacgcgttttccgcgggcgggccgatcatgtggccgaatgtgaaagccttgcaattggtgccgttggcggcgcatgcgttgttcgcacgtccgctcatcatcggttccggctccacgttcgccatcgacattctcgaggattccacgtcggatggctggatctgctgcgacggccgtcgtcaacgcgcactgcccaaaggcacacgtgtcgaagtgcgtgaatcgaaatgcactttgcgattggctcgtttgtctggcgtgccgttcacgaaccggctcgtcaccaaatttgatttgcctgtcgtcggctggcgcgagcaggcgcgcaaaaccggtggcatacatcatgggcaatcgttccctagaaccggcaaaccggaaagcgggaagtgaccgggcatgctggaagagcttgagattcacaatctcggtccgattcgttccgctctgatcgccccggcaggtggtatgacggcgatcaccggtgagacgggagccggcaaatcgatgctgctcagtgcgatccgactgatttccggcggtccgtccgatggaggccgcgtttcggtgggcgctcaggaggcgtgggcgcagggtgtgttcgaagtcgcctcgtcgccggccgcggtggccgcggcacgggaagccggcttcgaaccggaggatggcgagctgtttctgtcgcgtaaagtgcccgcttccgggcgatcccgcagcatgctgtcgggacgtagcgtgccgcgttccgtactcgcctccgtcgccgccgaactggtgacgattcacggacaggccgaccaattgcgcatagcgactacctcacgtcagcgcgaattccttgaccgctatgcgggagacgaagtggctttggccgcctacggcaagtcgtggagcgcgttgcgcgcgatggacgagcggttggaacggctcaacagccaggaatcgtccatgcgacagcaggcggattatctgcgcgaatcaatcgaacgcatcaaccgtgtcgacccgcagccgggggagatggacgaattgcgtgcgcgccgcgaccgcatcgaaaacgcggccgagatcgccgaaggcgtgacgcgagcgttgggcgcgttggacgcctcgcaggtggtggacgatgtcgaatcgtccagcgcggccgatttgatcgaccatgcttcgcaggcgttgcgcgccatccatgtggaaggcgtgttctccgaactcgccgaccggctcgactccatcagcaccgatttgtccgacgtggtgttcagcctgtcgggagaagtggacaacgaagcgagtatggaggatttggacgccatcaacgggcgcatccacgagctggacgagctgacccgccgatgggggccggaattgtccgacgtgatcgcatggcgagacaaggccgtatacgatctggaggatctggacgcctccccggaaaaggtcgaacagctggaagccaaacgggcgcagttgcttaacgcggcgaaaaaagccgcgcaggctgtaagcaaacggcgcaggaccgcggccaaggagcttgcttccaaagtcaccgccgaacttgactcgctggccatgggcacttcgaaacttgagattcgcgtggccgaacgcgaacagttggacgccaccggagcggacgacatcgaattcctcttcaccccgttccccggctccccgcaactgccgatgggcaaaagcgcatccggcggcgagctgagccgtctgatgctcgcgctcgaattggtggccgctgaaaagcatgtcgtggccggcggaaccgtgccgccgatgacgttcatcttcgatgaggtcgacgccggcgtgggtggcaaggccgctgtggagctgggtgcccgcttggccaaactcgcccaatccgcgcaggttctggtcgtcacgcacctgccgcaggtcgcctcctgggcggacgaacagtatgtggttgccaaaggcgaaaccaaggatggttccatcgccaccaccatcagccaggtgcgcggggatgagcgcgtgcacgaaatcgcccgcatgctgtccggcagcgaaagcgaaacatctctggaacatgccgaggaactgctcaaatcgtcggtgcttgactgacggcggattcaatcgtaaaaagtaatcgcaaatcgcaaaagcggtaattgcaaaacaaaggagccgatatgacacaggaaaccaaggcgaaccaaggcaaaggcgccatcttcgaccttgacggcacgctactcgactccatgggcgtgtgggatcaggtggacgtcgacttccttgccaaacgcggcatcgaggtgccggacgactacatgcagaaggtcgcggccatgcaattccgccagatcgccgaatacacaatcgcacgattcggcctgtcggacactcccgaagcgttgatggaggagtgggaccatatggcacgtgtcatgtacgccacggtggttgaagccaaaccgtatgcgcgcgaatatctggaatcgttgaaggcgagcggcgcgaaactggccgtggccacgtcattgccgccgatgctgcgcgaaccggccatgaagcacgtcggcattttcgactatttcgatgacgtggtcagcgtcgacgatgctggcgacgtcggcaaaactgagccggacgtatatctgctggccgcgtcgcgtctcggcatcaaaccaagcgactgcaccgtattcgaggatctgctggtcggcatgcgctcggccaagtcggtcggcatgcatgtgtgggccatgcacgacgattcctccgacgccgactggcctgagatctgcgatctggccgacggcgtcatgttcgacttccacgacgcgcccgtcatactgtaacggtttgcatcatcgcctgatgtttccgggccattgcgtgattcgaccgcttcacgctttcatgacgccgatcaggtccatatcttgttgagcctcatgaagacgcggctcatgattgttccctatacgccttctcgaacatgccaagcagatcaagcaggctgatgtcggcggccttggcggcggttaccgtctgccggaacacgtccatgatgcgttcgcgcgcacgttccttcataagctcgttgccgtgggccagcacgaacgtgcctttgccctgcacattctcgacaagcccctcatccgccagctcgctgtacgctctggcgatggtgagcacgctgatgtgcagttccttggcaagcttcctgagggaggggagcgcctcgccggtttgcagttcgcccgacatgatcgccgctcggatctgatcttcgatctgttcgtaaatcggtttgccggacgcggatgagatgttcagcttcactgtatccctttctgcgagtgatatatatcctgaccgaacagtgtacgcaaactgttcaacagctatatataacagtaacacagatttggccatgctgttattatatgatctataacagcatggccgtaattgaaaaccttggtattccgccattctgaacagttagtgcctaccggctgcggtgcctgtccgttacttgtgcgacggatggatgagacggtggaaggacaggtagatcagccaagacaccggcagcgccagcatgaacaggggatagaaccatgcgatcggcaggtgcccatagagaactccagccagcaccggccccaacgccatacccaagtcgatgcccatatagtacgtgccgttggccaagccactgcgctcccggccggcgatcaccaccgcctgcgcctgcgtgacggaactcatcagtccataactggccgccatggcgatgcccgcgccaagcagataccaatcgttcgtcatgaacgtgagaaaggcaagcgacgccaacatcgcaaacgaacagacgacaagccagaaacggaaacccttcgaatcgaacaggtcgcgcaacgtgagccgcagtaccagcagcgcggccgcatagaacacgaagaataagtcggacgagatacgcagatgtcgtgcggaaatgtaatccaccaggaacgactggttcgcgaaataagggatggcgaacatcatgaacaccgcggccaatggaatggcccgtggctccaccagattgcgaagacgcagacgatgccgtaacgactgttcggcggcaacggttttacgagccggcctgccaccgtttttcaccagcagaaccgttacgaacgcgcacacgttaagcgtcagcgatgcgatgaacgtccactggtagccgacggccgcctgcagacggatgccgagtgccgggccgaccgcaatcgccaacgcgttgacgatgccgtacaatcccatgcccgcgcccatatgccggatcggaagcagcagcgacacccacgtcgccagacaaaccgtgccgcatgcgaagccaagcccgttgaccatgcgcgccgcgaccagcatgcccgtcgaatcggcaagacaatacatgacgcccgccacgatgtacagcaccgttcccgcagccaccagcaacctcttgctgaccaaatccgacagattgcccgcgatgggacggcagaacagagacacgaaactcatcgcgccggcgatcacgcccatcagcgcgcccgtcgctcccatcgactcgccatagccggcgatgaccggcgtgatcaccatgttgctggtcatgaagaagaacgtcgccagcatcaccagcgccacgtcacgggtgatgagccggtccttcctcggttccgcgggttcatccggccgatttgccgttacgcccgactgcgatgctgaagctacgctcatgattctcctgcctttcgggaacgcactgtaccagcgtcaatgaaaaacggccgcccgcgtatcgcggacagccgattcttctatgtatcgttgccgttttgcctgtcgaaaccttacagcgccttcgcggcctgctcgacgaatccttccatgccgtcgatttcgacgacgttatcgaaacgcacgtcggcggtctcaagaccgcgcagcgcggccggagcggtggtgccggtggccttggcaagcacgtccatgcattcgaaatcggtgccggacgcgtcaagacccagagattcgttgactacgcgcgggaacttgtacgggctggcggtggacagcagcacgcgcggcgtgagcggatcgcgcggcatctgctgcatgacgtagtagccgcatgcggtgtgcgggtcgatcacgtaatggttcttgttccagcagtccgcgatcatctcgcgcacctggttctcatcggcccaaccggtgccgaagatggaacgaatcttcttcatcatcggctcgggaacctcgtaggcgccccactggctcagatcgttcatcagcatggagatcaggcgtgtgtccttgtcggacatgtaatacagcatgcgctccaggttcgatgagatgaggatatccatcgacggggaaatggtctggaagaacggacgctgacggttgtacgtgccggaagtcaggaagtcgaacagcacgttgttcttgtcggacgccaccacaagatgcttgaccggcaggcccagcagtttcgcgtaatagccggcgaggatgtcgccgaaattacccgtcggcacaacgaactcgacctcgtcgcccacattgatgacctggcgttccagcagctgcgcgtacgcggagaagtaatagacgacctgcggcaccagacggcccacattgatggaattcgcggaggaaagcaccacatgcgaatcatcggcgagacgttcggcaagctccttgtcgccgaagatgcgcttgacggcggactgcgcgtcatcgaaattgcccttgaccgcgcacacgttcacattggagccggactgcgtggtcatctgcagctcctgcacctggctgaccttgccttccggatagaacacggtgatgccggtgcccgcggcgtccgcgaaaccagccaacgcggccttgccggtgtcgccggacgtggcggtgacgatcatgatcttctcatccgcgtcgccatccgccggagtggtgcgcgccatgaaacgcggcagaatctgcagcgccacatctttgaacgcggaagtcggaccgttgaacagttccatcacatagtcatcgccgagcggcttgaccggagtgatcttctcgtcggaccactgcgggccgtacgcctcgtcgatgcactccttgagctcggcctcggtgtagtccggcagcagcacggacagcacatcgaacgcgatctgctggtaggacttgccggccaaggaagcgatatccacatgggtctcacccaaggagtcggtcacgaacaggccgccatcatcggcgatgcccttgcggatggcctgcttggaggtaagcgaatcggtggtgctgcgtgtgctgtggaacgtggtcacttgatttccttagcaatagaacggacagattacgtcaaacgtgcttctcagtgtaccggcacaggtgggaagaacgtcgcctcgcgtccgtggaatgggacgccgaccccatacgattgccgacggaaggtcctgcttttccacgtggcaccgcgatcgtgccgtccatgtcttcgcgcgcaggcggtgccatatttcccacatgtttcgaaacccggttttcctccgatcgttttcacacgtacactgctctgtaacccgcggtacagcggatgatcattccgaagtcaaggagggcttcatgactgcatcacctcttgcgcaaacaccgaacgacatgttcaacgcgcccatcgccgaagcggatccggaaatcgccgaaatcctcgacgccgaactgtccaggcagcaaaacggactcgaaatgatcgcatccgagaatttcgtgcctcgcgccgtcctacaggcacaaggctccgtgctgaccaacaaatacgccgaaggctatccgggacgccgctactacggcggctgcgagcaggtggacaaaatcgaaaccatcgcccgcgaacgcgccaaaagcctattcggcgccgaatacgccaacgtacagccgcactccggcgcacaggccaacgcagccgtctaccaggcgctcgtcaaacccggcgacacggtcctcggcctcgccctcgaccacggcggccacctcacccatggcatgaaaatcaacttctccggccgcttctaccacgccgaagcctacggcgtgaatcccgaaaccttccgcatcgacccggaaatcatccgccagcgtgcgctcgaaacccatcccgccatgatcatcggcggatggagcgcctacccgcgcatcgaagacttcaaagccatgaaggagatcgccgacgaggtcggcgccaaattctgggtggacatggcccacttcgccggcctcatagccgccggactgcatccaagccccgtcccatacgccgacgtcgtatcctccaccgcacacaaaaccctcggcggcccacgctccggcttcatcctcgccaagcaggaatacgccaagaaactcaactccgccgtattccccggccagcaaggcggcccgctcatgcacgtcatcgccggcaaggccgtcgccttcaaagtcgccgccaccccggaattcaaagaccgcatgcaacgcaccctcgacggcgccaagatccttgccgaacgcctcatggccgacgacgtcaaaaacaacggcatcagcgtcctgaccggcggcaccgacgtgcacctggtcatggtcgacctacgcaacagcgaaatggacggcaaacaaggcgaagacctgctcgcacaatgcggcatcaccatcaaccgcaacaccgtcccgttcgacccacgccccgcatccgtggcctccggcctgcgcatcggcaccagcgcactcgccacccgcgggttcggacccaaggaatacgaggaagtcgccgacatcatcggcaccgctctcgccgcaggacaggacgccgacgtcgacgcgctcaaggcgcgcgtcgacaagcttgccgaagacttcccgctttacccgggactcgaccaaatccactgatcaccagcctcgactgacgaaatcgcgtcccgccgcgcaaccaacgacccgaaaatggccgtcattgcccagcgaggcgtgatttcgcgctattctaagagactatgacgaatccacagaaccaaggcaccgccatgaacgccgacgtgttcgaagcagtatgcgccatgggcgacgcagcccgcaccgcgcaatcgcaacttgcccaggcaaacaccgaagccaaaaaccaactgctcaacgccatcgccgacgcactcgaccagcatgcggacgacatcgccgcagccaacacgctcgacatgaaccaagccgaaaccgacggcatggacgccggcaaactcgaccgactcaaattcgaccagcagcgcatcaccgccgccgcacaaggcgtacgccacgtggcatccctaccagaccccatcggcgaaatcgtacgcggataccatctggaaaacggcctacgactgcagcaggtacgcgtccccatcggcgtgctcggcatgatctacgaagcgcgccccaacgtcaccgtcgacgttgcctccctatgcatcaaatccggcaacgccgtcctgctgcgcggcggacacgcggccgaacacaccaacgcggcaacactcgccgtcatcgccgacgtactcaccaaacacggatacgaccacaacatgatcgccaccgtagaccaatacggacgcgacggcgccaccgccatgatggaagcacgcggccacatcgacgtgctcatcccacgcgggggagcaggactcatccaagccgtggtacgcaactccaaagtccccgtcatcgaaaccggagccggcaacgtgcacatctacgtcgaccgcaccggcaaccccgacaaagccatccccatcctcatcaacgccaaaacccaacgcgtcggcgtatgcaacgccaccgaaaaactcctcgtccacaaagacatcgccgaaagcttcctgccgaaagccgcggcagcgctcgccgcagcgggagtcgaaatgcatgccgacgaacgcgcgtatgacatcatcgaacatgccggaatcgcaaatgcgcaactcgtgcatgccaccgacgaggattgggacaccgaatatctggcactcaaaatcggcatcaaggtggtcgactcgcttgacgaggccatcgcgcatatcaaccgccactccaccgggcacaccgaatccatcatcgccgaagactattcggccatcgaggaattcaccgcccgcatcgactcggcggtggtgatggtcaacgcctccacacgtttcaccgatggcggcgtgttcggattcggcgcggaacttggcatctccacacagaagatgcatgcgcgcggtccgatggggctgcgcgagatgaccacgaccaaatggattggctacggaacaggacaggtgagagaatgagcgacgaagtcatgcaggacaatatgcagcacaccatgcaggacaacaagaacccatggaacgcggaattgaccgacccaatgctcagattgcgattggcgtccgaacgattgagcatcgtgcggtatgtgttccttgtgcaggtcgaagacggtatcgcgtcagcggacgaacgcgcctcgctcgaatacgccgacgcggtgctgatcggctggcccgaaaccgacgcttcggacgtcatcactcccgatgccgcccagcttgacgatatcgacgagcagatgcgggtcatggaacagcacatcgccaagttcagcgcgatggaacgagaccatgacatcgtcggcatgaccgacacgctgattcgtgtcaccgagcgcgttgccggaatccgcagtatataccagccggatttcccgctgccgacattcgccgagattcgacgtgtggtgcaggacgagtgggatgaggatatggacaagatcgatcctgacaacgcctcaccgaccgcggacagcatcgagcaggaaaccgccgacgcggacaaagagcagcaggccgagaaacaggccgaacagcaggccgatggcgcgcaaaagagcggagcgtccgcatgaccggaccaaaacgcatgcggccggaatctgcggaggccgatcccgaactgaccgtcagctacgtggtcgagccggaacgacgcatgtcggaactatccgtagaccggccgcaatcagccgtggccaccggacacaggtccgcgcgaggcaactggcacaaccggttgcgcatcggcatcatgggcggcactttcgacccgatccataacggccacttggtcgcagcctccgaagtgtcctgggtgtacgacctcgacgaggtgatcttcgtgccgaccggacggccggtgttcaagttggacaagaaggtcaccaatgcggaggaccggtaccttatgacggtcatcgccaccgcgtcgaacccgaaattcaccgtgtcgcgcgtggacatcgaccgtcccggcgtcacctacaccatcgacaccctgcgtgacatccgcgcccagtatcccgatgcggaactgttcttcatcaccggtgccgacgccgtggcggagatcatgcaatggaaggacgccaacaagatgtgggagctggcgcatttcgtggccgtgacacgtcccggttattcctcgccggacggcgtgaaattacctgaaggcaaggtggatacgctggagattcccgcattggcgatttcctccacggatgtgcgtcgccgcgccgaacatggcgaacccgtctggtatctcgtacccgatggcgtggtgcaatacatcggcaaacacggcctataccgatagaagatggatggggccgtccgcatggcccccgaacacacggggtcggtgaggtctgcgcggccggttagtatgggtcacatccacttcgctagaacagacgtttggagacacggtgagcgcaatccttgaaggaaagccggataagaaccttatccttgtcacaggcagagcacacccgaagctggcggcggaagtcgccgaacagctcggcattgatgttctggaaaccacagcatacgattttgcgaacggcgaaatgtacgtgcgctacaccgaatccgtgcgaggcgcggacgtgttcgtactgcagagccattccaatccggtcaaccaggccatcatggaacagctcattatgattgatgcgttgaagcgtgcttccgcgcgttccatcaccgcggtctgcccgctgctgggctattcccgccaggataagaagcaccgcggccgcgagcccatctcctgccgtctggtgtttgacctgctcaagaccgcaggcgccgaccgcatcatgagcgtcgatctgcatgcggcgcagtcgcaaggcttctttgacggcccggtcgatcatctcatcgccatgccggtgctggtcgattacatccgtgaccgtttctccaaccaacttgacaacgtcgccgtcgtctccccggacgccggtcgtatccgtgttgccgaacagtgggcgcagcgcctcggcggcggtccgctcgccttcgtgcacaagacccgcgacatcacccgcccgaatcaggcggtcgccaaccgtgtggtcggcgacgtcgcaggcaaggactgcgtgcttgtcgacgacctgattgacaccgcaggcaccatcgccggcgcatgcaacgtgcttaaggatgccggagccaagtcggtgaccgtcgtcgccacgcatggcgtgctgtccggcccggccgtggaccgactgaagaactgcggggcacgcgaggtcgtgctcaccgataccgtgccgattccggaagaaaagcgttgggacggtctgactgttctgtcgatcgcgccgttgctggcaagtgccatccgcgccgtgttcgaagacggttccgtcgccgaactgttcgacacgtatccggaacatcacggccagggcttcctgttcgcctgattttctaggaaactcggatacttctgacacttcagatatttcgaggttttacgttatacgggttccggttcattcggaacccgttttctttatgcttttcgctgcattgcacgctgacggttgcgcggatgggagtgtttccgccatgccgtacgggccgatccgacttgttcgaatggtaatgcgtgtggaacgtcatgatgcccccgcatcttaaaaaataatcgtcagtccggcatcagacctgtacgcctgcgagcttcaggaacttcttgtcggactggatgccttgagtcaggaactctccgtccttgaacagcgcgtaggtcgtgaccggagctggcgtattctgggcctgctcacggctgatgatgtgaatggtttttaatggaatgctgtgctcttccgccaccgcttccacgcgtggcacccagtagtgggtgaacggacactggtccgtgtagtagagaacgaatccatcaccatctgctgcgggatatttggcgcattctttgaattgcggaggctccgtgtccgaaccgaacggcaggtacatgagcatgattccgcatgatgacgtgtccgcaaccatgaaacccttgtgcgcaaggtatttcgcgtcggagaggaattcgcgcttgcgtccttcggcagacaaaatacacaatcccttccgcccctgctccttcgcatccctcacgcacccccgtaacaggtcgttggaatatccgtgccctttcatggagccggcgacccatagacagtcgatgtaaagatacccgtccgcttggataggaacccacgcgttctccgcggggatatattcgatgaagcattttccgcgttctacgctgcggtagaagatcaatccttcgtcgaatcgacgtttgagccactcctttttcgcaagggcctgtttgccggacatggcgcagcagacgtgctctgcatcgatgttgtccctggtaattcgaatgtattccattcgtgacctccttgtcttgcgcggttccgcccatgttgccgcctatggcgtgggattattgccgagtctactggaaggcgtcgttccttgacatcagcgttgctccgaaaaaacgagattccggtttccatgacgttttcagacttccgtattttagatatttagacaaacgtctaaatatctggtaggatgaatatcgcaatccgatactggaaagagagcgatgatggcaggagaaggattcaaggcgctcgccgaccccacgcggcgtcgtatcctcgagctgctgcgtgcgggggatatgaccgcgggggagctcgcggagcatttcgacatcagcaagccatcgctcagtcaccatctggcgactcttaggaacgctggtctcgtaacggacgaacgacatgggcagaacatcgtgtacagcctcaataccacagttatgcaggacttggtcggatggttcatgggcttcgcggacgatccggaagacaggcaatgaaaggtctgacaatgcaaaagcaggaaaaacccgagacaaccaaagcctcgaccggtattccggcccgtgtatgggtcgtcctcatgctgctttgcgtgctgaacgtcgtggcgcatcttgccgccatgccggggctacctgagcgcattcccatgcattggggtgctgacggcggtgtgaacggatgggggccacgttggatggcatccgttctgggtgcgcttccattgacgtttctcgcactgttctatgtggtgccgcgcattgatccgaaaggtgccgcatatgccaagttcggcggattctaccaaggattcgtgatctcgttcacggtattcatgtgcgccatcagctggcttggggaactcaccgtctggaacctccttcctggcaagggcgcggtcaacgtcatcgtgtccggggcgatcggcgcgttcttcatcggcatgggtaattatctacctcgtgtgcggcaaaactacacgctcggcatcaaaacgccatgggcgctcgacgaccccgacaactggcgccgcacccaccgtttcggcggagcctgtttcatggtggtgggcgttagcctgattgtgctgggatttttaggaggtatattgcctgaaacctggattctggcagtgattatggtgcttgcgattggctcggtcgcagccatgtatgtttactcgtatctcatctggcgcaaatcccacaacagctgattgggtagcacccccggttttcttcagcgaaaccacaggggagtccgacccgaattgcctgaccgtgcgggtcgtgttgacgcggataaacggataaaagacaccccggtgacatggaaaccagcggttagcatggggggctcgtacttgtaagtgcaacaggcattccgatgatgtttgattttcctgcatgcaaacccgtcgtgttctttatttctgttgtattgcgagcagtacggtggcgcgcaggacgtcctcgtcggtgaaattcaggccccatatgatctcgaccttgtcggtgaggcgcttctgcacgccgccgacgatcgccgtggcgtcggacagttggaggctcttcggaccttcgatggcgattatcgctcccgtgacctcgtcggacgcgacgctcgaatcatggaaccgtccgtcgagcgcctccacgatgcccgtcgacgacccgctttccacgcggatgaccgtggtcagggcgccggcgcagacgcttctgacgtcgtccccatcgatgtggatgtacttgttgttgccgaggaatccctccaacgccgcgacggcatcgtccatcgtcgtggcgggatcctcttccgggacgggcaggaggtccacgtccacgcggtccgtggcgtccgttccggctgccggcatgcggacggtcagttcccgttcgccgtcgttttcgttccataggatcttgacgacatggcttccgtccgtcttgtccgtggcgtcgatgtgtcgtgcggtcatttttggttccttttcgatgaggcgggttcgtttctttccggggcatgtcccggccgttcttacttctgtcgatgccggacgggcgtgtggtccgatcggggcgagtgcgaatcaggacgggggtcggcatgggcgtcgtggatcggcgacgagtcccaaaaacgtcaccgatccacgacgcaatcccgacacccgtttcgcagccgaggacgatggcggaaggggcattggcgcggttcttgccggccacgacggaagacgtggtctgtgcgagagtgctatgccttggctagcttcttatgtctgagggtgtaaacggcatcggcggaatcggcgacacgtttggaatgcgtcaccacaatgacacatttaccgagttgatgagcggcatgccgcaaaagatcaatcacctcatcagtcatttccggatccaggctgccagtcggttcatccgccagaatcgcgcggccgggcgccaccagggcgcggccgaccgccacccgctgacgttggccacccgacaagtgcatgatgttgcgcttcgattcctcacggctcagccccagatcctcgaggatcttcatatcggccttgggattgaccaggcgcagattctcttcgggggtgagatagtcgatcagattatggtcctggaacaccaaggacacgtgctcgcgacggtgctttgaataacccgtcgcagctatatcctcgccctcaaaacgaaccactccatcagagggggcatccagaccggccaacagagacagcaaagtgctctttcccgctcccgatggaccggttatcgcatacatctttccggattcgaaatctgcgttcacgtccgaaagaacgcgaatcttcgccgcgccatatgagtaattgacatggtccaattgcagacagatagtcataattagtatctcctaacgcatagaggaaagaatggatttcggggatttggccagcactgcggcgcacgacacggcaagcgcgatcgcgatgaccgcgcatccgagcagcaggatgagcagcgtctgttccggcggcagagcctccacctgcaatgattcaagaggtgcgactcccgaatcgtgcagcaggagcaaggacacgtaaccggacaatagggagcccgttcccagcgagcacagggcggcgaccacagccatgagaccggtttcgatcgcgaactgggcgataatctgcatcttgccgatgccgagggccagaagggtgcctatctcatggatgcgtgagcgaatccagaagacaagcgccatgcccaataccagcacatcggccaggcagacggacaacagcaccatgcggaccagatcgcgtaccgtttccaccgactgcagcacgccggaaagccgcgccgagtcatcggtgacgccatactcgcttccggcgattttctttgcttgggccactgcggcggaaagatcccgcggattatccgagaggcaccggatcgtgccgacccgttcctctccagtcagcgcggaaaccacttgagcgcccgaatagatgagattctccgatgcgtccgatggcatagggctctgtgcctgtacattgccagagaagattccggccacgcgaacggtggaatcgcggccttcctgactgagtcggaaggtcgatcccaccgatagtccattctcacgtgcgaaatcccggtgaatcagtacgttccggccattacctgaaatgtggtgtccttgttccaaccggtacaggccgctttggaactcttcggacaacgaggagtcagtggtgcccagcacgctgacctgcgtggatagaccggaatccagtcgaggaccatgttcggggacaaccggatgcgcgccatccacctgcgccagggtcttacgttcgtaaacggttttccctacgccggggatgcgtgagaaccggctcgcttcctttggactgacgggattctcgccggtgtcgacggtaaaacccattcccaggcttccgccgatatcgtcggacattttctgaagcgccgttgacgctccgacctgagccacgagactggtgaaaaccatcagcatcaacagtccgatgattccgctgcgtaccggtttacgtacgattgccagcgtggcacgcttccacacgttcatgcccgtcatcggagctccgacaggcttcgtggcgacttgcgcagcatcggtatgcacgatatggcgacgcataccagcatcaccgccagcaggccgagcgatacatacagtacggcggttgcgtcgatcgataccgtgagcgaatccaaggtacgaaccgacatattggactcaagatcgccgccgacctgtcccatgctgctcagttccttcgccgcggaggcgttcacggaacggagggccgaggtgccaagccattgggccgctccccgtgcgcacagccatccgaggaccagggacggcaggccgatcagaatcatctcggttagatattgggcgatcagggatggcttgccgatgccgagggacaccaatacgcccatctcctgacgtcggtcgttcatccacagcaagagcatgaggctgaggactatcactgccgagatggtcacgccgatcaaagcgccgcgcatcatggagcgcacacttcgggcggcattcagcatgctcgacgtatattggtcattgcgcgtgatctggtagttgttccaatccaccggaagcttcttcgccgcttccatggttttctccacgtcgacacccctatccagaacgaaagtggcatcctggtatatttccttgccggccttgtactggtacagagtacttgtagtgtccaaatcggtgtacacagtgttggaggtgagttccgcgcggctggatacctttctgtcgctgtcccctttgaatattccgacgatggtggttttgacagtcgccgtcgaatgcgactcattgtcggcatcatatggattggccttgagcgtgagggtatcgccgactttaagcccattggttttggcgagatcctcatggaccatcgacatatgcttatcggacgtctttagatgacgtccttcgaccatgccgagcgtgtgggacgtgaacacattgagttttgacgaatcgtttgtgcctatgacgttggccgtattgccgaactgctgttctttctccgcatcgtaatcatcgccgccggggaccttcaccacgctggctcccacgagatcggcggtggcgttctgcctgaccatgcacgagccaaccccggacagcttcgagattcgttgcacatcggcgggacggaccattccgcctccgcgaggcgtcagcatgctgccttgcaggttgctggccagcacgaatccgccgaccgcctgtttctcaatctgtccggcctcatgttgagctgcctgagaaaccgcggtcgcggacagcatactcgccgttatgatggtcagcacaatgaacagcaccgcggtgcgcactcgttttctgagcacatagcgcgccgcccgtgagataaaggtcattaataccccctgtaaagctgggaccttctcggtagtgcccgaaaagatgtgcactttggaccatggccgtccatggcacgatgatcagttcgcttccgcgagtttgtcatcgagccgggacctgtcgagatagcggcgggtcgacgctttcctcgcgccgtctgtggcgctcgatgaccgcggattcgaagacctcgcccttgagcttgggcaccttcaggccgagcctgccggccttggcggtcaggctccggtcgtagtggccggcgcggtacaccttccgctccccggcgcgctcgtatctggcggcgttggcgatctcgtcggcctgaagcgccgggcatcgcgttcaatggttcggtgaccttctcggcgaccaggcggtcgagcttggtctcgagcaggttccggtcgatctgtatgatgctcgagggtcttgccgactttgtcgcgtccgcgccgagcggattcctacactctttggcggccctgtccagatcggcggccgccgacacgcacgttccgcgcgccatggccgtcctgtggtcctcatatgcccgatagcccaggcggccgcccacgaccactgcggtagacgcggccgccgccacgccgctgaagcggccggaatgacggactggaacccgccatcgtcggcatacgtcggtgtatgcggtcggcgcgttgggcaaacccatgccgcaccggccggaggctgagggggccgttcgaccggaaaactcaatggccgtaggattcccggatgcgggcgtcgggcccggtggcaatccggactggaaccctcatacgaaaaacgggctgccgtggtccgttgggaaccacggcagcccgccatgtgattcgttggaatcggaaagccttacttgttgaggaccttcttcatcaggtcggaggaggccttggcgagtgcgaactggccgaagcccgggtcgatggaggcgaggttggcgttgatgatctggttgaaggtgtcgttcttcatggtgtttcctttcggacggccgcctgtcttcttgctcttgtcttcttctgcgtcgcgcggctcgtcgcttcgttgttttcttgtctctgtatcttctgttgtttttctgttgtgccttcactataggcaggaaagtatgcgtacgtcatgccgcaatcgccatttctattgtagactcatcggttcatcttaaagaaagaataaaaaacggtcatatattctgttgcgcagcctgccgcagcgtagttttgggtagatgaagtgcgattgttctgcccattccgacggaaaagttcatgtttgcgtcggaatgggcggatgaattgcgattgttctgctggtttcgatgcaaatggtagctttatcgtcgtttcgagcagaaaagtcaacggttttctgttgatttcaacgctggcagcccggtttgcgtcgtttcaagcagaagaagtgcggctcgtctgccggtctcaacgcgaacggcagactttgcgtcgttttgaatggaaagaccaatggatttctgtcggtctcgacgtggacggactcggcctttttctgcaccagtggggattgaccttccgtcggcatccggagcgaaggcctatcgcttcgaacgcttgcctacaagaaccatggaacagcctgccgacacgcacaggttcactccgcaggtcaccgccggcaatagccgtatgaccggctggtcatagaaatcgaggacatcgggatccatgaatcctgagtacgcctcgaaaagcggatatggcacgagtgccagtgtcgaactcgcaaagaacaatatccagataacggagaggcacaggatgaaggctcttcgaccttctggacggatggttttcgagaatgcgaaaagagtccatgaaagcacggtgattaaagctccggcgacatacagcagactcggaatctcgtcatacatgatttcgcctcctctcgattcggttgcagacgattcgatctatcggcagtatgggctgattataaggcggcgttgttttttgcgtcaagaggttttggccgctcatggccgatttgacgtttcgccggaatcgcaaggcaatgatgctgtacggatctggcgagtcttcgatacctgcgcatgccaagcgagggacgatccatggggtggcagggtcgagggatcttcgcaatgccgttctcgccgctcgcgaaaacggttcgtcatgattccgttcggctacaacgcggaccgagcgagcctgcattggaacaactggagctactgaaacggcaagacctccgaaaccgcgattgccgacggcgacgaggattcgccgaagaaggagaagtatcggtcaaggtggccgcggtgaacctgaaagcagtctagattatcccgatccacatattgtccattgtgtccatttgccgcatgatgaaaacagatggaggtggttgcgatgaccatgatgatgggtggcaaagtccataggacgaggtctaaggcacggcgctctgctggcggagttcccggagcgttcctgcaaggggtggacggcacgcgtatcccgttgacgccggacgactacaggcgcgttagggagtttctgcttgcagagccggaacgggcggtggcggatgacgagcgtatcacgactggcgaggcggcgcgtattcttggggtctcccaacgcacgctcacacgcatgctggacgcgggcatgattccgtacacccgcatgggggagcgcagttaccgtttcctgaggctttcggatgtgaccgactacaagcgcaggcgcgacgaggccacatccaaggcgttggatgagatgcgttccatcgccgatgaggacggcgcgtacgacatcgactattcggattacctgtcccggttcgataagtagagtgcccttatgattgcgctgcttgacgccaacctgttcgtacctacgtggatcatcgacccactgcttagcttggccgaggctggtctgtgcgagccagcatggtctgcgagggtcatggacgaggcacgcttggccatcatggaagtgcggcatgtgcccgacgtccgggcccgcggttttcttgacgcgatctgcagggcctttccgatggccatggcggaggattgggagcggtttgaaccggacgtgaatttgtcggaccccaacgacgggcatgtggtcgcggccgcccgtcgggccggtgcggaaaccatcgttacattcaacctcaaggatttccccgcagacgaactttccaggtacggactgcacgctcaatcgccggatgttttccttacctccgtgttcgatgcacatccagaagaagcgatggacgccatgcgcagactggtcagctccaaacgccatccgccgcgtaccatgagcgaagaaatcgagcatttgcgcgtcttgcgccttccgctgttcgcacggagattgtccgaaacggtaggctaatccccgtcatctgcaacactgcgaatcatacggtaggcgcaatcaatgcacaatctgtgaataatcgctaatccattggctcaacacaacctattgccgccttgcaccgtggaatcaagcaaatcacgaagaaaaggccgtccgcacggcaagatttcggtcgtaggcgatggattcggacgagccgtatccgagagggtgccagtacgaataggtggactcggaccggtcatgtctagggggtcggaatagccccctagacatagtcctttttgctcccccacctggactcgaaccaagacaaagggttccaaagacccgtgtgctgccattacaccatgggggaacggcgataaaacccgaggttttccgccaagtgtctattatgccatatgcggccatcacctgataccgcgtgtcggacgctttcgcaggtgatggccgcttcctccggattcagttcaatgccttgaccagccaaccatgcgtaccgttgtcgaaaagctcgctggtgatgcggtagccaagatgttcatacatcgcgaaattcttatcttcggagtgtacggcggcaacatgtccaccggccttccggatgagacgttccgcctcggccagcaccgtcttgccgataccatggccacgttcgtcggcgaccacggccaaacgaccaatcacccaacgtccgggttgatcggcatggtcgagatcagggtagagacggcatgtcgccacggcgcggccgtttccaaaagccagcagatgcgtggctcggcccggctcatcccattcgtcgaattccggacgataatccttctccacgacgaacgccgccgtgcggatgccgcgcgcctcgtccgtcatcatgtcgtattcgcggatctccatatgatccgacactacagtcgggcggggaagagagacgaatggaagttatgtggcgtcgtgttcgacgatggcactgttgtcgaacgcacgccgaacaacgcacgccaaacgcacgtaggcggatgtatgacagccagcgcacgtgatagggtacacccgtgaacgaaaaagagaaggactccgacacacgcatatacgctttggacgggctcagaggactcgcggccctggcagtggtcgcataccattacacgggaggcgccctccgccaactattgccaggcgcccaattcgtcaccctattcttcattctcagcggacttgtactttccatcgttccgctacgcgtcggaatcgacacatacaactggtctcgctaccagctgcgtcgcatcgccagactcgccatccccacctgcacggtaatcgggatctgctgcatcgtttccacaatcgccatgcatatggggtggaaagcggaagaatacgcaaacgcgttcagcacatcctcgccatcagtctggctccacaatctgctcacccaactcgacatgctttcaatgaccaccgccggcaccagagtggacggttccacattggcaatggtcgacctgccatcatggagcatgtgctgggaattgcttttcagcctcgccctgcccgtatacgtcatcatcgccaccgacatgcgattcgtggcacccattgcgctcgcatgcgtgctgttgtcggagtggacgcagtggccgccgttgcgtcacatggccatgttcgcgcttggcgtcgcgttggcgaaacggcttacggacaacgggcgcgagacgatgcgcgacgtcgttgccgtaccgctcgccctgtgtggcatcgtcttggtttgccaaagcggtttcggtttgctgcctggtattgtcgcccaacctttagccgtgtgcggatgcctgatattggtggtggtcgcacttacctgcaacgtggtatccgacctgctttccacgccacctgtccgttggctggggcgcatttcattcagcctatatctgacccatcttcccgtccgcgactggattgtgccgtacattcccgtgcagggtctattgcgcccggtggttttgtttgcattgtgccttctggcagcggaggcgttctatcttgccgtggaacggcctgctaccagactgtcaaggaggctgggaaaggtgaaaagggaagcctgatgtattccgcttgcgcatggtgctttaggcggaatcgccggtttgcatgaatgtcgattgagcgaccggtatacgcttcctgcgaggacatgttcggcatgttccgcggcaaggcgtgcattcggaaactgatccgcggaaacatgtccggccacggcaagtcagtcgccatcactttggaacatggcatccacggaagcgcgtacctgcccggtgtcctgtcgtggcccgtcaaataccatcagggagatggagttggtacgtagttcactcagcgagctcagcaacggacgcaccgccgcggtgctgcccaaagcgaccgtgcgcccgtcatcatcaaacggaacaggacatcctacatgtttatgagtatcaacagctatcagaatctcttcgaccgtcttgaggataagttcgatgcttgcctcgccgacgcccgcatagccgagaacgatggacgccgcaacaggcatggactctgatccgacgcagacggtattcgtggcatgtcaattgaattatgattcccttagtttcagattcgaaggaatcgtctggagcgatttccacgacggttcggtcggcattcccgccttcgtgcgcgaaggacagaacgtccacatcaaagcaacagtggacaaatacaatcccgacagcggctttcccgcatatcgatgggttccgtgtttttccgaaggcccaggactttcggaaaaacacggaacccatttttccatttcacgagacttttggccgacatgtggaataccagcctggaaacgcgccgaaccatgtaatatcgcttgcggacacgggggccattatggctgagaggaagcaaccgcttcaaccgtatgaacgtataccggataatgccggcgcacggacgtctctctacttcccgtgcctttgcataagagaaaggcacatacctatatgactgaagaaaaccagtcttccgcagttcgcaaacccaacgtcaaatggcgtgtggtcgacatcgtcgtggccgcgatcgttgccgtcgcatccggcgtgatcttctgggcctgggacttcatctacgccgtcccgaccgccctgttcgacagcctcaccccaggcctgggcggactcttccatttcatgtggctgttcgccggcccgctcgtggccatcatcatccgcaagcccggcgcggccttcttcggcgaaaccatcgccgcggtcatcgaaacgctgctgggcaatccattcggcgtggcgcacgcactgctgatcggcatggcccaaggactcggcgccgaaatcggcttcgcggtcttcgcataccgcaagtggaacctgctcaccgtgaccctggccggcgcgttgaccggcctatccaatggcctgtacgaatgggtcgtcaccgccggctggtcgacactgcaaggcgtcgtgttcaccgtctgctgcgtcatctccggcgccgtattcggcggagcgctcatgtggttcgtacaaaaggcgctcgccaaaaccggcgtgctcgaccgcttcgaatccggcaaggccgacgtcgtggcctgaaccacgcaactcacaatccaacaacaaacatagaaaacatgccggccgtccgccggcgtatccaagaaaagagaaaatcatgaccaaccacgttccagaagcaacgaaacccgccagcggagactacgcctggctgggcgcggaagccggctccgtcgccgacctcatgtacatgctcaacaccgaggactggtacgacgccatcaactcgcgtttcgtcagcgagctgcttgacgacactttgccggaatccatcctcaaggcgtatctgattcaggacttcaagttctataacaacggcatgatggcacgtctcatcaaactcgctccacgtcaggagaccaaggacatgctcgcggcgcaatcgcagtggttcgccgacaacgaggccacctacttcgagcacttcctcgaggcctatcacgtcagccaggaggaatacgacgcgaccgaaccgaccccggccaacaaggagtacggcgcatacctcgacagcctgtccgacaagagctggccggaactgatcaccgcgatctgctgcatggaatggctgtacctcgcatgggccaagcgcaccgtcgatgccgacgtcatccagcaggtgccggcgcacaagggctgggtcgacctgcatgaaggcgcgcacttccgcaagtgggtcggcgacctcatctccctggtcaacgaatactgctccatcgatggtccggaagccgaagtgttccgcaccatcgtgcatctggagcgccgcttcttcgacgactcctacccgcaggagtgagcctgcgatccacgaccgcataagccatgagccgggcgcgtacgatcgatgtcgtacgcgcccggctcatttgttgcggttccgtccggagcccgatttcctcgtgcgcggctgccgcgcgagggcggcccgtctacagcgagatcccgtcgatgcggcggagctcctcgtcgctgaacgaagtgttcctcagcgcaccgatgttgtcgatcagctgctgtggacgggacgctccgaccagcaccgaagccaccatgccgtcgtgcagcagccaagccagcgacatttcggcgagcgtctgtccacgctcggcggccagatcgttcaggtcgcgaatctgctgaagccgttccggcgtcaacgcgctctgctgcaggaatcgtccgtcatgtgcgattctgctgtccgccggaacgccgttcagataccggttggtcaacagtccctgggcgagcggggagaaagtgataaggcctttgccaagacggtgcgcggtctccttgagcccattgcgttccacggtgcggtcgaagatgttgtaacggttctggttgatgatgaacggcacatgcatctcatccaaaatggcggtggccttctcgagtgtggggccatcataattggacaggcccacatacagcgccttgccgctgctcacggccgtggcgagcgcgcccatggtttcttcgagtggtgtggatggatccatgtggtggtggtagaagatgtccacgtagtcgaggttgaggcgtttgaggctttggtcgagtgaggcgagcaggtatttgcggctgccgaggtcgccgtaggggccggtccacatttcgtagccggctttggtgctgatgatgagttcgtcgcggtggtggtggaagtattcgtgcaggagtcgtccgcagtttttttcggccgatccgggttcggggccgtagttgttggccaggtcgaagtgggtgatgccgttgtcgaatgcggtgaacacgatgcggcgcatggtgtcgtatggggtggtgtcgccgaagttgtgccagaagccgagggatatggccggcagtttgaggccgctttcgccggcatggttgtaggtcatgctgtcgtatcggtttggcgatggcgtatagacggtggtcggttcgagcatgttttctcctttgaatatgctgctcatgtcgtatccgcaatcaacatacacgtccgtttgtcgtgccgcaacattgcgcaatacaataaggcgcatcgcggtattcgatgcggtggtaggagagtggcccatgcgtgtggaacatggattcggtccggtttgggatgccggatcgcgtgtgttggtgttgggttccgtgccaagtccgaagtcgcgtgagatgcggttttattatggtcatccgcgcaatcgtttctggccggtcatggcggctgttttccatgatgatggttgtctgcgcgagtgccgggacccgggccagattgtggggttgcgtagggatttcgctttgcgtcaccatatggcgttatgggatgtgattgagtcgtgcgacatcgatggagcgagcgatgccagtatccgtaatgcggtgcccaatgatctttccccgataatcatgcgatcgaaaatcgcccatgtcttcaccactggcgcgaaagccgcgcaactgtaccgtaagctctgcgttccgctgcttcgggcgcatggattggacggcatgccgatgacgcagctgccatccaccagtccggcgaacgccaaagccgacctgtccggactcgtcgaagcgtacggatgcgtcgcacgctccgtttcgcaggcgtcgtaaggcgtttccgacggctgcggcattgtccgaaccctatttatacaatcgcggttgcgttgaaatccgaagcgtcctccactaatccgtctggaatggacgtttcccgcgaaaaccagcaaaacggaaggcgaaagatggcactgagcgccgcaatcatccttgccgcgggcgaaggcacccgcatgcgttccaacaaaccgaaggtgctgcacaccttggccggcaaaacgttcctgaaccgtgtcatggactccgtggcggcccttgaccccgatacgctcgccgtggtggtccactaccaggccgaacgcgtcgccgaagccgcacgctcctacaacgagcacgtcaccatcgtcgaccaggacgacatccccggaaccggccgcgccgtgcaatgcgcgatggcgcagctcacgcagaaggacgatctggacggcgccgtgctgatcgccgcatccgacatgccgctgctcgacaccgacacgctcgaccagctgctcgccttccacgagaaaagcggcaacggcgcgaccgtgctcaccaccatcctcgacgatccgaccggctacggccgcatcatccgcgacagcgaaggcaacgtgctgcgcatcgtcgaacaaaaggacgccaacagcagcgaactcgccgtacgcgaagtgaacacctccgtatacgtgttcgacgccaaactgctcgccgaagccatcgccaacctcaaatccaacaacgcgcagggcgaattctacctgaccgacgcgctcgaagccgccaaagccaatggagccgtcggcgctttcgccgcccccgacccgctaagcgtggaaggcgtcaacgaccgcgtgcagctcgccgcgctcgccaaggcgcacaacaagcgcgtgtgcgagcattggatgcgcgaaggcgtcaccatcctcgacccggacaccacgtggatcgaggacgacgtgcagatcgcacgcgacgcggtgattctgcccggctgcttcctccaaggccatacggtgatcggcgaagccgccgaagtcggaccgtacaccacgctgatcggcgccaccatcgacgccgaagcgcatgtggaacgctcccgcgtgcaggagacgcacatcggccgcgccgccaacatcggcccgtggacgtatctgcgtccgggcaacgagctcggcgcgggaagcaaggccggcgcgttcgtggaaatgaagaaggcgcacatcggcaacggcacgaaggtgccgcacctgagctatgtcggcgacgccgacctgggcgagcacaccaacatcggcggcggcaccatcaccgccaactatgacggcgtgcacaagcaccacaccaccatcggatcgaacgtgcatgtcggcgcgggcaacctgttcgtcgcccccgtcaccgtcggcgacggcgtcaccaccggagccggctccgtggtccgccacaacgtcccgtccgactccatggtctattccgaaaacacgcaacacgtagtagagggctggaagcccgaatgggagcgctgaacatgcctgcattgcaagattccatcgacgccatccgcatcgccgcagccgcggccgaccgcatgaaggccaccgacatcgtggcgttcgacgttaccgaaccattggccatcaccgacgcgatgctcatcgccagcgcctcgaacgaacgccaggtgctcgccgtcgccgaggaaatcgagaaggacctgtacctcaaggccggcaaacgccagccacgttcccgcgaaggcctgaccgaaggccagtgggtgctgctcgactacggtgatttcgtcattcacgtcatgcaccaggaatcccgcgaatactaccgtctagaacggttgtggaaggactgcccgagcatcgatctgcagctcgaacacgccgagggtgagcaggagccgacggcttccagcgaagcgtgatttttcatccatcatcgaaacgtgccttcccgaaaatcctgcggaaggcacgttttggtatgcgccgtcccagcaatccgaatacgatggcagacaggcaataaatcggaaagacaaccggcagataggggagaggcatgcccagaaacgtcgaactcgaccatgatgagaccatgacgccacacgtgcgttccatcacactggtgcgccacggacgcaccgcatacaacgcgcagcacaggctgcagggacagatcgacattccgctcgacgaagtgggtatgtggcaggttcgccagaccgcgtccgcattgcgtgaactgtacgtggaccgtcgtcccgaagcggcgcgccagctggtcgtctgctccgatctcaaacgcgcggccgccaccgcccacgcgttcgccgacccgctcggactcgacgtgcatcccgacgtccgcgtgcgcgaacgcagcttcggcgattgggaaggcatcgccgtcgaagagctcgccaaacggttccccgaggattatctgtcatgggcccagttccgcggcggcgagctcaagtatggcgcagaaccgaagcagaatgtcggcaggcgtggcgtcgaggcgttgaacgattgggcgtcgaaggccggctccgataccgacctgtacgtgttctcgcatggcgcctggatctcgcagacgttgcagacgctgctgggattgagcgaagtgcatggcgatttcgccgacattctgtcgatgcgcaacgcgcattgggtgcggctggcgccgttggaactgcagggcacgctgcggtggcgtctggtcgactacaaccatggtccggcgatcgccgacaccgagcagtgggagcatccgcagctatagccgctgacgaaaacgggggatgacgcgcgtcccgttcccaagttttttccaagcttttcacagaatcgcaagttttttcaaagcgtaatcggctaccgtcatgctctgtgaagaattttttcaagggcatatcgttttcatcgattttcgcgggcgcgcttgccgcggtgacctcgttcctgctgtccgcaaaaatcggcatcgcgggatcggtgattggcgtcgccgccggttccatcgtctcggccgttgcgacgcaggtgtacaagaacgtgctcaaggcgtcgggggagaagctgcaaaacgccgtaccgttcgtggccaacgacaaggacggtacggacggtgccggcaagaacggcgatgacgccaccacggtgatcgctcccgccgaatccgagggcgagcagaccaagacgctgtccgcggaggaatccgatgagaccacggtcatgacgtccgtggacggggatacgaccacggcgatgcccgcaacgtcaggccgtgtcatctcctccgcgcaggccggaggacgcgaatcgaacatgcttccggacaatgccggcggaagtatccagcatgctggacgccgggcgtcgtttgacgcttggctgcatggcaagcgtgcgccgatcgtcatcgcgatcgtcagcgcgcttatcggcgtggccgtgagcgccggactgatcctggcattcacgggcggacatggaaccgataccgtggtgcgtgacatggtcaacagcaagcagacgccgtcggatgacaatgccggcgattccacctacggcagcggaaacaacggcacgcaggacaatatgcagaaccagtccggcacgacggacaccgataaggattccaccacgaactccgacaggaacaacggcaaggacaccgggaagaagacggattccacaacaggcggcaccggaacgtccaccgacggctcggactcgtccaccaacaccggagacgattcgaacaagacggattcgtccacggactccactacgccatccgacggatcgacgtcaggcaccaacaattcgggacagtcgggcgcggggacgaccaccacgccgaatggttcggcatccacgaaccagaatccgacgccgaacggttcgaatcccaatggcacgtcatccggcacgtcaggcaatgggacggacacttcgaaatagcccatgaggcatgtgtccggggctttcctcgaccacgtgcccgacacgccgcgaattgcatgattctgctctgtgttgtatcttatacaaggtttgcagagcagacattggggctatggcgcagctggtagcgcatctccatggcatggagagggtcaggggttcgaatccccttagctccacgattggaaggcttccggagagattcggaagcctttttctttaccgtttcccgtcggcttccgggcaatccgcggatcggatgcgaaaaccaagaaagcgagaaccatgatcgacgaagtactgttcctgcgccacggacgcaccgcatacaatctcgccagacggctgcaaggacaaatcgacattcccctcgacatcgtcggacggtggcaggcggaccaaagcgcgtacgaactcgccaaaacctactattgggcgaaagtcgcgcatctcgccgaacataacgaccagctcgcgcaacccgcatacggcaacgcccatctggccgacgtcgacgaaatcaacaacgcgcccgccgcggcccgccgcatgctcgtcgtctcgtcggatctgttccgcgcgcagcagaccgcgcacgccttcgccgacctcatggggctggatgtggaactcgacccgcgtctgcgcgaacgcagcttcggcgaatgggagggcatgacccgcgaggagatctgcgagcattacgccgacgactaccattcctggcgcgcccacacgggaggcgaaaccaagcatggcgtggaaagccgcatccatacgggccgacgcggcgcggaagccgtgcgcgacatcgtcgccaaacaccatgacgagacaatgcctaccacattgcttctcgtcggccacggctcatggatcgtggccaccgtggcggtgctgctcgacatggaccccgacgatctcaacaacgtcggcgcgatgcgcaacgccttctggacgcgcatgaccccgcacaccgaccccaggaacgcggaccgtcccacttggaagcttgaggaattcaaccaaggccccgccatcgcatcattcgccgactgggagaacggtcccgaatcgttgcgcgcgcccggcatgccgctgtggaagccgatcatccaataagcatccaatacacggcgccgaaaacatcatccaaagtgaactcttgatgaaatcaccgccgtccgtacggcaaattctcacggtgggactatccttaatgaggttgtttgcccgaccatgcggcgagccgggaatccggcgatcgttccgcatgcggatcgggcttccgtacagcgatagaacgttggaaagcgcgaaaggcgggtgagagacatgttgagaatgttcagaacgattaacggccaggtggagcaaatccaaaaaccggagaacggctcctggttatgtctctcggcgcccaccgacgtggagctcgccaacgtgtccatggaaaccggcatcgacctggccgacctgcgcgcccctctggatgacgaggaacgctcgcgcgtcgacgtcgaggacgactacacgatgatcatcgtggacattcctaccgtggaggaacgcggcggccgcgactggtacgagaccatcccgttgtcgatcatcatcacccagtccgccatcatcaccgtctgcatgcaggacacgcccgtgctgcacccgttcatggaaggcaccatccgcggcttcaacacatacatgaagacccggttcatcctgcagatcctgtaccgcaacgccaccatgtacctgcgttacctgcgcatcatcgaccgcgaaagcgacaagctcgaactgaagctgcgccactccatgcaaaaccgagagatcctcatgctgctggaactgagcaagacattggtctacttcaccacatctctcaaatcgaacgaaatcgtcatggagaagctaaccacgctgccgcggctcaagcagtatccggaggacgaggacctgctcgacgacgtcatcacggaaaacaagcaggcaatcgagatggccaacatctacagcggcgttctcgccaacatgaccgacgcgttcgcatcgatcgtgtcgaacaacctgaacaacgtgatgcgcatcttcaccatcatctccatcaccctgtcgattccgaccctgatcttctccatgtacggtatgaacttccaggaaggcatgctcggcatgcccctcacggacaagccatggggcttcgcggtgatcatcggcatctcactggtcctttcggcgatcgtcacctggttcctcacccggtcgcgcatgttcaagtgacgtccatgatgggaaaagcgcgatacgtggccgcggcggcatgcgcggcattacttgcggccggcgccggcgcgtgcggcacatcggtttccgtggtgaccgaaggcgcggcgcaggggccgacgatcgcgataggagtggccgccgaccagccggggctcggatacctgcatggaggcgaatactccggcttcgacatcgacgtggccaaatacgtggcgaaaaccctcggatacgcggaaaagcagatcgtgttcaaacagctgtccccggccatgcgagcctccgcgctcaccgacggcacggtggacatggtcgtggattccttctccatggacgggacccacgatggtgaggccgacgtcgccggaccatatctgacggtccgggaggcgctgctcatccgctccgacagcgcatccgaaatcaccgggaccgacagcctgtccgataaaaccgtatgcgcggtcgctggaagcgcggcggacgacaacatccgcaaccgcacgaaaaacacccgcacgacggtggcggaacgcgacacgtatccgcaatgcatgacggcgctgatgatcggcgaggccgacgccgtcgccgccgacgacgcgatcgcggccggactggcgtcgaacaacacaggcgaccgtctgaagatcgtcgacgttcccgacaccacctggtcctacggcatcgccgtcaaatcaggacaggacgagctggtcgggcaaatcgacgccgcattgcgtgccatggtcaaggacggctcgtggcagaaggccgcggccgacatgggcaagtcgatcggatacacgcccgacgcgtccatgaatccgccgaaggcaacggccaaggccccgtcctccggcgcgtccgcggcatcggaaaaataacggcggcgcacgtgcctgaatagtggttgattccttgcgaagtgtccagttgcgcggctaatttcatgcattatgagtgacactgagaaaagcgcgcaggcgcaaccgaacgaatccgccgaaccgtcgttccgctacaacgcgaagctggcgcagggcatcgaagagaaatggcagaagatctgggatgacgaaggcaccttctgggccgccaacgtcaacggcgacctgaaggacggcaagggccataacgccgaaggccgcccgtcctatttcgcgatggacatgttcccgtacccgtccggcaagggcctgcacgtcggccacccgctgggctacctcgccaccgatgtggtcagccgctaccaccgcatgaagggcgagaacgtgctgcacgccatgggctacgacgccttcggcctgccggccgagcagtatgccgtgcagaccggccagcatccgcgcatcaccaccgaacagaacatcgccaacatgcgccgccagctgcaccgcatgggcctgagcttcgacaaccgtcgttccttcgccaccatcgaccccggctacgtgcgttggacccagtggatcttctcccgcatctacgacgcctggtacgacgaggacgccaccaacccgtccggctccaggggctgcgcccgcccgatcatcacgctcgtcgaacagttcgaatccggcaagcgcgccatcccgggcttcgaaggcaaggcctgggccgacctgagcgaagccgagcaggccgacgtgctcaacgacttccgtctggcctacatctccaagtccccggtcaactggtgcccgggcctgggcaccgtgctcgccaacgaggaggtcaccgccgaaggcaagtccgaacgcggcaacttcccggtgttccagcgcgaactgcgccagtggtccatgcgcatcaccgcatacggccaccgtctgatcgaagacctcgacaccatcgactggcctgagaaggtcaagctcatgcagcgcaactggatcggcgaatcccacggcgcttccgtgcatttcgacgtcgagaccccgaacggcgtcaaggacatggagatctacaccacccgtcccgacaccctcttcggcaccaccttcgcagtcgtctccccggaacaccacctgcttgagaacgttccggaagaatggccggcggaaacccccgaggattggaagggcggctacgccaccccggtcgaggccgtgaaggcgtaccgtctggccgccgaagccaagaccgccaaggaccgcgtggacgaggcgggcgagaagaccggcctgttcaccggcctgtacgccatcaacccgatcaccggcgctaagctgccgctgttcaccgccgactacgtgctcatggactacggcaccggcgcgatcatggcagtgccgggcggcgatcagcgcgattacgatttcgccgtcaagttcggcctgccggtcatctacaccgtcaagccgctgccggaatccggcgacgacctcgccaactatgagggcaaggcgccgttcgtctcccatgacggcatcgtcatcaactcctctatcgacgcgaccaaggccaagggcgattccctgagcctcgacggcctgcgcgtggatgaggccatcgacaaggtcaacgcctggctcgaatccgccggcgtcggcaagggcaccgtcagctaccgtctgcgcgactggctgttcagccgccagcgctactggggcgagccgttcccgatcgtctacggcgaggacggcaccccgcacctgcttcccgacgagcagctgccgatcaacctgccggacgtgccggactacagtccgaagaccttcgacccggaggacgccgaatccaacccggaggctccgctgagccgcaacgaggactgggtcaaggtcgagctcgacctaggcgacggcaagaagacctactaccgcgacaccaacaccatgccgaactgggccggctcctgctggtactacatgcgttacctcgacccgaccgacaccaagcacatggtggagaaggacgagttcgactactggatgggtccggaccacaacaagaccgccggcaagtccggcggcgtggacctgtacatcggcggcgtcgaacacgccgtgctgcacctgctgtactcccgcttctggcacaaggtgctgttcgacctcggctacgtcgactccatggaaccgttccacaagctgttcaaccagggcatgatccaggcatacgcctacaccgacgaccgcggccagtacgtgccggccgccgaagtggtggaaggtcccgccgacgccaacggcgagccgacgttcacatggaacggccagcatgccaaccgcgagttcggcaagatgggcaagagcctgaagaacatcatcacgcctgacgacatgtatgagaactacggcgcggacaccttccgcctgtacgagatgggcatgggcccgctggccgaatcccgtccatggaacacccgcaacgtggtcggctccatgcgtttcctgcagcgcctgtggcgtaacgtcatcgacgagaccaccggcgaggtgcgcgtcaccgacggcgagcttgacacgaagacgctgaagctgcttaacaacacgatcgccgacgtgaccgtcgagatggaggccatgcgtccgaacacggccatcgccaagctcatcgtgctcaacaaccatctgaccagcctcgacgccgtgccgcgcgccgccgtcgaaccgctgatcctgatgctctctccgatcgccccgcacatctgcgaggaactgtggagcaagctcggccacaccgaatccctggcgcatgccgactggccgaaggccgacgaacgttacgtcggacaggattccgtcaccgcggtcgtgcagatcaagggcaaggtgcgcgccaagctcgaggtctccccggacatcgatccgaaggagctggagaagatggcgctcgaagccgtcgccgaccgactgggcggcaaggagccacgcaaggtcatcgtcaaggctccgaagatcgtctccatcgttcccgcggaatgatcttctgacgagacggcccgcataagaggacgcgggttcttccgcaccatggcgacacgccaggaatgtggataacccgcgttctccgaccacaggagccgtttcggctggacagtatgcccatgcatcctccaatgttggatgcatgggcatatttgcatttcgcggcactcaccccatccgtgccatccacacggcggacggcggcactggcatgccggccgccacgaagcggctgcggggattgggcatgcccgaaaaaccgtcccgacccaacagccttacggccatggaggcgcaatcggacgaaccgtccgcatcgcacgaacccgcacgaccgatgccgcagcggaagacgcatgacgcgaaaccgaccttggcggagctcaccggcgtccggccgacggacaaacccgacgagggggagcggccgaaacgcgacaggccacgattggcgttccgcccgttccacgcgctcatggcgatcctcactttgtcgtgcgcgctgtgcgcgagcctgaccatgctcgtccaacagacgatccactacagcgaactgcagcattcgcggtcgcagatacgctcacaggcccaacagcagccgcaacaggccccgcaaacggaacaaacgccggcaccgcaagaaaacgggctgacgcaggacgcgtccacaccggacagccatgacgggcaagacggagcgcagcaatcgaaccagcttgacctcaacaccgcagacctaggcgaattgcagaccctcaaaggcgtcggaccggtcaccgcgcagcgcatcctcgactatcgaacgcagataggacggttcgacaacgtcgaccagcttctggaagtcaagggcatcggttcgaagactctggcgaagttccgtgaccaagtgtgcgtgagatgacgggcacacgcgattggctgaccagggagcgcgggagccgagactggagactgctgccggccgcaatatgcggttgggcggccagtctggccgcgcacgccggcttcgcatattgcatgtcgcatgacggcatgctcggcgctttgccggccgttctcacctgcatgataccgctggcggtcctggcgggactgcccttcccacgattgccggcgtccgttcgacgacggataacgctctggcatgcgagcgtcacggtctgcgcgatcgctgcgatggtttgcgcggcaagcgcgttgacctatgatttgctgcaatggcgcgacccggcttctcgggcggccgcggaaggcgacgcttccgtcgtcgtcacggcgcgcgccacctcgccgaccgtcatctccgacagacggtctaacgactgccgtgccgacgcgcgcatcacatcgctcaccatcgacggcgtacggcaaaccagttcggcacgagcgcgtatatacgcggaccggcctgaatgcggcaaactcaaacaggacggcacctacaagatcgcgggccgcatctccgaagcgcgatacggtgccatgccgttgtggctgaccgacgtcacgacagtcgaacacgtcaggccgccaaacctgccgatgcgcgccatcggcatgatgcaggaggcgttcttcgtccaaaccgcacgtctttccgaccaagggaaagtgctcgtccccggactgacattgggtgttctcggacaggactacgtgccggccgaaggcgatggcgccgacatcgattccacatacgccgcacaggtggaggacgcgttccaaaggtccggaatcgtgcatctcatggcggtcagcggcggccatctggccgtgaccgccgcattggtgcgttccgtctgctcgttcttccttctgccgcgacgattcaccgcactgctggtcgccatgtcgtacatcatgctgtcggcatgcgtgtttccgtcggattcggtatcccgcgcgcttttgatgggattgtccggcgcggcatgcctgttcatcggcagacgaggccaggcgatggcgtcgttgagctggaccacattggctatgctgatggcatgcccgcacatgtcgcaaagcttcggattcgccctgtcctgcgccgcggtgctcggcatcgtgctgttcgccgacaccctcaacgcatggatggaaccggtcctgccacggttcgtggccgaggttctgtccatgaccatagcggcgcaagtgttcaccctgccgatccaggtgctcatcgaaccggaactgccggtgttctccataccggcgaatctgatggtggcgccgttcgtgggtttcgccacattggccggcctggccagtcttgccgtctcatggctgattccgtggctcggcctgcaactggcccgtgcggcctcctggggcaccgcggtcatggaactgaccgcccttgaactgggttccggcagccaggccacgataccgtgggccggaggcgtcgggggagcggtcctcgtctgcgtggtggaagccgcctgcgcggccgccgcgatcatgacgcaccggctgttcggacgcatgatggtccaggaacccgatctgcccggaaaacgtctgacagccaaccctgtggaacggctgcgcatgtggatggaacgtactcggaaggcattgcgcgaactgcaatgggaggaataggccatgccggttttgtccaccgatacggcgagattgaatggtatgccgaaaccatccgcagccaccacgcccttccacctcgtgtacggaggcgactcgtacctgaacgaccagacggtgcgcgacctcaaacacgaggcgcaacgccggtatcccgacgcggaaaccatcgaactcgacgcggcaaacgccgaccattacgccttcgacgaggcggtaagcccatcattgcttgcggatcgcgccatcgtcatcgtcaccaacctgcagaacgcggacgaaaaactgggcgacgccatggtctcttactgcagacaggcgtgcaaggagccggcggacgcgtgcatcgtcatctgccagcatgagggcggtgtgaagggcaaacgtctggtggagcagctcaccaaggccggagcgtacaaggacgctgtcgccgacctgaagaagcccgaggccaaactcaacttcgtcatgcaatgcttcgaacggcgcaaacgccgcgtcgagccgatggccgcgcagcaactcgtggccgtgttgggggatagaaccggcgagcttgcggccatggtcggccagttatgcttcgatttcgacgacaatcccatgacgctcgaccgcgtcaaccaatatctcacctccaatccgcaggtggatggcttccgtgtcgccgacctcgcgttgtcgggacgtacggcggacgcgatcatcgccatgcgatcgtccgtggaacagggcaccgctccgatcgcgcttatcggcgcgctggccatgaagctgcggacgatggcgaaggcgtcggcggtgcgtgcgggcaccatttccacggccgaggcgaaaacgaacccctgggtgttgaagaacgcgacccggcaactatccggatggacgtcaagcggcatgagcgcatgcatccagatgctcgcatgggccgacgagcaaagcaaaaccaatggctcggacccggtctatgctttggaacggtccatcgaactgatcagccgcaaaggacgtgccgcatgagcaacaccattaccatcacagccgccaccggcgaggacatgcaggcgttgggggagcgtttggcgaagcttgcccgtggaggcgacgtgctgttgctgtccggtccgcttggcgccggcaagaccacgttcgcgcaagggttcggcgtgggacttggcatcggagagcccatcgtctcgccgaccttcaccatcgcacgcgagcttgagggacggttcgcggacggttcgccggcgcatctggtgcacgtcgacgcctacaggctcggcggcaacgcctacgcgcccggacaagacacggtcggacggctattggacgaattggaatcgctcggcttggacgaggaattggaggatccgggcgagcataccgtcatcctgatggaatggggcgagcagatggccgccgcattggctccggaacggcttgaaatccacatcgaccgtccgcttgacgcgcccgccgtgaccgcggacggcgagctgaccagcgcgggcgcacgcacggtgacgttggtgccggtgggcgctgcctgggattcgttcgatttcaccgcgggaaaacgctgaccctgtctaagacgcatccgacgtggccgaccgcaccgcatgccgtggcttccagcgccggttgtacagtggttggcagtttggcacaaggagttttcaagcatatgcagacactggtgattgacacctcatatggttcgaccgtaggcgtggtcggacatgaacccatcgtcgaaacggattcgcgcacccatgtcgagaaactgcaggtgaacatcgcgcaagccgtcgaacaggccggactgcaggcgtcggacatcacccgcatcgtcgtcggcgtcggaccggcgccattcaccggcctgcgcgccggcatcgtcgcggccaaggcattggccttcgccacaggcgcgcaactggtcggacaggacgtgctcgcgccgcaatgcctggcacatactcaagctacggacgatcgccgccatctgacgcttgccgtcaacgacgcgcgtcgccggcaactgtatttcgcgctgtatgacggcggcaccgttgcggacggcgtcggacaatcgcccataacgttgatcgacatggacatcgactatccggattccatcacgatgcgcgtcaatgacgttcttacgaagctcgccgacacgggcaagccgtacgtcgtcgacgtcatcggccatggtgcggtcaaatacgcgcagtcgtggaatgcgattgcctccctcggcgaagtcgacgaccatgctctgctcgacgaaggcgcggaaggattggcgcgattcgcggccttcaccaccagcgaacaggcgttggcagaaccgacccccgtcgaaccgttatatctgcgtcgtccggacgtgtcagtgcccaacccgctcaagcatgtgctcaaccatgccggcgccgaacgaacggagtgacggcacgcccatgatcgtcgaccattcccagattccggaagacaccgccgtcggacagatcgccgcattggaaaaggacctgttcggccgcggcgcgtggagcgaacagtccgtacggcaggaattccacgctccggcacgcacgtatctgctcgacattgaaggcgatgccgtacagacggcggatcccgtcgtccgaggctacgcaggctactggtacgacggcgacgacgcggagatcatgacgatcggcgtcggcagaccataccaacggcaggggatagcggcggcgcttctcgaaacactgatcgtctcggcgcgtcggcagggcgccaaacgcatgcttctggaagtccgcgtcgacaacgtgccggcattggcgttgtacgaaaggttcggcttcacgcggatgggattgcgcaaacgctactaccagccagaaggcatcgacgcgtacaccatgagcctcgacttggagccgcgcgtcgtcggcttcagcgcaacagcggatacagagcacacttcagcaacacacacaacggagcagcaatgagcgaaccaatcgtactcggcatcgaatcgacctgtgacgaaacggcggcggccgtggtgcagggacgcaccctcatttccaacgtggtcgcgtcctccatggacgagcacgcccgctacggcggcgtgattcccgaaatcgcctctcgcgcgcacgccgaagcgttcgtgccatgcgtctccaaagctctggccgacgcgaacatgacgctgtccgacgtcgacgcgatcgccgtatccgcgggacccggcctcgccggctgtctcgcggtcggcgtgtccggcgcgaaatcgttggcatgggccgcgaacaagccgatctacggcatcaaccacgtcatcggacatatcgcggtgacgcagctgcagttcggaccgttccccaaggacacgcttgcgttgattgtgtcgggcgggcacacttcgctgctgcatgtcgaagacgtggcgcggcatatcgacgtggtcggcaccactctcgacgacgctgccggcgaatgcttcgacaaggtggcgcgtctgcttggtttcccgtatcccggcggcccgcacatcgaccgtcacgcgcagctgggcaacccacatgccatcaaagtgcctcagggccttacacaaggcaaggcggggcagcagcatccgtacgatttcagtttctccggcgtgaagacggccgtggcgcgttggatcgaacaacagcaggcggaaggcaatgagattcccatcgacgacgtgtgcgcgtcgttggccgattccgtcgcgacggtgctcgccaagaaggcgatgcgcggttgcgagcagtacggttcgaagaccctgatcgttggcggcggcttctccgcgaactcccaactgcgcgccaaactgttggaggtcggagccaagcatggcgtcgaagtgcgtatcccgcaaatcaaactgtgcaccgataatggcgctatggtggccatgctgggcgtgaacctggtggagagcggcgtgaaaccgtccgaaccggatttcgcaatcgattccgccatgccgttgacgaagatcagcatgtgacggtagtcccgccgcagcaagggagacacgcgcgggatttgcattttgcgttttaccgcgtataattcatgtcttgtgcacagcgcattcctgcgtagctcagttggcagagcatccgactgttaatcggacggtcactggttcaagcccagtcgcaggagccaaggcggaaacccttacgcgagtagggttcagccgcagttgcgggaacggttgcggaagcgtccgaaatggtcattctctccgattctcagacaaactcgaaaaaccagcccaaaaaacacacgaaaaagggttgcgacacgccgtaatagaaaattcgtatgtcaggtgggaaggttcatgaaaccctgagagaacgccatccaaacgtctcacagggcataacagccggtatcatgcggaaccatccaaatccgacacgcccatgccgttctctccaaaatagggagagaacacgatgcatgagccgtccggaaccacgaaggccgccacacggcatagggaaccatgtggcggccttcatagacataaccgcaatcagcaatctcaggaaaacccaatcaagcaggtacaaccccaataatcttctttatttggattgcgttatcatgttgaccgaacacgaggacaatcggctacaagcccaagttcgccctcacgtaggcttctacttccgcattctcttcgggagagccgatggtcagcaagtacacgcctttggttctggtttgagggttgccctcacgtaggcatttaaccagacccttatccattagcttattcatattcttggagattctattgaccgcgttcgtctccttcttctcgtcgcgcggctctccatcgatgaccttgatggactttaggttgtccggcaacgtcataccgaactcacgcgccagtgcgagatagccgtattggtatgtgcgtggcatcaggcgcttatcctgagcggttttgtccagcggccagtcagctgttaccaaggcgagtcgttccaagatgtaagcttgagccatgttaagggttgtcccatcgccatacttggtattgagaccgccttcgcgcgtcagctgatgtacgagttctgcattgcggtatcccacaatatccatctctttccctccacgcctaggggtaagctggtacatggagaatcattgtgttggtttttccattggccctcggagctggtctagagcttcgagggctttttcttacttttgtaccttgttttaaagtatacccaatagccactactaaacatgagtcttagtcatgttctaaaaagagtgtttagtaatcttttaaacagttgatagtcacgttcaaagtagaataaatacatatatatacataagtaacattattcttcatttttttcatagtggattttgccatgcttttgccatgcttttgccatgcttttgccatgcttttgtcataccggacaaaacgttagagggtataagaaaagcccgccagcacgaaaccagcgggcataagaaactatgagtcacattgaactaccgctgactgtaacgataaccagtaacaagaaacacacgccaacagcacaaccgagcacaatccaacaattccgcacatggacagaattgcgagaagcgatatactccaaagcctttgacttcacattccgctcaatggcatctggtgcaggattagttttggcctcaatctcatacaattcacgcaacgaaggattgtcaccatccacatcgtcgatgcgttccaactcgtactgggtacgccagtcaatcaacccagacatgcgaataccattccgtaccgccatttgaattagcagaacgaacactgccgaaccggcgacaatgcctgcgacaacaaatatgaaagccatagttaacctctcgcttctctgtgctttaagtcttacaaggattatccacccaaacaggccgtaagcacgcattaagcgtttctcatacggggtatccccgtaaataccctcgcttttgagacagcacgtatcaaaaccgcgtgtcggattgaaacatgcgttcgagtggatatatcatgcaagtgaaagacgaacacatgttcgattgaggatataaaaaggagggccacgccccgtcctgccagatgaatgcgtgaccctcgaagaacacctacaaggaggtgttatggtctagtctactccttcttatcctttatgccacgaactgcatcaagtagtccgaatgcgtttccgtatcccagagccttggctagattgtccaaatcatccgtagtccaagaagctagacctttgattcgtagagaagcataggactggctcttgtcgatgattcgtccggttttggcctgtgaccatccggccttgtcgatcatcgaagcgaccgtctcggctattagctttgttgcggcactggtttccttgagttcggtattgcgtaccacttttgtttcacctcctaactctattgagtttatttgttgacatatgtaatggtaggaactagagcggtacgacacgccgataaatctgtaaatagctctattgagttgacaaacaataaaaaacgattattcttagtctcagaagttagctcaatagagttaaacaacgaggctgaataggaaaggagcaacgagcatgacgtttcgggaatcaatctcgaaggcgattgaatcccagcgcaaccggctgggaatcacagcgacggagctttccaaacggctcggaatttcacgccagtactattacatgcttaaaagcaacgatgccctgtggaagatcgagcagctaggcaaagtcgcatccgcactggaactcaaatcagtatgggagcttatcgacttagctaagttcgaggattcactgaacaccactatgaacggcgagtccaatgaagcggagcatgagcaatgagcgccgaggtacaacagtttactttcaacggttcagcattccgcgcattgaatgacgaatctggagagtcttggttctcaggtcaggatgtgtgcaacatccttgggacaggcactaaccacctgcgcgaatacctcgatgaagacgaaatcaccaatatccgcaatacggacattgctcaaaacggaggtaaagcgccggtcttcatcagtgagccgggcttgtacaagctgattatgcgtagccgcaagccagaagccaaggaatttcagcgttgggtcactcacgaggtgttgccgtccatccgcaagcatggcgcttacatgactcagcagactttggataaggcgctcaccagccccgacttcctaatccaactcgcaaccaagttgaaagaggaacaggagaaggtcaaggagcttgagccgaaggccaaggcgttggatgacttcacgaacgttcccgatgctctgcttgtccgtgacgcagcgaaactcctaagcaacgattccaacattcagatcggtgagcatgagctgcgccaatggcttgtggataacggttggatttaccggcagcctaaccagtcgtggtgcgcggcgtcaagtcgcgtgaggcaaggccatatggtcatggtgtcctcccgttcccacggaatccacaaggatggcacgccattcgcctatccgccgaccccgaagctgacacgcaagggattggcgcttatccaccagcggttgtctgaacaaagtttcgagcgagtgcttgacgcggaggtggcggcatgacgttgttgaatcctcccgcgccaccgcatgagttcgttcttgacgagggtgggcactgcgtcttccgtatcaatgatcggaaaggcgggtcaatcgttgaaaaagatggactcaagacgagcacattgtatgagattccagaatcgaaactggctgcgttcatccaatgggcttccgacgttcacggccaatcaagataggagcaggttttgacagacaggatggttgttgtcgaagaggagattttcgacaggcaggaagctgccaggttcttcaagcttggaacggccaagttcgacgaactgtacggggggtgcgccgactatcagggcggcaagaccgtcacatacaagaagtcgaagcttctcgaccgttacgaccaggtgtgcgagagtccacgggaggtttcggcatgaacggcactcgacctgacgcgtggagcgtgcagacgggcattgacttggatgccatgcttgccgccaacgcgggttggattgaacgggtcagacgtaagaccaaacgtgactatcagcgggacaagccggtattgcagcgggtgttcgagtcgcttcgcacgaaatacgaggccggtttcagtaccagttcgtatcggattgcggaagacctgcaattggctcagagcgttgtctacagaagtttgcgcaagcttgtttcctatgggcttgcggaaacgtttctgacgcatggaagacattgtttcaggccgacaggcttggaaccgacgaaaggatttgattggaatgaatgacagtgttttggtgaagcttgaccagcttttcgataagttgaagaccgcaagcgacggagacgattggaataccgtgcgcggtctggtcgcacagatcgcatcactcgtcaaagtggatgaaaagccactgcccgaagagccgaaggagcggggcttctatgtcaccgcgaatgatggtcggctccctaaacccgaaaaaaatacatgactaaacacgaaacaccgacttgacgaaatacatcaccgtcgacctgccaggattcgagaccccgggcgtaaacacgtccggcgtcatgcttgatcgccacgggacggtatccgttctccaacagcatgaggttgagcagttgccggccggtcctgccgttgccgtccatgaatggatggatgttttcgaacatcgtatggaacgccgcggccttgagcaacgggtgcgcgtcgcttccgttcagcccgtcgatcagggcttgcaggtcgtcatggatctccaacgggtcggcggtcttgacgcgggtcgcggtgattctcgccagatatccgtaaggacggaacgtgccgcgtgcgaacggctgcaggtccaatgcggtcacctcgtggatcctttggatcagttccgggtcgagttcacgtctttcggaggcgtattcgcggacgtaggccatgccgtcggcgacgccgcgcgccgcgaacacgaaacgtgccggggaatccgagggcacgaattcgccttccaatacgagggatgtgtcctgaagagtcagggtcgatccttcgatggcgtttgaattgtaggtgtatctcacgagccagtcgcggtcgtaatcggataatgccatggtttcgacgccatccaacggttccagtgagagggcgtgggcgcgcagggtgtcgatgaggtccagtcgggtggtgatttccggaatccgttcaagtttggcgaggatgccgggcatgtcgtcgatatgttgacgcagttgcgtgttgggcatggtttctccttctttggcttattttaccgaaccgtggtggatctgggtcctgagagagaaacggccggaacagggtcgggaaaccgtcatgtggttttccgtcgtcctgttccggccgcctgtttgtttggaggggggaattgggtcagcgcatgccgtggcgtgcggtcacgtccatgcggcggcgtttcaggtcgagcgtggcggcgcccatgccggcgaacgcgacgacggcgaggatgatgccgttcgtatccgcgccggtggatgccatgaccttgtcggccttggcggccgcttcgaccgtggcctgctgggcggcgttcagactggtctggccggcattgtcgtcatgcttcgggttggcggcctgctgggccgtcttgagcgctgccttcgcggtctcgtagtcgctcttggcctgggcttcgaccgtctgggcctgcttgaggtcggcctgcgccttggcgaggatcgtcttggcctggtcgagcgcgtcctgtgcttccttgaccttggcctgcgcggtcttgacggcgtccgtgtccttcgcgtcgctcttggccttggcgaggcgtgcctgcgcgtcggtcaacgcctgctgcgcgttcctgaccgcggtttcggcgtccgtttcggcctgcttggccttgtcggcctcgttcctggcggcgtcgtatgcctgggtcttcgcgtccaggtcggcctgcgcggcggcgagggcctgggtcctggccgcgaggtccgtcttggcgttttcgaggtccttgacctgttgggcggccttgtcgctttccttcttggcctgctcgtacgcggtctgggcttgggcgagttcgtccttcgcggtctgcttggcctgctgggcctggtcggcttcgctcttggcctggtcgtatgcggtctgggccttggcgagggcgttcttcgcgtcggtcagcacgtcgagacgcgtgtcggcggcggtcttgtcctgttcggcctgcttgacgtccgtgttggccttgtcgagcgcggcctgggcttgggtgagacgcgtctgcgcctgctcgtcggcggatttcgcctggtcgtacgcggtctgcttggtctggcggtcggtttcggcggtggtgaggctggcctgcgcctgctcgtcggcggatttcgcctgctcgtacgcggtctgcgtttctgcggccttgcgggtcgcgtcggcgagcagctgcgtggtgcgtgcggattcgtcttgcgtgtcctgcaggtaggaggtggccttgtcgagcgtgaggacggcggacgcgtgggccgtgttggccttgtcgagcgcggtcttggcggcctcgacctgcttcaacgcgtcctcgtacgtggattgcgcggatttgatctggttgacgtaagcttcgaccttcgcgcggtacacgctggcatcgaacgtggtgtcgttcgcgttgtaggagttccagtcgttatagaactcctgggaggatgcgccgtatccgtaatcgccggtgtcgtagccgctgtaggccatgccagtgacgctgtattccgggtcgatgatgttgaggtagtggccgaccttgtagtacaggtccggatacttcgagaacacgtcgtacggggacaggtccgcgaggtccggatagtcgccggacttcacggccgcgtcgtagatcgctttctcgttcgtgtaccagccgatgtacgggtcccagtccgaagttccccatgcgaggttctcgccgacgttgtcgtactggtagttgtggttgtggtgttcctcaccgggctgtgcggcgtagttggcctggaccatggccatggccaaagcggtctcggacaccttcaacggttccaggccgttctcctcgcgcagcctgttgcactcgtcgatcatgtcgagggccttgagcaggttgtcgaggctggtcgcgtcgtccttcgcgccgatgtgcgtgtattccaggtactgggacacgctggagtcggtcagatacttgtacgcctgttcggccttgttggtcttgaaccatccggccgcgccctcggcctgcgccttcgcggcctcgtccgcggcctgcttcgcggcgtccgcagcggcctgcgccttgtcgtacgcgtccttcgcggccgcatactcgtccttggtcctgtcggcctgcgcctgcgcgtccctcacggcctggtcggccttgtcgagcgcggcctgcgccttgtcgttggcggcctgggcgtccttcacggccttcgcgtccgtgttcttcgcggcggtggccttgtccagggcggcggaggtcttgtcggccttctcctgggcggcgtccttcatgtcgttcgccttgtcgagcgcggccttcgcctggtcggcctgggtgcgggtcttgtcggcctcggatttcgcggtggcctcggcgacggtggcttgggcctgcgcggtcttagcgtccttcacggcctggtcggcctgcttggccttgtcctgcgcctcctggatcttggcgggatcgttcgcgtcgcccgcgatgcgggtggcctcgtcgagcaggctcttcgcctggtcggccttctgctgggcctgctgcgcggcggcggatgcctggtcggccttcgtctgggctttgccgagcgcgtcctgcttcgcggcggtggtctggtcgagcttggtcttgtcggtcgagtcgaccttccgctgcgcgtccttcacggcctgttcggcctgttccttggccttggcggcgtcgtcacggatggactggctgtcgttcatggccttcttgatggtctcggcgttcttcgcgctctggtcggccttgtccttcgcggcggcgaggctgtcgtgggccttgtcgaggttggtctgggcctggttgacgcccgtctgggcggcggccacgttcggatcgttgttgatggtggtctcgacctgctgttgcgcctgctgcacgttctgctgggcctgctgcacgccggtctgggcctgctggacctgctgctgggcctgctgggtgccggccgtggcctggtcgaggctggtcttcgcgtccgtgacggcctgctgggcggcggcgacctggtcctgctggggctgcgtggtcggctgggccgcggcctggtcgacggcctgctgggcctgctcgacggcctgctgggcctgttcgaccggggtggtcgcggtctcgtcggccattgccggcgcggcgatggtgcccgcgacggccacggatgcgacggccgttgcgaaagccttcttgttcataattctccctccaatgccatgccccgtatcggggtcgtggctccaatggaaacatccctgcgacgtttccgacaaccattccacgtgcccccaatccgatatcggcgccatcggcgtgtcgcggtctcggaggcatatggcgcgcatacccaccagtctacccccgcatgaggcggtgccggcgtgtgggcgtctaccgtttcatgccgtggcgtccgtacgggcggacgcgtggcctggactcgaccatcgccacgggcatgcccgcgagcaatgccacaccggacacgagcagcgggcgcgtgtcacggccggtggtcctgggcgcgtcctcgggatagggcgcgtcgtccggcatgctcacgcgttcgcccgtgacgagcagccgatacgtgttcaggaagatcggagtgcaggtgaccagcgtcaccaggtcgcgtcccggctggatgcgcacgtcgcgcagatcgtccggatcgaccttgcggatgcgttcgaccttgtaggcgagggtctgggctgcgaccctcacgtagaacacgtcacccttcctcaattcggtgagccgagtgaacagggccttgtcggccactcccgtatgtccggtgatcacactgtgggtgctttgcccgccgacgggcaggctggtgccgtgaaggtgtcccgcaccgttctccaacgcgtacgtgtcggccccgtggcggacgggcaggtccacgccgatggacgggatctcgacggtcgccatgatcccgtcgccgaaatccagcaggttctggtattccgtgtccgatttgaacccgaaatcaccatcgatggtcccgtccttgccggacgtctctccgatgacatgcggcgtggcggcgagcctccggttgtactcgcgggccttggcgaccatgcgcgcgtaatgttcggccgaatggtcgtccttcgcggccagggcggacgattcggccgccctgcgggccgctccggcctgttccacgccaagccaagcgaacgtgcccacacccgacaggcagaacacgaccgtgacggcgatgagcgcgcggaacacgcgtctcgaatgccgtgcgcgtatgcggcgcaggcgccgcatacgacgtccctctgaagcacgttcgccctcgatgatccaatcccaatccataacgtccatacctttgccacgatccgttccacgaatatcgacggggatgggcaacgggaagggccggcgtccggaccattccgcccacgtccgaatggagttggtggatggccgtccgccggcccttccgtcaccgggttccggtcactcgtcgtccggcatgccgtggccgttcatgcgtctggtgagcatgacggtcgagccgatgccgaacatgagcagcaagacgccgcccgcgatggcgatcggcaggccgataccgcccgtttcgacgaagttctcgtgaacctcctgccattgcgcgtacagggtgatgtccttgtcctgcaatgcgaccttgctgccgtccttatagacgacgtccgccttaccgggtttagtgccccaacccttgaacacgtacttgtcgcgtttgaacgacttggacgtgtcaccgggaatggtcacatccgaatactgccagccggtcgtgttcggatgcgaaccggtgccgccgttcgcgttgtagatcacgttggcctgcaaccgctgccagtgcgcgtacacggtgacgctgccggtcagcggggtgttccagtcgtacaggttggagccgtcctgcggggtcgtgtaccagccgaggaatctgtagcccttgatcttcgacacgtcgcccgcctgccagccggaaccatccgccgcggccgtgttgtagggcacggacacggacgccggggtggacggcatctcgccggtccacgtactcggcttgttcgtgtcgtaggtgaggaccgggttgccgacccacaccgcgtacacggtcatgccgccctcgaccatcgtgacctcggcctgcgcctgggtcgcgttccggtcctggttccaacccagctgggtgtggcccggacgcgacagcatgctggaatcccagcagtcgtcgtccttcgccatggtcgccaacgtgatcctctggccggccggatagtagacctggcagccggacaccacatccgtgctctggtcgacggtcctcacggtcacgctaccatcctcgtgggtggtggtccgctgcacgaggtccgacaccttgccgtcggtctccgatttcgcgggctgagtggtgttagcggccgtgtcggacgggatggaaccggtggcatcctgcgcgttcttgttgtaggtgagacggtaggcgatggtcgaatcgactggctggaagccggactggcgggcctgtcccgaggcgaccgaccagcggacgtggaaggacgagccggtgaatgtggcgccgacgtaatgtttcattccatgcgcgtcggcattgttcttgttctcgtccgtggtgccggcccagctgttcgtgccgaaccgggcgaggtgagcgtcggagcgcacgtacgcgccatcgaagccgctgacgagttcgacgccctcgttgtatccgctggtgccgccgtcaaggtcggtgaatccggtcgcgccacgcagcccctgcggcgtggatccgtcgtccagcaggaaatcgacggtcacatccatgtatgggcgggacgagggatgcttgtcccacttgccatacgacgctctgaactcgtgcttcgattcgaggtacaccagggagccgaggttctggtcgttcacggtgattttggcgttgagccaccgttgcgtgccggaggagtcgcgccactgtcccacatggtgcaggaccaggctcgcgccattcttgttcggctggtacatggtggccagaattccggcatatgcctggttctcctccgtgggatcccagttcttcttgacagtgaagccgttcacgtcggtgatctggtccgcggtgacaccatcggttgtggagaacttgaaatcgccgtactgggccggagcgatgtcgcccttcttcaagtcatgcaccgtcagaccggaagcggtcctgtccgccacggtcctcacgcttccggtcgtcctggtcttggcctgcttgacggtgttcgcggtcgtgtcggacgggacttggccgtaggcgtcgttcgcgttcttgtcataggagagcttgtaggcgagcttgaactgcacgtcgtcgatcagattgccggagatgccgtcgatggaacccaacgccttgaacgtgaacctgctgacgttctgaccggcgggaaccacgaccgaaccctggaacgtgtcccacgagccgagccagccatccgtgttcggagcgttcaccgtggtggacttctcacccagcctgttgccccggtcggacgcgatgcgggtcatctccaccggctgctcgtggccgggcgcgccgacgaggatctggatcttctcattggagttgatggtcccgttcctgtgcgcgtaccggagcttcaccgtgtacacggtcggataatcgtgcgcggtgtcgatgtcctgatacaggtacgtgcccgcctgcgaggcggtgatctccgcgtacatgttgtcgttcgcacgggagcgttggatctcgacgatgccgccgcgcccgtcgaccctggtgtcggtctggttggatttccagccgaacttgttcgcgtcgaacccgttgaggtgcacccactgcttggacgcctcgcccttgccgttcaacggtccgctgacctccacgtcgccgtgggccgggtcgatgttggcgaaattgtatttcgcgctcatcttcgactgggtgacgatgttccgccaatcatggtcgaagtcgctgttgacgagctgcttcggcaggccgttggcggcgtaggtcgccacatcgtcggatgcgagacgcacgctgccattggtcttcgtcttggcctgcttgacggtgttcgcggccgtgtccgacgggacggaaccggatgcgtcaccggaattggtcttggcgggctgggtggtgttctccttgccgcgctggttcgacggaacctcacctgttgcgtcagtggagtttttgtcgtaagagagcttgtaggcgcgggcgaaggtcacgtcgtcgagcaggttgcctttggtggggtcgaggtagttgacggccttgaatccgaaccgtgtggtggtctgcccgtcagggatcacgtagtagccctcgtaggtctcccactggtcggcatgatgccaacggttctcgttcgtgaccttggtggcgatggtcgtggacttctcacccaccttgtcaccggccttgccgttcgcggtcacgcgggtcatctcgatgggcgtgccgttgatgacgacctgcatcttatccacgttgtccttgcacaggctggcgtgcttcaaccggatcttatacagggtgccgggaatggtggcaaggtcctgatagatggtgcggccggtctcggacgcgaccatttccgcgtaggtgttgccatccgtgctgtcctgttggagttcgaccgcgttggcacggtccttcagaccgccttggtcctggccgcccttctggtcggtcctccaagcgaacctggacgagtcgaaaccgtcccagtccacccaggcggtaccggtgtccgactcggcgtgccttgcgttgcggatgtactgtccgttgttcggatcgacactcgtatacgcgcttgccatgtcgtaacgggcgctgatggtcttccacccaccgtcgggaaggtattcgaagtcgctgtttatcaggtggtccgacagtttcgacgtgtcggaggcaagcctgattttgccgttggtcttggtcttggcgggctgggtggtgttctccttgccgcgctggttcgacggaacctgaccggacgcatcggccgagttcttgtcataagtaagcttgtacgccttggtgaacatgacgtcgtcgatgaagttgccgcgcgtggagtcgcgtccctgggcgctcttgaacgtgaatcgggtcacggtcgaggtggcgacgtacacgccggtgtacgtctcccattcggcctggccgcccttggtcgcaatggtcttggacgtcacgccggtccggtcgccgcggccattggacgtggtgcgggtggcgtcctgcgccgtctccctgcctggactgcctatcatgacctgcatggagtcgacgtgggatgcgtcctcgctcgcgtgcttcaggctccaccggtacatgacgcccggcgtggtggcgatgtcctggtagatgtactcgtccggggtttcggcgatgatctccgcgaaacggttcattttctggccgttgttgttcggcttgttgccgatctgcacgcaatgctggagcttctggtgcgagttcggctgctggtcgggacgcaggccctcctggctgctgtcccagccgaatttggaccggtcccagtcggggataggcatgaacttgcgtccgtaatccacgtagaagccgccccagccggtcgtcggatccacgtcgcagctgttcttgccgtccgggcaggccggatagtcgaacgagccgttgacgatatggtccggcaggcttgacttggccgtggccttgtcctggctcgtcgaggattggatttcggcctgctggccggcgtcggactgcgcgccggcgtccgtggtggaatcggcgtccgtggagtcgtcgtccggattgtctgccgtgtcctcggaggtctcgttcccgccgtcgtccgcgagcttcacgacgcttttcgtggttccggccgcgccggtcacgtcgaccgcgtttgccgtgccggtcaggccggtgcccaacgccgcggcggccgtgagaccggcgagaagtcttgtaaggaatcccatttccctcatcctttgtgattcatatgtgagttccgtattttttggaagagggccgggatcgtgcggctgacaggagaaaaggccgcacgatcccggcctctggatccccggcccctcgctttcgaggccggggacgattcggaaaaatcaggcgatggccggaccgtcgcccaggttctcgtggcggactcggtaggcggcgaagccggacgcggtggccacaaggatgatcgcgaacgcgccgaccagcatgacggccatggtggtcgcgccggtctgcggcagctgggtgatgttgtcgatgttcttcaccacggcggtcggggtggtggtcttgccgtccgcgttgttgaccgtgccggtgagtcccggctggtccttgccggtgatggtcacgtggccgtcgtcggtgatcttgagggtgaagctcggcttgacgaagctgaagtagccggtcggcacctgggtctccttcacggtgtacgtgccggcgcccagacgggtgaagttgatcacgccggacgcgttcgtggagaattcggtggctttggactcatccgtggtgaacgtccactggttcgaacccgtgttccacacgtaccactggttcaggctgtcgttgtggagcttgaacttggcgccctggatgaccttgttgccgtcggccgcgctgatcttcttcagattcacgtcgtaggtcgggaccggggtctcatcggtgcccggccccggggtcggcacgtccggcgggaccacgttgggcagccagttcgaggtgatcaggatctggttgaggccctggttggccttggacgcgttgacgaccttgccctggtaggtcacggtcacctgcttgccctggtaggtgtccacgaagctctgcaggctggtggtcttgaagccggtgccgtcggaattgccgaccttgtccttgccgatggtgccgaactggttggtcacgtccgtgccggacgacgtggtcgcgtggaacgaaccgtccacgtatacgatgccggtcatgtggtcctcgagggtgatggtgtccacggccagcttgttcggcacggtgaacgtggccttgaagtcacgggtctcgccgttggtcgcggccgcggaatccttccacgtgccgtccacgctcttgatcttcttgtcgatcttggtgacgttggtcttgatctgggtggaaccgagggtctggccgttgctcatcctgacgctgccgccgatcgtggtggacacgaggatcgggattccctgggcgtcgacgacgagataatagccctccggcagggtcaggttcagactgcccgtggcggaggtctggttggtcttcacggccgacaccttgctggccgcggcggtggactgcagggtgccggcgaccttgcgcagcgtgtccgaatcggtcttcaaccgcaggagttgttcggcggcgttacggccttcggacgtgttgtaggtcacgccgttcttgttcaacgcggccttgacccacgcgtcggtcgtggcgttcggggatgaggcgctcacgctcttcacgttcgcgccgtccttgacgacgtcgttgtatccagcgaccttgtacacggtgaagctgtgtccggcgagggtgctgccatcgcccgcgttcagggtgagcgtgccgtccgcggcgaacgccgagcccgggacgcacaacgcggccaacgcggcggcggtcgcgcacgcggccgagatcttcttcatatccatactggatgtctcctttgatagggattcttctgttttctgcacggacggctcacgctgccgtggaagtccgatatcgtcggcgtccgctttcggatcgccggccggttgccggatctctcaaccattcccacgtgcacatggccgtatgagcgcagatattcgaacgggtggcaccccaataagatggatgggggcgtgggccgttctttcggacgagccacgccggccttgtacggcatccacggtccgggaaaggaaaagggcgggatgttggagaatcctccaacatcccgcccgtggcgtcactcatgccgtatggcggatccgaacggtcatcggatcatttggcggcatgcacgccgtgcttgacggtcgaggtcctgcgacgtgcgcccaagagggtcacgccgacaccgccgaaggcgatgatggacagcaggacgccgccgatggccatgccggtcttggcgagatcctcgcggtagccgctccagtcgtcggtgttcgagtccacggtggtgtcctcgcacagggtcctgtcgccgaccttgacctgcttgaggcctgtcgtgtcggacgcgtcgccgtcgaccttcgcatcggcgtcggacttctcgtcgccggtctggttgccgtcggtgggctgctggccgccgaactggtcggtgacggggcattcgacgagcggcgtgccggtgaccttgacacggtcggtgtgcttgccgccctgctcgacgcccttgagggtgccggtgatgatggtggattcgccgggcttgagcacgagggtgtcccagttgtccggatacttcaggtccgtgacgtcgccttcgccggcgatggtcctgtcgaccatcttgaggtccttggcgagataccaggcgccctcaccggtcgaggagtccgtcttggacgtgttggtgatcttgaacgcgatctgctggctgtctccggccatcttcaacgcgtccttcacgtcgtcgcggtcgccggcctgttcgccggaggccacgtcgtacttctcgatgtggatcgacggggtcatgtccggggtgcgggtccatacgatgttggactggaactccttgtcgttgaagatctcggtgaactggttctcgacacggtcggacaccttcaggcgcttgcactggatgtacgcgcgccagccgttctcatgcgcgttgtccgcggacacgagggcacggtacgcttcggtcgcctcgacggtgacctggccgttggcgtcggccgtggcggtgaacagttcgccgccgagcttcgagctgtcgaagccgttgccggcgagcttgtcgcccttggcggcgagcaccttgccgtccctgtacaggtcgcgggtcgcgtacacggcccacgcgtccgtgtactggtcgaactcggtgttcagcggatccacgatcttccactggctgacctgcgggtaggcgcgatcggccgggatgacggagctgtcgagctggtagaggaaggtgcggtccttgtacacgctcctgccgtcgatgctttcgccgccgaccttgacggtcacgtccttggccgggttgacgggcttgagcgggttggacacctcgttggtctccacggtcgtgtcgttggtgacctggatggccttgttcctgaccgtgtacccatccttgaccttgacgaccttgtacggcatgacgacctggtaggtctggccgaggaggttctggtcgatggccggatcgttgagcggatcatgcttgccgttggtcgaatacttggcgaggtccttcggctgggggtcgcccttgacggtgacgcccttcttcgggatccacgtgtccacggtcttcgcgtacacgtatgcgacgccgtccttgatctggatgttgaactttccggtcacgtccttgccggactggtcgagcacctcgatcttggattcgtcgatggcgacgtactcgtcatcgaaatcgtcggtgatgccggccttccacacgcggtacgcgttgttggtctgcttcaggtcgagggtgaccagatagttgccggtatcgcccagcagcatggtcttcccgtcgatgctgacggtcggatcgccctgctccttggactggttgtccttcttggaggggttgtggaccggcggcaggttgtcgacgatgttcgacggggtgatcatgttgttcagcgtgagcgcccactggttggccactttgcggtcgacgggagcgttcttcgcgacggtgccttcgaaacggacctgcacctgcgggttcgtgccggccttccaatgttcggccacgtacttgttcgagtacgtgatggtgaacttgtgcgccgcggtgtcccatgcgaccgtgtagtcgccttcgacgcccatctgcgggtcgctggtggtcagctgtccgccggtggcgaggtcggtgatctcaagggtctgctggtcgggttcgaggtactggtcgtacacgtcggtgtcctggatggacacgatccggtatccgaggtcggcgggcagtttcggctgcgtggtgagacggtattcgaccttctggcccggatacacgaccttgtcgtcggcgtcgttgttcgcgccgccctggctgccttcggcgatgaccttcttcttgaccggtgggacatagccgcagatgtgcggttcgttggtcggctgggactcgttgttgaccttctcggaacccgagttggtcagcttggagccgtcggggttctcgcagaacgtgagctcgtcgcccgcggccttcctgaagtccttgcggacctgggccgcgcccttgccgttggcgaagttcaccacgccgggcaggagcaggctgatctgcttcggattcttcaatccggcctgcgcggcacggtattccggcttcgcggtcgcggtgaccttggtgccctggacggtgatgtcgaactggtcggtcacgtcacggcccttgttcgcgatgtccgcgacggaggatgccgcgtcggtcgtggcgtcggcctcgtacacgcggatcttcgacttgtcggacgtgagatcccagatgtagtcggccttggcgtaatcgtcggtcagcttgatgtcggtgaccttgacgagatcggacgcgatgacgccgttgaccacggacgcgacctggtcgccgtcgaggaacttctgggtgtccgctccggtcttgttcgtctcgtccggatcgaccacggcctgccaggtgccgtcatcgccgagcttgatccagctcttgtccgggttcgggctccactccctgacgggcggctcgttgccgggcacggtctgctggttccatttctcccaatcgccgttggtgagctggaccttctggccggccttgagcacgcccttggtgaacgcgcccttgatggtcatgcggaccttgcggtccgccgcctggttgtaggtcgtgtcgagcagcggttgtttcgcggtgatccacaccctgccatcctgcttgtgcacgtcgaacaggctgttcgcgtccttgccgtcgatggtgacggtcaccgacgcggaatccaggtcgatgttcctcgcgctcttggagaaatcatcgcccaattcgtaggagctcatcttcctggcgaggttcttcggcagcaggccgttgacggtcacgccgaaatcgtcctgctggacgaacgtgtgcgtgtccgcgttgaccttgttggtccacgccgtgtcctcggccgtggcggcctggccctggtcggcgctccacaccttgtcgggcttcgggttgcgcacgtagaccggcggctcgttggtcggctgggattcgttgttccacttctcggaggccttgttggtcagcttcctctggtcggccgcggcctgcgcgttcggcgtctgcttcacgtatccgccgatgtacagtttgaccttgcggtccttggtgccgaacgcggtcttcgtgaggaacgactgcttcgcggtcgcggtggtcgtgtgcttcgcggtgtcgaccgtgatgtcgaactggtcggtcacgtccttgccgtccacgtacaccttgacctggtccttgtggttccagtcgatccactgggccgaagcggtccaatcatcggtgatcgcgtaggaggtgaacgggttgagcaggtgcgcggggatacggccgttgaccacggcgccgatcgcgtcgccggtcacgaacgtgcggttgtcgctgcccttgtcgttcgtatgctgcggatcctcggccgtcagggcgccgttggagtccaacacccacaccttgtcgggcttcggagtgaccttgccgacctgttcgctgttgccggtctggcagtggctcttatccgcattgccgtactcgtcgccggtccagcaggcctggctgtcgtccggaatggtgtagtccgtgccggtcggggtcgcggactggggcacgttcaacgtgtattgtccggagaccgggttcagcacgtgcgccttgacgacgcgtttgcccgcatgggaatcgtccaccgtgatgtcggccttgacggtgttgccgtcctggtcggtcacggtgatcttcgaatagtcgtccttgtctgtgccgccgatcaggaccttctggccggtcacgtcgatcgtgtcgtacagccagaaatgctcggacgcgttcgactgggcggtgatatgcgccgtatacaggctgccggaagcgatctgctgggcctcggcggtgacctgctggcccgccatgttggtgagcttcttcgacggcggcggcgagaccggcttccaggattccttcgcgtcctgagcgcccatatggctggccgcggccttcatatggccctgcttgccgacggtcacatcatagtagtagaagccggccggccatgccttccaagacttgtccacgtccctatagccgaacgagacgcttttggtcgtgttgttgttctgggtgaactgcttggacgcggtacgggtcgtgccgtccagaccggtccaatgcagcgtgacggtgcccgtcacgtcctcggagatcgtgctgccgccacggctggtggtgatcgcgtcggaaacgtcatcggtcgaaccggcctgggtgaacaggccacccgcctgcgtgctgacggtcagatcgtagtcgaccggcggctcgtcctggtcgagaacgatggcgacgaccgcgcgcggggccttgctcatctcacgggccgcgagactgttaatggttgtggctccatcgctgaaagcatcggaagtcttgtaattggctccctgatacgaataggtgccgttcgggatgccggaggcgttgtaggccgccttccactggtccgcgctgaaggagccgttggcgcccgtgtaccagtcgccgttcgcgccgggcgtgtgcacgaagcccacggacacgaggcggcaggtcggattctggttgcccgaagccttcgaacgggccacgcattcggcgttcgcgccgttcacggcctcgtcgatggcgctgttggactcgctgccgtccatcgacttcacaccgacggatcccatggcggatttcacattctcgcgggtcggggagccgaaggagtccttgtacacccatgtgatcttgccggtgccgccggcggagccgtcgcccgtgcccgtgccgtcaccggagccgccgccaccgtcggcggcgaacgcgccggcgaccggggacgccagcgtggccgcggcgaccaggccggctatcgtggccttgccccatttcttgttcttgttggaacccaatgttccgtctcctttcagagattctgcttgcagaacgtcccgccgtgcgggcgggacgggacgacgggaacgcacgttccctgcgcggtccccctcacggggaccggcccatccaaccggttccacgcgtacgggcgccgatggggctcgatatgggttcggggggttacgtggcatgtaaggtacgggaaagggaaaggccccgcccaacagggcggggcctttggaaggctggatgaggcgaatcagcccaaagggcagaaatgctgtccatcgcaattcggattgatggtcactttgtcttcccagtcgtagtggatgcttggcgcgggggagttcccgctcggggagccgccaccctggccttgcgatccgcctgaatacgatccgccggaataggaccgtccaccggcggaaccggaccagccgccggacgaatacgaaccgtacgagtacgagcgttgcgcctgctgttgggcctgctgtgcggcggccgcctgggctgcggcctcctgttcggcctgcgccttcgctgcggcctcggcgtcggcctggtccttcgccgtcttcgaatcgttcacggccctgacggccttggcgattgcgtcggcgtcgcgcttggcgatggcctgcttcaacgcgtcacgggtcttatcgtcctggaccttgccttccgtcgccctgtacagtccgtccgcatcgtccaccgtcttgtcgagcttcgacgattcgaccgccctgaccgcggcctgcagcgtcttcgtatccgccttcacgctcctggccgtcttgtccgccttggcggtggcctcgtccagaccggtcttgtcggacgcgtcgcacttgaccatggcgggcgtctccgccccaacggcccgtttgagcgcgtcaagggtcttatcgtccttcacggccttcacgtcggtcttcaacgcggccgtcgtggcgtccgcgccgagcagcgtccgatacgagtccacggccttcttctgggctgcgacggcggaaccacacgccccacgcgccacggagaccctatggtcctcccaggcgcggtatccgcacacgccgccgacagccaggacggtcgccgtgacggccgccacggcgatgatgatcggcctgcggtccttcctcgttggaatgtcctccgtgccggccggtggaatggctgccgggacagtattcttctcttccatgacggttctccttgatgtcttccgttccctgtttcctcaatgttcgatatgctcatactacccacataaccccctgacaatatcggcaggggagaagcatgggtttttcggtctggcggcccggaaggaacgtccgcccatggagttcggaatccgggaaacggttgcggatggaaaacaggagtcgcggaacgccatgggagcaccacgtagcagtcaactcagaaggtcgatactccgaacatagtggaggcttgttcccggtttcctttcatcggccgtcggtcccttcttcaacgacttcggataatacagtccgttgtcatcccgtcccagaccaagatgccatgccgagccaccgaaatacaatcggacacgactattgcccgactccaccacgagttcggccttatccaattcgaatgcgccggcaatcacatcggccttggctttcaaccagttcgcatcaccggtcggcgcgaccctcttcggagagatacgcttccgcgcgagcagatcgacatacagacgacgtgcgggcaatgaccgcctgcgatggtcgtcggcataataatccaagccacacaagtgagcgaagttctcagccctccaccgtatcgccacctcgaaaccgtcgtcacagacgattcgcgtggtccggccaacgagacactggtacgacagggcggccttgcgcgcctcgccaagcatgcgctccttctccctggtgacgttcaagcccgatcctcccgcgaaaaaagaaggggcgtcgaaccaacgccccttcggaagcagacggcaagtctttttacagtcttctgcgtgacttgacgctcccttgtcagggaggatgaacggcttcggcccgttccggccatctggtccagccgctggacgagacgtcccgctatcgcggatgacgcggccatcgtcatcggacgcctgcggcagcatgccatctgttccggacccgaaaccccgcccacgaccaaaacggggtcaggcttcaaggtctatgcgattctattcacagaccatggacgagtccatccaaaggattcataggctcctgccatgtgtgcggacgagcaggtacgcccagaccatcagattcacggtctgcaccaccagcagaatcacatccacgccggaaacagtgccggtccaaccatcccgtatgcgcatgagcccatgacccaacccgtacgagtaggcgagcacgccgatccacccggccaatcggcacaccgaatcgcgccgccgttgttcttccgaacatcgacgggaaccgttcggcatcatgtatggtccgaccagtcggacgcacgccacgagattcagcacgcatacaaggcttttcaacaggttcacccaattcactgaatgtctccttcccaccatccggcgctttcgcgcacctgttccatcagatcctccaacgtggcctgtttcgaggcatgacttccgatggtccgaccattccacgtctcttgaccatcgatatcatgagaggcgcggtcaccttcccggaccgtcgaaacgtatcggagcggaggacgatgagggcacgatggaaggatcgggatcgggaagaggttcggatggttccggccgggacgggaagcccacggcgggatgcagttcccgccacgcctccacgaacgcatgctcgtaccggtagtcgcagacacggcgatgataatcgtggaaaccctccggcgcgacggtgagaccatgcgacgtggagggtacggagtcgagaagatcatgaagggaacgcggatcgtatctttccatgaaacgatccaacgccttcgtacattcctcgtcctgccccgacatgatgtacttcaagggagcgatgggagcgcccttgtccgtcacataacaggagcggacgtccaacgcgtcctgccggatgagatccgggttggcgagacgacgttcaattcctgattccgttctcttgttgttgaacgaattgccgttatcatagaccggcgcgagggagaactccccacgtggatttctgagaataccccaattcgtgttattccggtctatattgcggatgaacgcgtccaccacgaacatgtcccagaacctatcggacactccatcgatcgaacgaagcaccgggatgcggtggatcgccgaacgcacgtcagcgagcaccactccggagccggtggacgcgtcctcggtgaatcctggctcatcatcggaaagagagttcttcagatcatggaaattgacgagtctggaatccggaaaggtgaaatccctgcaggcgcagacgatacgcccatcacggattcccaacaccgtttcatggaccggaatgccaagcgccccgtacacatgggatcccaaccattcggacaatggcgcggtcgtatacgacgggacgctgccgtgaaggttcctggtcgtgccggggaacttcaccagccagtcgctatccctccagacgagtcctatcttccgtccggcgtttcctccatagaattgcccggaagtctcgcatgattcaaaatcgtggatgtcgatcataaggttcattctaacggaactggctttcgagggaacgagccggccggactggaaccagattcatggcccgcacgccggttctccttattcaagccggcggattccgtcgtttctttcactcctgcggtccggcgctttcgcgcacctgttccatcagatcctccaacgtgaccgtgatggactcggccccgctcgcatcatccgtggcctgttcagccaaagccaacgtgtccgcgagacgcgtccgcaggtacgggaccttcaactccatgctttcggtccgttcaagcagactccgcgccgcatcgatatccttggccaaccggtccatgttctcctcgtccgcacgtttcgcagcacgccgatcatacacgcgggcgaacgcgtccacccggctcgactgtctcccgtaagcgcgcgccgcatcacgagccttgtccgcatgcttttcgagctgatcgttcttctggctcgcgtcacagtcgatggacacggttgcggcgacacgtcgcaacgaatcatattcacgtttctgccgtgcggtcaacgactgcggatcgacgttcctgaacttgacacccacacgatcgctcaaccgtacacgcgcctcgctcatttgcgagaccgcgtcctcgcaatccgagacgagctggtcgtggcgcacgctcaaccgtgattccgtgatgaccatgccgatgcccgcgaccgcgatgacgagcgtgcatgcggtgaggacggccacgcccttccctgacatgcgcgacgggttgacgtgaggcgtctcactgccgtcatcccagccgatatcgtccggatcgtcgtcacgtggcgtggagaacggattccaatccgggtccacgccatgcgaccgtatgccgtcgtaaccgtcgtcgtcaaccatgggaaacctcctgaagaaaaaatgagaaggccgcccgccggacttcccgtcgagaagatagacaaaaagaaacgggacagaaaacggtccggcggacggctcccgtcgaatgtcggatgggaaggggtagaacccatccggacgggaccgctcaccagccttgaagcgtaggccggacgggaacgccggacgctccctcaaggggaggagggagaagcccggacgtttccgtcaaccatcccacatgacggccgaccgataacagccgatacgggtttctaatccaacacgtcggcggccatgtccaacaacgttcggttcctatgggaatcgtccttcgccatgagactgtccaggaaaccggtatccaagaccagtttcagatcaggttcgaaccggacgtcacccaagcatacggacagccgataggtttccacgcaatgctcgccgcgcatgacaggactctgatcgtggataaggaaagacaaatcgacgaaaccatggccctccgctctatcgacacggacataaccatccatcctggtcggagtgaaacgaatgcttttgatccgcagctttttcagataacagtgcaatgggccatctaccagcaagtaccgtcccaccaggttctgggcgggcgcggcgtagaaaagcatgaacgactggttgaaataggaggcgcgataataccgccatccctcatcggcacgccacatggacagcagttcccgagcgtatccacgtcccacatgcaggcccgtggtcttctcccagatgtaaacataccggtcgaattggtcgcgcatcagagcgtacagttcccgtccggccttatccgtcggagtccggcgcgtgttaccgggatccgaatggttcctggacagcggacagaacatgtacgcggtctcgtcatagtccgcgactccaggaaccgacgccgagtaatgccggccgtacggattggccgaccggcttccgtcagtccttttgaacaggttgcagatcaggatcggattgccgcacgccggacataccgcgaaatacgagggatgtccgccccgcatctgcacgaacggtgctttccggttcgtttcccgccgataattttcttccgtcaacggcacaacgcgtcctcttcgacctgttctgaaaacatccatggcgaacctccactaaccggaaccgatatcggttccaatcgtaggacgattcgcctatcatcggtcaggaccaaactcactggtacctcctgctgacttttatccaccattccgtcgagaggggtggcaccgcgccctcatgttcggcgaacgcgagcatggaaagcaccgtggtcagtcccatgccgaactcacggccaccctgccgcagaaggaacacgtaatcctccgtgcagtcgtcgcaatccatatggtcgatgatcgccttgcgcgccagacgcgcacgctccaccttgtcgatatcctccgccacgcttcagctccttactatcattcactatgctttctcacatgcgtcactgaagagccgccgcgataaggatacgggtcccgaaacaagcccatccattaggacctccagcaggtctagcggacgcagaagcgcccgcatccatcgatcgtccatgtcgaccgtcccgatcagatgccgaggggaaggatggtcgtcaacgcggcacgctgctggcccttcatcggattcagtttcatatgccagttcttggccttgttctgcatgtcgcggtcgaacacgtcgagttcgggcaggctgggcgcgaacagggtgatgaatccctgatggtcggtgtccggccagttggcctcctgctccagctcgcgcagccgctgttccttctcctcgcggcgttcgtcacggcttttctcacgctggtcctggagtttgctgcgctggcgcatgctgctcttgcggttgcggagttccgcttcggactgttccatcgtcaaaggccgccagatatggcagaacgccatcatgcgtcgttccgtgaccagttcacggatccaaccggcctccacgtcgaagtcgggccactggtagatccagaacgaacgtgccacgcacgagtccaaggtgatgtagtcgtgctccttggcctcctccacccaggtgacggtcggatcgtccctgttgaccggcggacggtcggccgcatgctccgggtccgcgacggtgcggatcagataccgcaggtcgtccacggaacaccagtggatcgtgttccggcgggcgccgcagtccagcagggacggggcgacggtcatccggatcaggtcgcccatggcgatgccgaccgcggcccgttccgtccggtccttcctcacgacgtgcggcagacggtccgcgttcacggacacgctgatgtagttcatgttctgcaatggagtgaggatgtccggaagatgccacaggttcgccagatcctcacgcgcccactgcggggtcttgtccgattccaggtattcgggttccgggggagtgtggccgggaagcacgaagcttgtctccttcaattcgacgaaaccgtccgtttcggacagttccttgagcatcgtgttcaacgccatcgcacggccggctttctgccggtcggaggaaagaacccattcctccacgttcgcggtcaatacggcagtggcctgccgtttgtccggatcccacaggtagcaggctccctggaacggggtgcccacgacctccacgccgtcgccttcgatggtctgggcacggtcctcgacgtgcccgtacaatcccagcacgcccaacgggcggccggacgcgagcggcgagtacgcccaacggttcgtgccgtccttcagccggccacgccaatgcgtccagatccatgtccatgacacgaggctcaatccctggattcgtgggatgccgtaggcgaggacgagcgcgcccaatatcatgatcggcacgttcaggcccatggccgctccggccacgaggatggcgaggccgatgacgcagacgatcagctgggccttgtcgaggccgaggaccacgcgtgtggcggacagtcggctgaacgacgcggaggggaccctgctccggccggtattggattcgttatcggacatggaaacctccatcggattatcggttgtcggaaaaacaatggagggaacccgcctggggtcgggcccaggatggtgggttccctccggtattacggccacacggccgcgtgtcgataacgaatggcgtcagccgacggtcggaccggacggggagccgttgacgccctggtacgggttcgaaccgccggacgagccgcccatgccgccgtttccgccacggccaccggagcctccctggccaccggtgccaccggtaccgccttggcctccttgtccgccgtccgagccctggccgccctggccaccgtccgcaccctggcctccctggcctccttcggcgtacgcgctaccgccctggccaccggccggtccaggagcgcctggaacgccgggtgctcccggcgcgcttggcgtgttgggaacggaaacgtccggcgtgggttgcggtgcgggagggacggaggataggccggaaccggtctcgttcccatccgttttcgccgcggcgtccatgacctggctcgaaccggaacggtccattccatccgtcgccgatggtgggagcggaggcgcgtcgtttggacgggaagcggcgtccatgacctggctcgaaccggaatggtccgcgccgtccggctggacgtccggcgtggactgggttttccgcgcgtcatcgccaacaccgccgttcgacgtgtagtcgccgtccgcgccgccggcctgcccgtccttgggcagcaggtccttgatgccggaggcgaggcccgggatcgacgatcccacggcggccggattgccctgagcggctcccagcacggctcccgcacccgaattcacgaccttgccaagacctccggtggcgccgccggtcgcggcctgcacgacaccggccgtgacctgcaccgcggccttgatcgcgttcggaccgatcttgccgccacgctcctgcatgtcggcggtaacgttctcgccgatgaagctcacggcaggcatgatgagcttcggactgaagcacgccaggatgatcgtggcgatgcccatcagcgcggggaagaacgattccgcgtagttcggattgttcttcgacacgaagcagatgccggaacccaccatgatgaccagggcgctcaacggtgcggacaggagcacgccgaccacggcctgcgcccatttcgccgcggcgggacgcgtgactttccaaccggtcatcatgaccggcagcggcgccacgcaggccagcaggatcaggctgatgtcgcgtgcggcgagcatgcccgccagggcgaggaccgcgaggaaaagcacgaagtccacgacgcagcggatgatcagatcgtatccgccggtggtcttgacgatcgtgccgatgaggttcgacacgatgctgtcgccgaacgggtcggatgtgccggcaccgttcaacgggacggtgaggatcctgtgcgtgatctgtccgacgatgccgtccatggtgatcatcacgctgatgcacaccgcggtcaacggccatgcgagcacggccatcgcgaagcttttgatcacgtcggcgacgctgcctttggccgcggcctgcaaggcgccgatgacgcataacgccatgttcacgaatcccatgatccagccgatacggttcgccgcggtgatggcgacgttccattcgtcgttggacatgctgcccaccaggccgctgaaggcgcccgtcaacagttgggagcacaggttgtccaacggtttgaacagccagtcgataaggttcgcgaagacggtctggatgatgagtgacatccggcctccttcaaaaaaggaaatgccgtggacgggactggcccggccacggcgtgaataggggtgtgtcaggcgggagccgtcagaacagcgcctgcgtcgcgaagaacttcacgatcgccatggcgctgcccaggatcatcgtcgccagggcacaccagatgaacaccgtgccggaatactgctgcatcggaccggaatggatcacacggccggcgatccaggcgatcgccgcgcagatccacgctccgacggcgatgtacaggctcaacgcccacaaacctccgaccatgtcggacaccaactccatgaacgggaagaacgtgaagttcggactcaccttcaggttcgagatgtcaccgttgttcaggccggtggcgacggacacgattgttgccgcggcgggcgccgcgagattgtgtaacatgatgcacactcctttcagaagattccacgcggccggacggcccggccacgccgataatcggcagggggattatttgcttccggtcaaccatttccataggccggtcgcgccgtccttgatgccctggccggccttctggaatatgttgcccttgccgtcaccgccggaaacccagttccaacccttcaaagcgtcgtcgacggcgcctttcacggtggtcttgaccgtgtcggagataccggacacgatgtcgtcgcccaactgtttgaccagtccggtcagactgtcgtcgcccttgcctcgaccgtccttcaggttggttttcccactgccggacgcctgcgtgtaggaacggttcacgcccaacccgttggagccgaacacgttgcagctccaaccccatccgctcacggcggctccgatcacgaacgggacgagcatggcggcgagcaggcgtttccaactgaacgcgcgttccatctggttgttggacaccagtcccggaatgaggctgacgcagccgatgatgatcacgcccacgcacaatacgagcgcgacggcgatcacgccgccggccatgtcccggacgccggacacatcccaggccgggtcgggtttcaaacccttcaacgcgttgtccgcgaggttcaatgcttccatttccgtttccttccattcgaggtccatcagtaccagccggtcgcttcggaatgggcccaagcgccgcaaggcgactggtagcgttgttggatgtaacccaatccccatttgacctgcgtggccgcgttcgtcttccaatcctgtcccgcggacgccatcttgctgccgggcagtgattgggggatgccgtacgcgccggaggacggattcgtcgcgttccactgccaaccggattcgcgtgtccagagcttgtccagacagtcgaattggctatcatcccaaccgaagtccttgagcttgcgtcgggccatcttcttcgcgtccgcggccgatgccttgtccccggacacgtcggatgtggagtcgtcgcccgtcacgcactgttccgtgccagacgagccggacgcgcccatgcccgtgagcttgtcgttcggcagcacgtacgtgccaccattcctgatcggcatggtccgtgaatacactttgtagccggcgcccttctcactggtggtgatggtgcccttcgcggtgtccacgctttcgacgatgccgacatggccgtacgtgggatccgaatcctgcacgccggcgggccagctgatgatcgaacccgcgaccggcgcgtccgtcgtggtcttgtagccggccgctgtggcggacctggcccaatcctgcccgttgccccaatattggcctatgttcttccagccgagtttcttcgcccgcatgcacgtccaccacgtgcattggccgtacgcgtacgcgacgcagaggttgttcggcccctgctgcccgttgaaccaagcctcggcgtccttctcgctcatgccgaccacgttcgtggaaccggtgctgccggacacggcctgcgcggatgattggccgccatggggatcgttcacgttcatggagcccttgtaccggtagtaggccgcgtagccggccgcgtacgagtcgatgctgatctcgtcgccggtctggtctccgggcttgggaccttcaataccattgttctcgtcgtggtgcgcgcccacgaacctgccgtcgccgatgtagatctccgtgtggctggaactccatacgatgtcgccggtctgcaggtcggacacgcgtgaccagtcgtgtcgttcgaatcccgcgtgcttcagggccgcgtcctcaccgtaggtggagaaggggtacgagcccacgtccaggccggcctgtttcaacgcgtagtagaccaggctggagcaatcgtagtccgggttgccggtacgacgcggctgactgtagccgtgggaatcgtccgcggcgatgttcttggcccattcgacccatgaggtcgttgttccggccgcgttggacaatccacagttcgtgccgtactgcgattggaccatggcgacgaggatggtgctgaggctcatgagcatgacgagcggcacgatgacgatcatcggcacggccagaccgaacacggtggcgcctttcaccagaccatgcccgccgttcccggtcctctccgccataggctcctcccatcatcggcacgcttattgcaatccattccacgcggatgcgggggagaacgacgccgataatcagcgagggggagtggacgggagccatggagaagcaaaaccgactcgacgaggaccggtcaagaagatagtatcgtccattacaggccagacggaaaggtgagtgaactatgagcatcgagatgcgcccgttatctggaacacgcccgttgtacgtggacgagccggaaccgttctggccggcgggagacgacccggacctctacaagctggaactctggagactccacaaagtgggattggtccaaggcctgcgcagcgtgccctgctggaagtgcggatacttggtcatccaaagcggactgttcctggaactcgagggacgggacggataccattgccgcgtcgtatcctggagcgacgcccacaacgccggtatactctcgcaaccattcctgcgcacgctttccgactgctggcgtgtacgcccgacgtattccaagtcggcggggtacgcatatctgggcataacctgcccgaaatgcggcagtctccaaggagacaatttcgtctacgacaactatcagggccggggaggcgtgttcagcgatcctgaagacaagtccccgctagaggtactgcccttgccggtgttcaccgatgattggccgcaaagattccattgggcgttcgactcgttcagcctcgatctggaaccatggaggatcaggttcggcaaaccggtcgcgatatggggcaacgcctggccatggagcgaatgagaccacgcaagactatgacggccgacgcggcaagctcgcggcggggaatatcagttgcggaataattccgcaactgatattctgcctccgtgccaggaaatggtgcctcgcttattcgatcagggaatcgaagccgttcgtccgcagggactcatcggccaatgatgtttgctccattgcggagatcattcccttcccggcatcgatgataggagagacctgttcccatgaatccggtacgggcacgggcagaccccagatgtgccttggttggagatgctgctgcaccgagccgaactcgtcgagtttcatgagattcatcgccgtggacgacatcaggaacgccaggagatacgccctcatattctcgtcgggaacgcggacgcgtaccaggtcgtcgctgatgacgtacttgtccgcgagtatccgcgtggcgtaggtgactttgccgatcgtgccggaacgggagatgaggatgtcccccttctgcacgcgcagcattctgacgcattccttctgtttgtcggtggcgcgcgacatgtcaaaccatttgacggtcattcgtcgctgctccaacgctccgttggcggtgagatacggtgtcagattcgtcgtgtcgcttgggtcttcgacgacgaggcttcgtgagctccatcgtggccccatgtagatgcggatgttcttgtcgagttggccgatggtggtgaccgaccaatcgggtttgtcgtcgaatttgctgactttttccaacgtcgcgttcaattcgggtgaataatgctgcgggttgaggttgagattgtcgtccaattcgccgcgttccgcggtgaaacaggtttcggattcggtgaacgttccgatgtctctgaatgtcttgtatgcttccgcgatctgggtcaggtcctcatccagctcgctggtggcggagcctttttcgtcaagtgcgaacactggttcgcccttcgaatccttgccgacccttctggattgggccatgaagatggtgtagtcgccgggtaccggatcgtcttccaaaggtttggagaggaaaaggacgcatgttcgaacgcctgtgtcgggttcgaaagtgttcttgtgcagcgtgaccaccgcatccaccttgcatcgcgacagcatccacctgcggtagttgatgtaggtgcggttgtccaggattcctttcggaaggacgatgccgatgcgaccgcccggcttgagccaatcgatgcagcgttcgaggaacaggagctccggcgcctgacggatcaatagggtgccgtggccggcatcccgatcatcatcgtccgtgatcgtggggaacgtgccttccggatcgggtctgtgtccgaaaccgaataatttgaggatgtccggatccatcatcatggattcggttttttgcccggagaacggaggattggtgatgatgatgtccggcgtgccttttggacagtggctggttatccacccgtccagattggaatacttgtcgagtgagtttccctgggtcatgccggtgttgccgtccccggtcagaagcatcgccgttttggcgatcttcacgagtcttttcgagatctcgaccaggaacaccgaattcttgcataagccgagccgtctttcccgttgtgggctgcccggtttggtgccgtcgatggctttgcgccgcttgtatctgaacgcggcggtggcgaaaccgccgctgccgccggcggggtccagcactttgtcggctatgtcggggtcgagcatatcgaccatcgctttgaccacgagccggttcgtgaagaactgtccctgctggcgtttgagtgtgacatgggtgaactgctcgtatgccgcgcccatcagatcccagtcgtccgcatcgtcctccctgctgacgaacgaatagtcctggagcacggaagccgcttcgacgagggtggagtcgccgacggcgatgtcctcgtccttgtcgaagaccgtgggatactgttccgcgtactcatggaacaggctacggatggttttcgccacggcggcccgcccgtcttcggacttgtactgttccggagtgatccagaaatgggggtaggcggtgtcggaagtcaccgtctcgtcatagatcttggcgagaaggatacgcaccatgtccatggtaaggtcggaatccgcgttctccatgcccctgccgtaaagacggttatggcacatcgccaacagtctgcgcacattacggggtcgttccaactctcctatgcgcggagtcctcccatcctcccatccttgaccgcacctcggcagaccgggggtctcctcgaggacttgaatgccgtccttgttctctctccggtagaagaccgtgccgtcaccattcgtccagacgccaccattggcgctggtgttgaagatgtacgagaccagctgggcgtatccgtcctccaccttgttccgtttgcattcgaccacgaagttgatcttgccctggtcacggttcaggcaggcggccttggacgcgtagacgacgatgtccgcgcgcaccgggttcccgtccttgtcccggagctccttcgacccatgttggatcggcacctccctccggatggtgttcgccggataatggtactcgttgatcagggtctcgatgaaacgctgcctgactttttcctcgggagtgcttttaagacaccccccccaagaatatccacgatgtcgccgttctcatcgaaacgaaccttgaatcccgtgttcgacatgcatcagcctccttgtgtccgatggctacagtgtacaatgacgccgccgtttccaacggttcacgacgggaaatatccgacaggacgaggcatggccgtggataacatgcccgaagtaaaagagaagccggcactccaataaaaatatcaggtgggacataatgtcccacctgatattctgtttcaaaaccaatcgtcccggcgcctggaggattggcggatggggactcaggcggcgaacccgcaatggagaatatcaggtgccgcattatgcggcacctgatatttcgtctccatgatgaagggcttttccgaaacggccggccgcaggccgaaagcgggaccgtccggaacggccgggaggatcagccgcgcttggcgtgttcgaggtgcgattccggaatgacggacacacaacagaaaatatcagttgcaacataatgttgcaactgatattttgctccgttcttaatgggcgcgggcaagggaaaacccggtctcattttaggagagggttttcgctcgtcttcaagcgtttgagtgtgggggatggaggcccgtatgccgggtggagcggcaagctcacgacgggaaatatcagttgccgcataatgcggcaactgatattccgaaccatagtaggcggcggaacggctcttcggaatctttgaccgaaagggaagcattacgttcgggatggtccgctgtacggaaccgttcatcgtttctggttggggcgagggtattcgagtcgtgtttcgggggagaaccggtagtggattccgccctcgaattccgcatcgaccgtgacgcttctcgaaccatcctggttcaaccggcctgtgatggtgaaccgttcgaggacaccccagccgatgaattccttgccaagatgcttctcgctgagttttcccgcctcgatggaatacggttttggatggttccgttcggcgatctccggtttgcagacgccgcacgtgcggtatcgcaggccgctggccagcaggcttgatcgggtcacgtacaccgcttggaacctttggatgtcgaacaggagcgtacgttcgtaaatctgatcgccctggccgtcggttccgactggctcgtaatcccaccgggggtattcatcccggatatcctgttcgacctggtgtctgatggtccggcagtccggcatgtggaccatggccaggcctccctcgcgtcgttgattgacgacgtacacgggttcttcgtattgcgtttcgctcatttgcgggttcttctcccttcggttttggcttgtttcccattatgaagccgtttccgctctcctgggacggatcgtctcacgcggcggtttcgatgccttcgagccggttgagctcgtcggcgtgccgcatgcacgccatctgccattcggatggcttgccgtagcgcaggcttccctcatggtcgtattcgtcctcgtgcggccgcatgtcggccaggacatgctcgcagaccagcgaatgcacgtgacgttccgaatgacgttccggcaccggggtcggctgggccacgggcctacggtcacgctcatgggcttcggcgtcccgttcgcgttggcgttcgatctgggcgacggtccagtcgttggcgatctggtcccagttgtcggcgaggcggcgcgcggaatcgacacggcggagccagaacgtgttcgcgggcagccagtcgatgaccgcgaggataagcgccaacgaggccgcacggtcgccgtcatgggctttgacgacccggctgacgaggtttccaatcttggacaaatcacgtttggtcggttccgtggtggtcaacgacagcttcgagcggacggaagcgagatggtccatcacggtcgccgcgtcggaatcccctcccgtcgtcgtgttgtttccgtcctccatgccggggagctctcccgtagggagagaggggttaatggtttgtattaatctattgggtgcaccgcatgcaccccgcggggtgcatgcggtgcacctcctacccttgtttttagaggtgcatgtggtgcaccccgcctttttaatgtccttcgaatcggcctcggattggctttccgaagcggtttcggccgtttcttcttgcggtttcgggtgtttgcgttcgcgttctcgtactttgcgttcacgttcctccccacgcagtctttccctaacatcctcggcacgttcgactccgttgaattcttcgaccggcatgttcagtctcaggtcccagaccttcgatctgcgtccacgtggcacggtgccgccattcttgccaagggccgcgtgacgttggtcacccggcatgatcaggcccttatcctgcagttccctcaacgccttgcgcacggcgcgttcgctcagttcggtagcgacctgaatgttcaggacgcttggccaggtgcaggtaccatcctcgtgcgcgaattgcgcaagatagatgagcacggctttctgcggtgcggaaccgagactcaaaccgtatgcccacgacaaagcctggaaactcatctttgcccctttccaagaaagaaccgaatcatgtcattcatcgcccggttcgtggatgaaatgcctacttgttgtgttccgatgcgttgagacgccatgccttccaagggccttcctcgccacgttcacgctccaacgcgcctatatgccatttgaccggttcgctgtcggccgcgagcggcgtgatgaaaccctgcttttccaaacggtccaggatcgcgtcgagttccgccggcgtcatgtcgcacgcggtccctctcaacgcgcgcacgcccacgacggcgatgtcctcccgaggcgtctggaacgtgctgttggcaagactgacgagaacaagcttctcggccggagtgtccggcttggcctgccatgcccatttgaagacgctgatcattgtctgctcctttgtcggttgtggtgttcgttctgttttgaaagtctgtcgagggggcgccggacacgcgtcggcggcgccgttgccgttcggcgcgcatggccggcatgtcgccggcatggcggagaaagaagaaaagaccatgccggcatccatctccacgtcaccggggtccggtaacggccgatggacgatcatttcctgtacttatcgacgaccgcgagaatgtacgggtagtcgtcgatgctcggaccgaggccatgatgatggttctccaggaaacgacggatgtcgttgcggagagcgtcggagccacgcgtcgcggtaaggcattgacggatcagcatctcccaagccatgcgcttgcatcgagtcgtcacgtcctggcgcaggccctccatgtcggccgcgtacttgtcgctttccaggtccaacggctgggtgccgccggtcaaccattcctgataactggacttgtctcccgccggcgcggacaggacggtcgaatcgggatcgccgaacacgtcggcttcctcgcagagtcggtcggcaagggccgcgttgttctcgttgcggatccttcttctcgcttcggtggcgtccaaagcctcgcgttgcggcgtcgtgtccttccgcttcctgcggcgtagcggcgcgtgggtcatgccgctacggtatttgggccgctcagtacgcatccactcgcccaaccggttgccgatcagcgtgttcacgaacgcgcccaatggtttgcgttcctcataggaggcccacctgcgcaggcctcccttgagcagttccacggccacgtcgcacataatctcgtcaacggcccacgcgtatccccattcggagagtctgcgggcgacacgtcgacggttctcgtccaacgcgtcctccacttcccgcggggtcacgccgtaccgcgtgtggaagtccttgttgctcatgctgtggtgttccatggcttagaacctttccgaatgctctcttctgatgcgggcgagataccttttcgcggtgctgccgctcgcggccagtcccgcgtccactgccttcgacgcggtcggattctcgcctttagccgtaagctcgtcgatccatgcgagccacgcctcgtcatcggctccggccttgccgcgccggccggttttccctggcttcggcttttcctccgcctgggcgtcgtcggtcttctcttccggcccgtcggccggttccacggccgtcacgtccggtcccacgggttcgggagccggctcgtcctggccgtccacggtcggggcatcccgctcatcgggttggatggtgagggtcgggatgatgactggttcacgcatcaccggctgcgggatggcgtgctgttcgacggtcggggttgaggcgtcggcggctggcgcttcggcctcatcggcttttggggccgcatcgtcctccatggcgggaacgatggtctggaagtcgaacaggtccggaatctccggcttcgccggttcagccggttcgggagccgatgccggcggttcggacgggatggccggggccggcatggcggatggtgcgggaacgggagccggaacgtcagtgtcttccatgacggtcaagccgacgggaaggacggtgttgatcttgtcgagacggtctcccgcgatgatgacgatcaaatgggtcgcgtacaggagtgcgaccgggggaatgctcatgatgaccggcggcacccaggccggcaggtggaatccggtgttgagcatcgcatgcaaagcgttgccggcgatggagaagctgctgaacagtacgagtccgacccacggataggcgctgcctcggatgtggcccttcttgaatccccacgtggcccaggtgcacaggaggatcgtgccgtccacgcacaccgggccaccccagctcaggtacgtgttgatgccgcatgccacgaacacgagacgcagggcgtcgaagctcaacacgaacgcgatcagaccgatgatgatgccggccgtgatgccgggccacattttgacgcttgacctttcggcccgcgcttcctcgtctttggtgtatttcatgattcagtcttttctctctgccggtccacgaccggcgatgatggttggttcagtggcgggggagcggacccataccccttgggatccgcccgtccgatcccggtcgcatgtcaggcggtgatttcctggcagacgatggcgagttcggtgcatccgtcgatgaaacgcgaccagtcgttgtcggtgtcatcaagttccgcgtccgccccgtcgaagacgttgtcgacgtcgatgttcagcaggcgcagcatcttacacatgtcgctgatgatgccgaagatgttcgcgccgccacgggagacgatctcgctcaccgtggagcctcccggctgccacttgtcggattccagcagatgcaccatctcgttgatggcgccgcgggcgtccgacgactggctgacgaacgagtcgatgtaggagcggatgtcggtctcgcggttgcccatgtcgaggtccaacggctggtcgtcgtcggcgttgtcgaaatcggtgttgtcgatcttggcgggttcgagtccttcgctcatgcgacgcatcctgtccttgcggagcgtgtcggacacggtggactgggatacgtcgagcatgtcggcgatgtcggtctgcttgttgccggcatcggagagttccacgatcttcttgcggcgttcctcactcgacatgctgcccgcatccacatgctggcgtttgcccgccgcgtcacgcactctaccttccgcgggagcgataccggcttgacctctgacacggttaacagtcgtgtgactgacaccgagcagagcggcgatgccacggttggtgatcttgcccggagtgaacccagtgatcaggtcagtgcgctgctgaccagtaacccgaatcttctccgcggcgaagttgtcggcgcagtatgcgatccaacccttcatgcccccgtcatagccgagagcgacccagatatggccgtcaaaagccttttccaccgcgtgcaccaaatcgtattgggcttcggcggcatgcagaatcttgactttgatgtcttcggtggcctgacgagcctcctgctcggtgtaattggtctcacccggagcaagaggatgcgctgtcagctcatcatcttggaagtttccggcgagagcggcaaccgggttggtctcgaccaggtcggcatcatctatgtcgtccacaatttcgggggtgacggtcggcgtgttttcctggtatcgggtttcattcggtgtggtggatgtggaataatcagacattgagctggtcctttcctcagagttggaattgattgcatctgcgtaggtttcgttgaaatcgctcattgtgatctcttctttctgcgattggttccttggctggtgaccgtggaaccttggttaattgggaaatgctggatgggattgactcgccgcccgtatgtgagctgcaactcatgtgcgggcattactatttgagcgatatcggcccatcgccaagtggttggtataggaacccgacgaaaagattggaatggctatgacaggagatgactcccttgcattggattccatcacgtcggactacagattcatgttggagcatgacgtctccatgttggagattgctcttgcggctgtgtccttcgaagattgcagtcttgatgacgccgttccattggatcgggtctccgtggcgtacgattgctggcttgaagcgttggaagcgcttcatcctggccatcgtttccgcgaattcagtctttcggatgcggagcttgcggacgacggtctgcttgaacgtctgctgttgactgttttgttcgatggtggttcttgccggttcatacgttccgtggttgccgtggtgaatggctaccgggcccaccgcggttgacggtgcgtattgccggtggtgttttatctcttttctgttattggtttgggaaatgctggatgggtttcatccgccgcccggatgcgaactgcaattcgtccacggactctaaatgttttacacaggtgtcatagcttcctctctcatacgcatgtcggtaagcccatacaaataatctgtagagactccgaatatcactgccgtcttccaaatgtcattcgcagtgaacttcaccgtgcccgacaacttcccagaaattgccggctgtgaaagatgcagcatctttgcataacgttcctgagacattttggtttccgccaaaagcccagcaacccttctcgctgtgataagtttatcagggtttttataaatcatatttatgagtataagccatgcttatattttttcaaatatggcgtgtcataataaatatatggccaagcattcaataaagacagaagcatctgaacgactacaagaaatagtcaccaagaacatcagggttcgacttgccctttataacgtcaagcaaaccactcttgctgaagcgctattacaaacgcaagcgggcttgagtgccaaaataaaccggaaatcagagtggacagttgctgacatagcgaatgcagccgcattcttccatgaaccagtagagaatttaataacttcttctaccttggatgcaatcagtggcggctcggaatatcaggtggaacataatgttccagttgatatttcccgtcgtgagcttgctgctccggccggtgtgcgttacctgcgtaagccggacgagaatgagggaaggtcacatggcgcaatcggaccgcgcgcgttcgtcatgccgttgatggatgtggatcaaatgaatttgggtccccgcttctccgcgaggacccgttttgagctcccccactgatgtggaataaaggtgtttcgtatctgatttcttgattttgggtggatgtcgcgttctgtttgtttgagtccttctatggtcgtcgcgtctgcaccactctctctagtgcagtgaaaactgagttgtgtagacgctaagtctcatttccaattaccgaatctgtagttcttcggttcgacggtcgggatgcggttcactttcggagagccgtttcatgtctgagctccgcggctattctttcgggactgaacctagaataagaggtccattccccacggggctggatgtgaaaaagccgccggcgattaacgatttaccggagccattgtgcctagatatttccaaatactccggatgctcagccaagcatctctccagatcggtaatcgtgcagacgacagtgtcaggccatgccgatgcaggaactttatctttcctgaaatcactgatagtacggtctctacgaccgaaaacgagctttccgtcattggtttttgccagcaatgaaagctcgccagtactggactgatttcttttcatgtctcctgcaacataaatacaagccttgtcttcaacgtcatttagctttgttagcaattcatttgcggtcaatcttgcttcgtcctgggtgtgctcttcagcatatcgggacaggcaattagtccctgttgtttctgaaatctcttgccatttcactaatctgttaaaccgttctcgcttttgttcgtccatgaaagcatcaacaacgtgaagggagcatttgttcggaacacaagcattccggatgagctcattaaccacataatcggtctccggcattgagtagcccatgatggtcaggctttccgcttgctccaatgcgtcgtatgccgaacgccaaagcagacggtcaaacccgtttccgtagaatgacgctttgttgctggacgggggaatgaggaatcggtccattcccgtcacagccagcttttcgttttccctcgcgtcaagcttgttctgagaaactgtttcgtcatattctctttcttcccgaattcgtttcaagatcacttcgccgtcattgccgtagctgtaccagtttagggaaccgtgcggcttgatgatctgcatgctattcctgcatgggaggttttcggagaaatcaatccaccttgtcatggacgcggcctcgggtcgtggatacactacctcatcgcttacgatctgtttagctcgagccccaatgctccacagcaatgctggacgctccgtgttgatcgccatttccaacaacgtgtcatagttgaacgtaattatgattgcgcgctcatatgcccatagattcaccagttgtcggagccagagtgggcattcctgcttacagcttttcactacgtcatcgtctagaacactgccgatggcgtcgatcatctccatcgcttccgctcggcgacgcatgttctcatggtcaggcagaaacggcatatcctgagtgcgcatggacagccactgctcaaaggattcgccctccctgaacgaaatactttcacgggaagccttgggcagcaggttcaaagcttgctgcccaagagcgttcagcagtggcatttcgtcacagattgccttggagaatcctgcgcccagaatataaacaggacggtggtcggttatgtcttcttcacctgcagtcatgccatagattttatagtaaacagccacttaaggtcgcgtactgcagttccctccatatccgtcatatatcggcgaagatgccagcaaatcgagctgtactatgtcgccgcttaatttgggacggtgcgcatctgtcgtcaacgaggcctgcgattctgtcgatggctgtaggccggctttggggcaggtctttccgaatggatagaatcccctatgagggggatgttggaaagagaagaaaaacgaaggagagatgattatgggctcaaagaccacggcctcccataaggccgtcccgccgacccgaatttcaaatgggggggcgtaattccagcatagaactattgcgcatcgtcgcaatgttcatgattctcgcccaccatttcgtcgtccacaacggctatgacgtcaagaatcttccgctgggtcctgaaaggatcttcttccagcttgtcatgcagggcggcggcaaagtgggcgtcgtcatcttcttcaccatctccgcatggttcttcctcgacaaggaacagaccatcaaatcgaacctcaagcgcatatggattttggaacgcgaagtgctgttctggagccttgcgctcatggcattctttctggttttcgaccgtgctgacttcggtatgaaaatgatcgttcgcagcgtcgctccgaccatcatgggattatggtggtacgtcactgcatacgccaccttcctcgccttgctgccattcctttccaaggggctacgcgcgctcggcgaacatatgcattacgcgcttgccataacagtgctggcgatctggggactgacaagcttcattcccggaacttctggagtgaacgatagcgtgttcggcttcatctacctattcatcctcatctccgcgtacaagtggtacatgaagccgttcacgctcaaacagacttggctgatgaccggaaccggactggggttcttcctcttgtacacatgcgcttccgttatgttatcgttgttcggaatcgataagggcaatcttcatcaccggaccgttcaagctgcccgtcatcatggtgggcttcggcatgtttctgctgttcgaccggctttccttccgtagccggctcatcaaccgcatagctcagtctgcgttcgccgtgtacctgatcaccgaccatcccgccacgagaacgctactctggaaacatctgttcgtactggaagacctctgccgacaacccttcgcgatcctgcagattctcggcatcctgctgataatctaccttgcctgcaccctgatcgacttcgtacgccagggactgtttgctctgacggtcgaccgcaaccgcggccattggttcgaactggtctggagcaagaccgtggaatggattgaatggggcaagcataagcagagtaacgcaagggcataatccgtaagcgaatggcgataacgcccgtcttcttgcgcagattcggttgtgagttccgatgaaaaggacatggcccggctttggtacgattttcagtcgcttacacatgaaaaccgcgattggaaagaaggccggaagccatgtccgataaaatcatacagttcgacgacgccatgttcgagtccaagctcgatgctttggtccgagtcaaggtcgagcagaccatcaacgccatgctcgacgccgaggccgacgagatcgccaacgccgccagatacgagcgcaagaccgaccggagggcgttccgcgccggccactacgagcgcacgctgaccgccaaggccggcaagttgagtctcaaggtgcccaaactgaagggcgccctgttcgagtcggcggtgatcgaacgttaccggaggcgcgaatccagcgtcgaggaggcgctgatggagatgtacctcgcgggcgtgagcacacgcagggtggacgacatcagccagctgctgtggggcgagcggatgccatcccagacattgagcgacaaactcaagaagatctacaaggagatcgacgagtggcggaaacgcccgttggaatccgagtacccgtacgtgttcgtggacggcgtgtggcacaagcgatcctggggcgggcacgtggagaacgtgagcgtcctcgtcgccatcggcgtcagcacggagggccggcgcgaggtcatcgcggtcgacgagggcatgcgcgaggacgcggccagctgggagcagttcttccgaagcatgatcgaacgcgggttgaggggcgtcagactggtggtcggcgaccggtgcgccggactcgtctccacggtcaactcgatgctgccgaacgcgaaataccagcggtgcatggtgcgcttcatgcgcaacgtgctctccaagacgccgcccagtcacagggaatgggcgtccgccgccctgaaggccatcttcgcgcgggaaaaccgcgaatccgccatggccaaggcagggacggtcgcgggcgaaatggaggaacgcaagctcaaggcggccgcgaactgcctccgcgagggcgtcggcgagaccaccgcctatctcctgccggagttccccgcgaaccatgggatcaagctgcgcacgaacaacatgatcgagcgattgaacaaggagatccgccggcgcacccgggtcgtgggcggcttccccgactccaacagcgcgctcatgctcgtatgcgccagaatccgctacgtcacctcacgctcgtggtcggaccggcgatacatggacatgtcccggctcgatgacaacgctaggcgtagcggcatgaaagtcacgccaacagctggccaacagccaatctgcgcaaagaagcgggcactacccgcctttgagcttgcgttcgtagtggccggccctgtatgccttccgctccccagtgcgctcgtatctggcggcgttggcgatctcgtccgcctcggcgtcgagcatcgcgttgacgatccgctcgaccttctctcgcaccatggtgtcgagcttggtctcgaacatggcctggtcgaactgtatgatttccttggacatggctccgtgcctctttccaatcgcggtttttcattgtctggcgactgaaaatcgtacccggcacggtccatgtccctttccatcaaggccgaaatccgaaaatgcgcaagaatccggacgttatccattgccttggtgctttctgtttacgtgcggcagtcttcgcgatgtatccccttctatatcgggataggagtcgtttcgatcgagacggcggcattttcgggactctcgattcctgttaccgataggggagacccggagcatcaaaatgcatgaaaagcggagcttggaatgcgttttccttgccatggtcacatggtttcgtctgtttcggcacgttctgtgctccgtaaatgtcacacgattccattttttggccgttttttggaatcgtgctacaccgcacacccccgtagtcgcgcgaaagtgtcgggaaagccggttcgggggtatgaaataggtgggaaaaccgcatttcggcaggaaaaatgttgcacgattcgaaatttgccccgaaaatcggaatcgtgcaacaaaattcgtcgtttccttccgtgggtcctcatctcttggcaggttcttgcggcatggtgtccgctgcaagcttggtgtttggacgatgaggcgagaggctcagtggcgggcgcagggcctgccgatcgcgatcgtggaggagatcgcgttcgagaacggttggatcacgcgcggccagctcatggagtctgccgagcgttacggcaagagcccgtacggccagcatctcaagggtatagccgacggcgagatcatgctcgtccccaaccaaaagagctgatccctcgagacggatgatgcgttaggggtgctgcctcattgaggcagcaccctgatgacactttgactgacggtgcttcttatggattgcgtcgatgagcggcacttcgacgaggagtgttttgactggagacgttccaatgggcggcgcttcgactggcggtgaagagggtcatctgccttatgagtggcggatttgggcggcgtgaaaatgtcatttcgcttatctgtggcaggtaatcggcagagatataccctttaactgtggaaaatgtacccccaaagtggcttttgcccgttatgacctgccatatataggcgaaatgggagtttccatctctcggaatctgccgcgtataagcgaaatgggagtttccatctcttgaaatctgccacatataagcgaaatggggagctgggcacatacattccgtcactttcagggcgtggcggaatgatgatgaaagcctgtaccggtcactaccaatgatttgaggaaattcttggggtatctatatctggcaaggcctaattatcgttgtatccgtgtttgcgggtgtccagtgcctgcttccaataggcttctcgggcgaggacgacgtttttgggcacggtggaatcgtaatgttccaaaagcgtgtaacggaaatgcgtctctacgtacgcttctcctgctgctccacaagtttgcttagttctgtattgccgccgtggccattatctatgtagtttttccaccgctgatatatgccgttccttccggtggcgattcccacatacagtttcccattatcggtattggttattatgtacacgccttgctggcgggacagcgtattcttccagcttgccttgtcgttctcccaaatcgccttaagttgggcgtaggaaaggctaacagcaggtgttggcggccttgttcacttggcacggtcggccggtggcactttttcttgcggtcagaaacagcccgcccaaaatcagccactgaatatgccaaatattgccaataagtctcgtgcgcgcacgatatcgacagggaatgttccttatttcacggcccatctgtttgagttcccaaaaatgtgttcaatgtatgaagggatgaggaatagttcgagggggaagattattgttggaaaggatattgtcaacgtgagatggggaagttcagtgacttctgtagagaacgctaatgtgcagcagcctaccgcaccgcaaggggtagttgaggaagcggatgacggcatcactctgatggatctgttcaaaatcattcgtaagcatctggtcaccgcgatcatcgcattcgtggtggtagtggcaggcgtgagcgcctataccttcctcgctccggcgaagtatacggctacggctcagaccatggctacttacaatgcttctcaaaatggtgtcgacattaaccagcagtccgctggtggcagctacatttccaaccaaatcacctcatatccgacgcttgccaccacttcgaaggtgctcaagccggtcatcgatgatctcggtctggacgaaaccgtgacggatctcgccggccaggtcaccgtcaccaatccgaccaacaccgcattcgtgaacattgccgtggtggatggagatccgaagcaggccgcggacatcgccaattccgttgccgaatcgctgaagaacgtcattgaaagcgacctgtactccggagataagtccccggtgaagctttccatcgtgcagaaggcacaggtcccgacgtctaagtcttcgccgaagactgccctgtatttggctgtcggtgtggtgctcggcatcatcatcggcgtgttcgccgcactcatcaaagacctcctcaacaccaaggttgaagagacttccgacgtgcgcggcatcgtccgagcatcctcccttggctccgttccgatggacgcttcgcttgatgataagcgtccggtgctggtgagccagcctaacggcgctattgccgaggaattccgccgtatccatacgaatatcgacttcctgcagaccgaccgcaccgaaggcgtgggccagctgcttgtcatcacgtctgcgcagccgtccgaaggcaagaccaccatggctatcaacactgcggtggcccttgctgaagatggtgcgaaagtactgcttatcgacgctgatcttcgccacccgtccgttgctcaccacttgggcattgaaggtgccgccggtctggcgcacgtgctgtccggacagatgggcccgaaggacgtggtgcagagctactggaagccgaacctgcacattctgcctggcggcaagaggccagcgaacgctggcgtgctgctgggctccgaaaccatgaagctcatggtggagcaggcgctcacccaatacgattacgtgattattgataccgccccgttgacggtgtccaacgatggcgcggtattcggccgttgggccaagggccttctgctggtggtcagccgcaacgtgtgcgagaagaagtccctgcaggaggcggccgacacgctcgccaccgcgcaggtgccggtgcttggcttcatcttcaatcgtgcagatccgaagaagaccaatacgcattccaattattactattactatgaggatggtgcgccgcgcagcagccatcgcgcgaaggggaagaagcggcactgatggttcccttctccatggaatgaggggtgtatggcaactgagaacgatgattcccggtctatgaacggtattctgtccaacatatctcgggatgtggtggacaccagctgggatattcctccgctgaccttccccaaattgcagcctactgattcggaagaagccgatggtgcggatggggcttcgcttgctgagccccgcaccatcgcttcctccgtacctgcgcaaacggaacagccggtttcggctgcgccaacaatcgcggatattcccagtatgccgctcgataccgtcgatttcgatgatgcggttgcaccagccgatgccgaggaaaccgccactttgccacccctcgtctcttcgacagatgaacaggacgtcgaagcaactcaggcctttgacacttcggatggcataacggacctagaggagctggccgcggaagatccggaacatgatccgctgaaaaccattccggtcgcaccgaaagagccgtctgcggacaagcgaaagattattgccattgtcgctgcgattgcggcagtggcggttgctattgccggtgtcatcgtggtacgcaatcgtatcaattcgaaagaacagcgtgcggcagtggtggtatgtgagaaggcgaaatccaaatactccaaagccaacgaaaaactgcaaaacgccatcgaacaggcaaccagtctgcagggcactgcggcaaaccaggtggcggatgccgccacaatcgaccaactcactcaggccgtgaccaaggcgcagaacctcaagacggtcggcggatgttcggtgttgctgtctgaaaccacactgcgtgcgcacgcccgtagcatgagcaagcagatcagcaatatcaaagaacaggccaaggccgttaccgcagcagccacagctgtggccgccagcaagcgagctttggaagtgaataagacgactgccgcattgcagaagaccattgccgacgcaaagacgttgcttgacggttctgcaggccaggttgcggacgagtcgacacgtgacgcgcttgccaaggcgattgacgctgcccagaaactccttgatggcaaaagcaccgatgttgcggccatgcagaacgcttcgaaggtgatttcctcgacttctgacggcgtgaacaagtctgtggcggagcaaactgcggctaatgcccagtcgaataccaattcgaataccaataacggcactacgaaccggcgttacacatatacgtggcaatttggtccgggctctggaaacggtgtgaacggtggtggttcgaccggtggcaataacaatggtggctcaaccggtggtaatggcgattcgaccggcaacggtaacggtggttcgaccggcggtaacggcggttctaacgacggtaatggcggttcaaccggtggcaatggcgattcgaacggcaacggtggttcaaccggcggtaacggtggtaatggcgattcgaacgacaatggcaatggtggttcgaccggcggtaacgacaactcagatacaggtactgctggcgaataagccataccggagaaggatttggatatagcgaatggtacccccataggtccctcttaatttctggggggggggctgtggtaaattgtttgccgtatgcagctgaaggggagggagatacatgcaaggcgtgaataccggtgaatccggcgcaccaaacggcgagcaaggtatgaggactcaagagattcatatcgtctcgtccaatgcgcatcgacaggcatacgcgtccatacagaatcagcgtctgcaaaagcagttcgagccgatgactttttccaataccccgtttcctgcggaaaaggaaggacataggcgcggcaaggctgaatcgactccccggtggcgtttcgccttcgtcgccagcctgatcgccatcgatttggcagtgatgctgctttcgttgaccgtcagccttgtaatcaacggtgctgctttcgatgccatcggcgatgtgatgccgttttggcttttcctcattctgttcagcctgatttggttgctgtgcttggcattcgcgggcacataccaccgccatgttatggcggacggctatgagctgtatgccaaaatcatcaatgcgtcgttgctgaccatcatctcatactgcagccttgcatttattttcaaacttgcattgccccgtactgcgttgattatcgcgccagtcatcgccttcttcttggatatcatcgcacgttggcagatgcgtcaagcgttgcatcgtcaccgcagcaaaggctcttgcaattacagaacggtggtcatcggatcttccgatggcatcaacaaagccttgcagaccatgcgcaactgcatgaattgggggtacgaaccagttgctgtatgcccaattgaagcggatccagcttcaaaagacgcttatgtggttacctcatacacaccggatgccaatatcgaaggctccagcaaacttaaggtgattcctttcaactcggcattcccacgtatttgcgaaagcctcggtgtacaggaagtctatgtggctgacgtgctttcgcgtgattccgaaatgttgcatggtctttctcttgcggtggagtcgctgggtatggaacttgccttggcggtctccctggcggatgtgagcggtcaccgtttgtatctgcgaaacaccacggaacagccagttctgttggcttccctgccgcagtacacgggagctgcgaacgtaatcaagcgtttgctggacatcatcggctcactgtgcgcgctgattatttcctctccgattcttctcggcgtcgccatcgccatcaagtttgatgatggcggtccggtgttcttctctcagacccgtatcggactgcacggcaagccgttcaaaatgtataaattccgttccatggtcaccaatgctgaggagctgaagaagaaactcgctgaggaaactgggcaggaagaccggttcatcttcaaaatgaaagatgatccgcgtatcaccaaggtaggtcacttcatccgtaagacttctttggatgagttcccgcagttctacaacgtgctcaagggcgatatgtctctggtcggtccgcgcccggcattgccggaagaagtggcccgctatggttccctatattccgcccgactgctggtcaagccgggcatcaccggtccgtggcaggtgtccggccggtcggatctttcacaggagcaaagcgaatatttggacgtctcctacattgagaattggtccatcgctggagatcttgcgattcttgccaaaaccgtgatggtaatcttcactggccgtggatcgtactgagccaataagtgggttttctgtgattttccctctgttcttgtgacggaacagagggaaatttcatttggcggccgaaaaaaggggtgccatgtggcacaataatgcgctggaatagtcaaattgagtgcttaatgatttgaggagcaaagcatggggcaacatgctcaagcaatacgggaaaaacatacggcacggaatgtgacgcttattgtacttgcggtgctgatcgtgctacttgccattgctgcagtgtttggtatgcaactgtataagcaggcaaaaagcgtcaaggcacacgaatcgcaagccatatcctcactatccgcaatcaatgaccctgcaaagctcaaggatgccgccgcgttgcaggcgtccatcgcgcaggctcagcagcagacggcgcaggccaagcagattgcgcacggttcattatggaacgtgactgcgaaaatgccgttcgtcggcagtgacatcgccactgtgcaaggcatgacggaagtcgtggacaatcttgcacagcagacactgccatcgttgaccactgcggtgcaacagcttgccggggccaatctttccggtgcggaagggcaacttaatctgcagccaatcgccgatgcgcaaggtaacttcgacaagctcaaccagcaggtgcagcagcagaacaagcagtataacagtcttgccgagccgaaaatcggcatggtgaagaaagcctatcagcagggcaaggaccagcttgacaatatcgccgatttggttggacaggtcagcaacgccactcacatgctgccttccttcctcggccagaacggtgcccgcacatacttgctggcggcacagaccacatccgaaacacgttccggcggcggcttggttggctctctcggcaccatgactgcggataatggcaaaatcgcggtgggggacttccacccgaatggtgagttcgtcaatggcaacaacggcaccgctgaggaacatgcggtattcaacaggccgttgggtttctccttcgacgtgcgagacaccttcgcggtgccggatgtttcccgcaacgcggaaatgctcaacgcttcatggcagcgttcgcaatatgcctgcaacatcgacggtttgatttccgtggatccggtgttcatccagaaaatggtggagatcaacggaccagtcaccttgtccaacggcactgtgcttaccggcgagaacaccgccgaatacatgctcaacaccatctacaaggacgttcctgtggcacagcaggacgaatacttcgagtacattgccaaaacggtgatggacggcgcttttggcaacatgactgtggacaagatgatgaaggtggcgcaaagcatcggtgatttggccgagaaccgccacttctacgcctacacgttccacgatgacgaagcgaagtacttccaaggtgctggactcgccaagaatgcgcctgagagcgagaccaatccggaaacgggcatttacatcagcgagcagaatccttcgaagatgggttggtatatcgaccgtaccagcgaagtgaccaagacaggtgacaagacctaccacgtgaagtacacgctgaccaaccgtatgacttccacggaaatggctacctgcacgagttacattctcggtggtgagcagaagggcgttggtggcgtgcccgtggcgccgagtggcacatccgcgcagcgtgtgctgatttacgcgcctgcaggtggttcgattggatcaatcgccgtgaccggtgatgtgcgtgaccgtagcaatgccaccatggacggcaagccattgaactccagtatggcgtacatcgcacctggcaagagcgtgacgtacgagttcgacgtgaccgtgtctgacaaggccacggctgatatgaagctcgatcagacgccgtgtggcaaaatgaccaatgatgtgaaatacaactattgaaatatggcgcggtaattctcgacattattggtgcatgatttccttgaattcatctcaatgaaaacttgttcaatgaagtctatgaattattgctatattcttggaaatacagggggtatttctgccggaaagcggagataccccctattttattagtgaaaaaagggtgtatttatgcgaattgttgtattatattgcatgtaattaatatcctatattttcaaggggttggcatgtctgttcttgacggatttgaagcagtgggagaaaagaccaccaccaataagatgaccatgacggtcatggaatcatccgttcgcttttccaaaggcgtgaccgaagcgctcggatgcccggcatacgtgaaattgctggtgaatgacaagcagaagaagatcgcagtccaggcatgcgacgccaaagacgagaacgccatcaagttctgcaagaccaagcgaagcaaggccgatggcgtcgactctgacgctgcaggaaaggcttcttccgtgaccgtgcgtaccaccgatgtgctggtagcggtgcagaagtatttcactttcccgccggtcgcagacgaccagatcgcctatttcgccatggatggcgagtcctacccggatgagaaggttgtcatttttgctgtggccgatgctgcaaagggtgtatccggcaagcgcggtccccgcaaaggttcgcatcatacggccaaagatggcgagtaagtgaacaatattccgctcagcttgaaaaatcgcatatagtacagttctcttgatgtgagtgctgtactatatgcagtatcttgataggctgtgcgaaacgtccataaacgctaataatgagtacgtatgcatccagcccaaaaatcctgaaaaagggagcttggaatgaatgtggcaggtagtgggcgtgtaggatcttcgttcagtattcgagtcgctcaaaataacgtgcttggttggcgatggacggtggaaaaagagcatgacggctttttcgagcccgttgcgtctggccgttcgctcacgcgtaagatggccaaaagggccgcgataaaagcgatgaatgaattgcgtgcataaacaaccgtaacgccatgaatggcctgcatctttccatatgaaatataaaagaggcatataagacaggagaggctccgcacaatgtgtgcggagcctctcctgtctgaaaaactaaaactcagtagcagtggttggcgagccagtaggtgtaggcgccctggatggagccgtagcgctgtgcgcagtagccccagaaccacttgagctgggtctgatagttggtggcccagtcagcgccggcgctcaccatcttcgaaccgggcagagcttgcggcaggccgtaggcaccggaagacgggttcgtggcggaaacattccaaccggattcgtgggaaatgatgtacacggtcgcggtgaaatcagcctcggaatagccgctggacagcagataatcgtgagcccactgctgcatttcgccagccggcacggtggtgccgatcgacgctgcggccgcggacggcgtggacgaggagccggtgccgacgaggatcaccttgtcggtcggagccttcttcacgaaagagctgatcatattggaagacatgaccttgccgccggacttggtgacgaggttcgtggtctccataacaccgttcgcgccttcggtctcgaccttctcctggcccttcggcaggctggaggtctccttcttgaccgtgttgaatgcgatatccgtatcagacacctcaacggaagcgccggcacgttcgatcttgatgacggtgttctcgttcaccttcgtatccaaagacggggaaacggtgtcttccgtatcaagggtgatgtcgcccgcgtcaagcacggacttcacgtcggtgaaatgcatgccgggaaccacgcgggtcttgccgttgatcttcacggtgacgtacgaagtatctccggaaagcgcctcacgggcgttgccacgggaggcttcgatgctgtcggtgacggaatacgcggtgacctgcttggcaggagacttctccgcggtggcgtacagattatgcgacacgatgccgccagtggccaacagccccactgccgcaaccgttgcgacaatcttcaccatctgagatttgcccggcaaggcaaacgtagttggttgggcatgtttcttatggctagccattctgctcctacatcgggtacaattcctcggcggattccgtgcctagggcacggcgcacaaccgctagggttccgccggaatgcgcgcaactgcatatagtctaccgcaccccaaggaacttgaagataacgtatgcaacgcgcaggcgacgggccgaatcatcgttccgactgactacttggcgttttcactttggcgtctccgctggaagcggtgtccccatcggaagcggccgcatccatatccaacgccttggcctggctgatcagatcatccaaatcggaagcgcgcaacgcgccggcctgctggaagatgatctgctgcttcttgacgaccatcagcgtcggcactgcctgaaccttggccgcggcggccagatcgggattctgatcgatatccaccttcgcgaaatagacgtccggattcgcctcgcttgccttctcgaacgttgggccgaacgcgcggcacggaccacaccacgtggcccagaaatccacgaacaccagatcattggattcgacgacctggttgaaatcctgcgaagtgactgcatgcgttgccatatgcgttccccatttcccggcttacgctataagccgatttcaaaaaacaatatcgtgcaatgctgcgcaatattgcgaaagcccgtttgcgaaaagtatatagccgcacgccacgcaaacacactgccgcacccgattgcgctatgggaagaatcggaagcacgtgacattcacatgccgtgcgtgataatggaaccatgccagtgatgaatgatgaagtgcccgacgagggcgatttcgacgccaaccgccatcgcggggaattcgacgacattacgccggaggatttcatccgcggaatgggcaaccctccgggatggctcccatcggacgaaatcaaccgcatgcgccacgaaataccgattccgtacgtcgtggtcgtgccggtgcgcaccgacgatctcggcagggtggcgcaaatcggctcgctgctgcgcgtcaccgacgacggcggtatcgaacgcacattgatcgccggacgtgtgctctatcacgaatcgttgcgtgaagcggtggcgcgcaacgtcgcaaaagatttgggcgatatcgccctgccgcagctgccgatcagcctgcagccgttcaccgtggccgaattcttcccgacacccggcctgtccgactattacgatccacgccaacatgcgatcgcgctgtgctacgtggtgccgatcgccggcgattgcaagccgcaggacgagacgctcgatgtggaatgggtcgacccgtccggagacatgctcgacaccttcgtcgggcagatggccaatggttacggcaccatcgtgcggcaggcgctcgcatggaccggcaagtaggacaagccgcgcaagcggggcaaaagccaagcaaactaggcgaacaggcagataggggaggattagaaaaaaatatggcgattgaactgaacaacaacatatatacggacggcggcaacgataccgaaaccacgccggtggtgctcgtgcacggcttcccggtggaccaccgcatgtgggacgagtgcgcggcggctttacgcgaccaagctgtgaaacaaggcgtgaaaccatttgcgatctgggctccggacatgcccggcgccggcgaagggccgattccgtccgacgaagacagcggcggcaaggacgccgacggcgcgttcccatacggactggaccgcatggcggacgcgtacgtggacctgctgcacgccgccggctacagcaaagccatctgggtgggcctgtcgatgggcggctacctgattctcgacatccaacgcctgcatccggaagcggtggcggcgctcgccctgtgcgacacgaaagccgacgccgactccgccgacatgcgattgaagcgcgtcgcaatcgccaccgactgcgaaacgaccggcacacacgagccggtcatgggattcgccgtgccgtcggaagccgactccaccgtgaaacagtcggacgcctactgcaggcagttcgaaacgtggatcaacgaacagcccgccgacggcatcgcctggcgcgaacgcatggccgctggccgtcccgacctgaacgacgtgctgccgaacatcaacgtgccagtcgcagtaatctgcggcgacaaggacccgtccagcccgccggcagtgatgaagccggtcgccgacgcgatgacgaaaaccgacgtgacgatgacggtgatcgacgactgcggccacttcagcgcgtacgaacaccccgaccaggtggccgccgcgttgctggaactggtgaagcgagtcggctgagccggctgcgacgattatctgtggcagaccatccggcgtatcgacaagatatagagaaaatatataaaacgtatatacgaaatatgtactacgtatgtataacgaatatattccgtatataacacgcatgaaagaggcaacacaaccatgagcgtgttctcaccactggcattgacgcagaccctgccgttcctgccactcgcccaaggagacatcgactacgaagtggcacgacgcggcgaacccgacctgttcgccaaagtcctggcggaaccggcaacgaaagtcatcctcgtcaaagacggcaaagtggccgtgccgcacggccaaggcgccatcgccgactacgccaacgtgaaaatgcgcctcgcccaactgccgggcgcgtacgttgccgcggaactcgaatcgcacccatcggcgctcgcgatattcctcggctcgtacggcggacgattgggcgagcacgtcgtcgccgtggacgtgacgcacgtccagccgaacgatacgacgattacggctgcgacggctcgcagcgggggagcggacgacgcgttcgccgaagtgccggcgcatgaatcgcaggaaaacgcgaaatcgctgctggaaagcgcggcaacccgattcgactgggtggacctgcgcggattcgcgccccacgccagcgcacgcgaagccggacaggcaacctccgccatctcgctcagcatgtggcacgcccggcagcgtcactgcccgacgtgcggcgcgcccgtcgaaccggcgctcggcggctgggctcagcactgcacgaacgacgaggatggcaatcgtttgctgttcccccgaatcgagccagcggtgatcaccgcgatcgtcgaccatgatgaccgtctgctgctgcagcacaacagcgcgtggcgcaacaacggcctgtactcggtttcggccggattcgtggaggctggcgaaaacctggagcacgcatgccggcgcgaagccaaagaggaagtcggcatcgaaataggcgaactcaaatacctcggctcccagccgtggccgttcccctcgtctctcatgatggcgttcaaaggcgtggcggtcaccaccgacgtgcacgtggacggcgaggaaacgttgcaggcgcgttgggtcacacgcgacgaatacatgagcgaactggtttcgggacgtatggaggctccgggcaaagccacgatcgcacgctacatgattgaggaatggctcggccacgacctgccgtgacaagacctgccattaaaaggtggtatcggctgagcctgtcttcggggcggttgccgggggagcttgtttaggtattcgtttgggcactcgtctgcgtatcatgctgcatggtatgtaccgtgaagagagtgaatgaggaaaccacatacatgtctgatagaagtgggcagaacgatacggacaacagtttcgccggcatctcgtttgaaggggtgaatgccgtgccgccgcagtctggtgagaacggcgatacgatcaatctcgccgacgtggccgatgtgtccgaacaggacgacgtgtccaacgccgccaccgagaccatgccgccgttgaatttcgcatcggaccagacccagccgttccagtcattcccgacggccggtgccgccgaaaccacgcctgccggaactgtccccaacggagctgttcccactggtgccattcctaccggtgacatgccctcatccacgcccgctcccgccattcccgtgctcaccatgccggtcgaaggagaagccgtcgtggccaagaaacgcaaactgccgctgatcatcaccggaatcgtgctcgccgtgctggtggtcgccgcaatcgccggcttcttcaccgcacgctggtacttccaagacaaggccgcgccgggcgtgaccttcggcggaaccagtgtggccggacagaccgccgaccagctgaaaaacacggtgacggccgccgtgaagaacaccaccgtgaacatcaaggacggcaacggcaacaacgcttccggcagcctgagcgacctcggcgtgagctacaacgtcgacaagacggtcacggaactgctcgccgccaagcaccagaccaacggcgcactcgaatacatcaacgaagtcaacccgttcgtcaagaagaacgtgccgctgaacgccaagtccaacaagctggccctcaggacgttcgtcaccgacaaattcgtgcaggacaccgaccgcgcggtaccgtccaccgcatcgtacgatgccaacgcgcgcgccttcgtcgcagtggaaggccgcggcggcaggtccccgaaggtggacaacgtgatcgacgcggtcgccaaagccatcgcgaacccggggcacagcggcagcgtgacgatcacgtacgaaaccattgacgtgccggtcgcactgcctgaagcccaaaacgtggccgaccaggcaaacgcgcgactgaatgcgccgattgtgctggacaacggacaaggcaagaccttccagattccagccgaagtcgtggcctcatggctgaaaaccgacgccgacctcgaacacggcacgctttcgctgtcctacgatgacaacgccatcaccaactacgtgcagcagcaggtcccagcccagctcaaccaggacgcggtcgaccaggaagacgccgtcgacaacagcggcaaagtgctggccaccatcgtcaaaggcgtgaacggcgtgaaggtcaagaacatggaggcgctcgcaccgaagatcggcgaagcgctcaaaaacggccaaggcgccaccattccggtggacggcgacgtgcagaacttcaaaaccgtgcagaagaagagcgaataccgcatcgtggtggaccgtaccgcgcaaactgccaccgtgtatcacaacgacgaggccgtcaagaccttcccggtgtgcacgggcaccaccggcaagcacgaaaccgacctgggcaccttctacatctacctcaagtatcagatccaggacatgaccggcctgaacgacgacggctcgcgctacctgtccaagggtgtgaagtgggtaagctacttctacggcggcgaaggcttccacacggcaagctggaacaattacggcatcgcccacggcgacccggcgcactacggctcccacggctgcgtgaacatgtacgaagccgattccaggtggatctacgacaactgtccggaaggcaccatcgtgcaggtagtcggcgccatgccatccggaccggtacgctgacccgttacgcgtggcgcgggtgcgcggcgttcgcatacgccgtacaatgggcggcatgagcgaagcaaacgatagcaaagtgaacctcgacgtgcccgagcacctcgaatactccgacgagcacgtgtgggtggattcctccgttgaacccgccatggtgggcgttaccgaatacgccaccgaacagttcggcgaactcgtgtacatcgatttgcctgaagtcggtacgcaggtcgaagctggcgacgaagtggcggaattcgaatcctccaaggcggtcaccgcgctggtctcgccggtggctggcaccatccgctacgtcaacaacgaggctgcggacgatccgagcattgtgacggacgatccgtacggcgagggctggattttcaagatcgagcttgaggatgacgagcctgacctgcttagcgctgacgagtatgccaagattgtggctgactgaatagcacggacgcctagttttaattacggctgcggccggcgggtgcgatgcgcggcacactcaaggccgttcggccgggcttacggtcgcgcatcgcacccgccggccgcagcctttttatgggaagtgccttgcggggccctgaaagttccctgattttctcggtggcgttactgtttgttcgaacgcgacctctatagtgggcatatgagtgaaattcagccgttgccgcagttcccgccgcagcacgaccagcagcgcgaacagcagcgtatgggggagcggatggacgattcttgcgatgacatgcccaccgtgccgattccggcacgcaaggtggtcaccaccttcgacgcggcctccagacatgagcgtcttgaagtcaaaccgccgctgaccaggctgttccgccgcacgatcaccaaagcattcagtgtctggctgaaattctcgaccgcattggtgcggtcgctcgactggtatccacgtgtcgaaccctacgtcggctatggcaccgaacactactcccgactgatttgccgtaccgtatacggcccgttcaaacggcaggccggccgcctgattcgcggcatccgtggcatgctgatggtgccgtccccgcataccaaagtgcggatcgccatcgatgacgtgcccatcgaaacagtgcaggtgggtgcgtcggaagtatacgacgcgatcgacagcaatcctgatatttccagcgaattcgcggcatccgacgatgccggctacctcgacctcgtggccgagcattcgctcgaaccgggcatccacaacgtctcgtacaaagtgcgcagccgcaagccggtcaacgccaatcttttcaccattcccagcggcaccaaagtgggcgtgatctccgacgtggacgacaccatcatggtcacgcaggcgccgcgtctgatgaaggccgcctacaatctgctgctgcttaatccgcgcaaaaaagtgccggtggccagcatgaacctgctgttcaaccgcatcgcggacatgttcccggacgcgccgttcttctacctgtccacttcgccatggaatgtggaaagctcgatccgccatttcattacgaaccacggttttccggaagggccgctgctgctgcgcgaccttgacccgaggccgaaaaccttcattccgtcgggcgtgcagcacaagcttgaatacgccgagcagctgatggcggattttcccgatatgaagttcattctgatcggcgacgacgggcagaaggatccgaccacatacgccacgatcgcacgccgctacccggggcgtgtgctggcgatcggcatccggcagctgtcaccgcgcgaagtgaccggcaatttcggttccgtcgccgggcgcgtggccacgcagccgatgccggtcaccgacgtgccggtattcacgggaacgaccggatcgaacatcatgaaaaccatgctgccgttcctgaaacaacagatgggcgtctgactttttcgtacgcccagagcaggggttgcgtgccgcgtgggattgggaatgcaatgccggtataatcgcgtgcatgactgattttcggggtgaacagggcgcaacgggcgcgcgagaaagcgacgaaagcgtgcaagacaaatgcgggatgccgatcgcgaagcgtgtgccgaaggagcgcgtattccacggcgacaccttcatcgacgagtacgaatggctgcgcgacaaggaatcgcatgacgtgcaggattacgtcgccgcgcagaaccggtattgcgagcagcgcatggaaccgttgaaaaccctacgctccacactgttcgacgagctcaagtcgcacgttcaggaaaacgacatgtccgtgccgacacgcatggatggctactggtatttcgtacgcacccaggagggccagcagtatgcggtgcaatgccgtgtgccgattcgaagcgcagacgattgggatccgccaaccattgaaatcggcgtgcctatcgacggcgaacaagtggtgttcgacaccaatgccgaagcgcaaggccatgatttcttccgtatcggcggcatggatatttccaaagacggacgttggatgctgtacggcaccgacaccagcggcgacgaacgttacgatttccgcatccgcagcttggaaaccggcaaggaactgccggaagtgttcaagggcatcggtggcgcctgcttcacaccggacgcgcaatgggtgttctatgtgaagctcgacgacgcgtggcgtccatacgcggtgatgaggcaccgcgtcggcacccccgtcaccgacgatgtggaagtgtatcacgaacaggacgaacgattctgggtgggcatcggcctgtcgttcgacgaacgcaatctggtgatcggcaccggatcgaaaaccactaccgaagtgctgctgctttccaccgacgatccggaaggtgaattccgcgcgttcattccgcgcgagcaggacgtggaatacgacgtgagtttcagccgtttcgaaggtgccggcgaacgcggtgaggatattccgctcgccgtggtctatcacaatgcgttgaacccgaatttcgaaatcgatgtgatcgacatgcgctcccatgagcccccgtaccgtttgggtgagggcgtgcgtgtggccgtcggttcgccgtacggatgcgagtatggcgacgaggtcgaaccgggcgcttctgggatgccgatcggcacaccgtattccaatccctgcaatccagccattttgcagggtgcgcatggtcttggcattgaggggatctcgattcaccggcattatgtggcgctgcagtaccgggcggaaagcctgacgcatattgcggtgatgacgaaggatgccgctgcggaggattttcttgcggggcgtccatggaagttcaccgagctggttccccacgcgttggaagacgattgggatgtcgacgagtcggtggacgagatcaacgaggaacgtgccgaagtgtggggcgcgctcgaccaattggccgccgcgcaaggcgaggggtcggccgtgcatggggtttcccgcaaggcgatgacctcatcggatggcgcgaccgccgatgcgatgccgggggagacccggcgcttgtattcgattggtgtgggaggtaatccttcgtatgatgcgccccgcatgcgctactcgttctccagttacacgcgtcccggcgaactgcatgatatcgatccggcgaccggcgaggatcgcctgttgaagcgtgccacggtgcttggtggatttgaaccgcgcgaatacatggagcgcagggtgtgggttaccgcccgcgatggcgagcgcattcctgtttccttggtgtggcgcagggatgtgcccgcgtgtgattcggcgatgttcgttaccgggtatggcgcgtatgagatcagttcggatccgggattctcggtgtctcgcatcagcatgcttgatcgtggtgtgctttatgcggtgccgcacattcgcggcggcggtgagatgggtcgtgcctggtatgagcaggggcatttgctcaataagaagcattcgtttgaggatttcgttgatgccgtgcgtgcgttgcagcgtgccggtttggcgtcgcctgctcgcacggtggccgatggcggttccgccggtggcctgttgatgggtgccgtggcgaatatggctcccgaatgtttcgcgggcgttgaggcggatgtgccttttgtggatgcgttgacgtcgattcttgatccgtcgttgccgttgacggttacggagtgggatgagtggggcgatccgctgcataatgcggacgtgtacaggtatatgaaggaatatacgccgtatgagaatgcgccgtctgatgcaaatgatgcgcgggttgcggtttttcccaagattttcattaccacgtcgatgaatgacactcgtgtgctgtatgtggagccgatgaaatggttggcccgactgcagcgtgcgggcgtggatgccgtggcgaagattgaggttgagactggtcatgggggtacgtctggaaggtacaagcagtgggaggagatctcctatgagaatgcttggtgtctttcgatgatgggtatcacgcattgatccggtttgtgggacctttcatgttcggatgaggtcggtttcggaacggtctgttgttatgtgacggggtgcaccgtatgacgcaccccgttttgcaaacgcttccatttgcagtttgtttcatgaaacattgaaacagctcgggtgattgttttcggcgtttcttgcataatcctccgatttaggggtgttccgtcaaacgttttttccaacttttgacggcatgttaaaccttttataaggtcatgcttgcacctgttttcagagtgtttcattgtctgtgtggggtggtctagtagggtccagagaaatagcaggtttacgggtaaaaccgactagattgcattgcgaccagggggaagaatggcaggcatgcataaagccgtaagtgagcggcatggaatgacaacgattgccgcgttggtggcaatcgttgcgatgatcttcgcaagtgtgatcgcagcgccgcaacgcgcgtatgctgagggatacaatatcagcgatctcggttgggttgacaaggacgacacctccttcgaaatcagttccgacggaggcaagacgtggaagccgtacatttccggcatgcaggtcaactacggtgatcagatccgcaccgaactgcattggaaagtgccgaacgacgtcaaaatcaacgagggcgacaccttcgtctacgaccttcccagcaatctggaatacaaatcgaacgagaaatacccgatctacaacggtggcgacgtggtcggctactacaccatcgacggcgacaaaatggtggccacctacacccgcggcgaatcggcggggtccaacatcgaagcgttcgtgaccactgacggaaccatcacctcgaacaaaaccggtggttcggctggcggcgataccagctttaccttccccggatatggcaccatcaccgtgaacgtggagggcaaacacagggtcaacgtggtcaaacgcccggcaatctccacttccgacgcatccacctacgatttcgttttggaagtgacctctacaggcacgaacaccggcgtgaccatagacgacaccatgggcggcctgctgaccttcgtggacggatccgtgcacatctacaccgacgccgactgcaagaacgaatacacgggcgcatggcaatcctccaaaaccgacgaccataatttcaacgtcaccatcggctccatgggcgacggtgagaaactatacgtgcgctactcggtgaacgccgacaaagacagcgtcatcaaggcatgccgcgaggccggcaattgcagcaatgccaccgaaaacaaaaacaaggtgacctattccagcaacgaagacgtcaacaagaaggaaaccagcaactccatctggttcaactacagcgactggtatgtgaacaaaagcgcaaccgcagcaaaagacgaaaatggcacgcaaggcttcacttggaacatcaccatcggcgctggcgaaggccaatccgtcgacggagccaccgtcaaagatctgctcgacaagaacaacctcaaggaaccgaccggagatctggtgctcagctgctacaacagcggcgactggaaatccgtgtgtccgaccggctcgcccggcgcatatacggacgacgacccgtacaatccgcagcattacatcaaacttagctggagcgatctcgtagcaggcaccgtgaccctgccctccggcggctacgaccatttccaaatccagtattggaccgaagcgaaaaacgtgccggtcgaaggaagcggcgaacaccagaaatacaagaacgaagtcaccgtaaaacctcaggatggaaccggcaaaacagccacggccgaacctcaactcggcacggacgcggtcgaactgaagaaaacatgcacgtcgccggcatccgaagcgaagaacctgacgtgggtgaccagcatgaaagccttggaagacctcaccaacgccgaactgaccgacaagctggatgtggacgacagcggcaaggatctgggatccaagcaaaccttggtgaaagacagcattaaagtgtacaccgacgccgccctgacgcagcaatacgcgggcggatacacgacagaggccaccgataggggattcaccatcgtgttcgcatcattgcccaaaggcactacggtgtacgtgcaataccagtccaccgtcaacgacggtgtgaccgacgaaaccgtgtggaaccgagcttcggcattgaacaaaacctccacggcgaaacaccagcatcgcggcgacgtgctcggcaaggaagacgccaaccagtattgggaccaatacgggtacggctacaccgccaactccaaaggcgtgatccgctggcgcatcaaagtgcatgacgtgatgtcggacgccgaaaacatcgtggtgaccgatacgttgcccgtccacacgcggtacgacgcgaaatcgttgaagatcttcgacgcttccagcaccacaaaaatgctgtccggagtgagcgccaaagacaacggcgacggcacggtgaccttcaccatagccaagggtaccccggcgttcagccaggcgaagacctcggctggtgtgctcatcgtgtatgagacgagcatcgacccgatcaccgcacctgattggggaaattacgagaacaaggcgcacatcgacattgatggcagcgccggaggcgacgcttccgccacagtgggcgcgagcaagccgaaacttcttgacaaaaacggcaaatacgatgccacgaccgcgccgaacgtgaactacacggtcaaagtcaacccgaatgcggacacgcttaacaaaggcaacaacctcactctgaccgacaccatgggtcaggcactcgacctcaacgccaacagcgtgtcgatcatggactccgacaatggaaccgccatcaacggtgcaacatggtcatacaatccgcagacccgcgaactagtgttctccattcccgacgcccgtgcatgcaccatcacctacacggccgcggtgcagctcaaaccaggcgaaagcttcggatcgctgggcggcaacaaaatcgtgctcgccgggtatgagaacaacggcggaacctcgcagaacacaatcaccggaaccgtacagcagagcaaaggcggcatgaaatacgaccagagcacactgcagatctacaagtacgcggatggcgatctcggcaagccggcgggcagcgccaccttcaaagtggaaagcgtcaccggatgcaacttcgtgtcgtctacggccgatgccgacggcacctgcaatggtacggttggcaaagaaatcaccaagcagctgaccacaggagcatccaacggactgtccgaccgactgcagctggactacgacaccgtatataaggtcaccgagctgacaggtccggacggcaaagtgcccggcagcactgattcgcaatacgagaaatccgctccgctctatgtgatattccccggacatgacgcgcagaccgctgccggtgcatacgacggacgatacgacaacaaaaccgttaccgtagacgggcaaagcggcaaattgatcgtcgccgtagccaaagacagcgacggcaagacgaccacattgggcaactaccgttggaactgcagcaacgaccacaaaacgaagttcaaggtgcaattcacaaaggtggatgcggcgaatgccggtgtacccgtcgacggtgccaccatgcagctgactcgtgtcggatcgtcgcaggtggaatccgattggacatggaccacctccggcagcgagacgaaaacgctcgaactcctgcccggacggtacaagctgaccgaagccaacgcaccggacggataccaagtcatggatccgatcatcattctggtcggcgaagacggcaccatcaccgtcgacggcaaaaatgtgaccggtagcgacggcatcggtcacgtgcaggcggaggacgcaccgaaaaccacgtcgttgactgttacgaaaacatggaacgacaataacaaccaggacggcaaacgtgcatccgtcaccttcgatttgtaccgcaagaccgacggcgatgccgattatacgaaagtcgacgggcaaagccgcatactcaatcccgacaagaacgataacgtgcaatggacgggactgccggtgaaagtcgacggcaaaaccgcggcctacatggccgtcgaaaccacgacgctgggcgggtacgactcgcaatgcgctgacgtgcaatacaacaccgacggttcggctgccaccgaacaatgcaccaacacgcacacgcccgaaaccacgtcgatcggcgttgaaaaagcatgggacgacgccgacaaccaggaccagaagcgccctgacagcgtaaccgtgcatctgttgaaaaacggagaggaaaccgatcaaagcgtgacactcgatgcggttggaaactggcggaacgacagcgcgttcaccaatctgcccgtctacgaggatggcaagaagatcgtgtataccatacgcgaagatacggtgagcggctacaccacgcacatcaccggctcgcaaacccaaggtttcgccatcaccaacacgcaccaccccgaaaacgaggaggtgtggttctccaagcaggacctcaagggtacggagatcgcagatgccaccatgcgcctcaccggtacgctgaatgatggcaccgaattcgaaacgcagccctgggtaagtgagcgggataagtcgaagagcatcaagctcaagcccggcatctacaccttgaccgaaaccaaggcgccggatggttatctggtagcggatccggtcgaattcaaagtcgtgagcgacgccgtcaccggcaagctcagcgtgcagatcaagcaaaccgatggcacatatgccgacgtgcaggacaataccatcgtgatgaccgaccagtaccggacgcatcaggtgaccgtcaataaaaacagtctcaccagtggcatcaccaatatcgacggcgcgcagatgagcatcaccggcaccaccttggatggcaaggcgatcgacgagatcacctggaccagcaaaggcggcgaacccggcgaactcaccctgctacccggcacctacaccctgcgtgaaaaggtggcgccggacggctatgaaaccgcggatgacatcgtattcagcgtcgggctcgacggcagcgtgaccatcgacggtaagaagcaggattccaataccgtcgtcatgaaagacaagccgggcaaaagcggcatcctgttctccaaaaccaaggtcggcggcggcagcgagctggctggagcggaattctccataaccggcaaaactttcgaaggcaagacgatcgacgagatcacctggaccagcggcggcggactgccgaaacaattccagctgcaggacggcgtctacaagctcaccgaaaccaaggcgccggtcgggtatgaaaaggcgaacgcggtcaacttcaccatttcccgcggcgaagcatacgtggacggcaagctggtggatggcaacaccatccgcgtcgaggatcgcgtggatacgaccatggtgcgcgtgcgcaaaatctggtccgaccacaactattcggagcgtccgacatcggtgacattccacctgctgcgcaactccaagcagctgcaagatgcgaagtacacgcggacgttggacaacaagaacaccagcgactggacgtacacgtggaccgatctgccccgatatgatgcggacggcaacaggtacaactacacggttgacgaggaactgacccaagagctcacaggtaaggaataccgcgtttccgtgatcaaacgtccgtacatcgacggcgccgaattcacggtattgaacattcgggagccggaaacggcaagcatcacggtgaacaaaacgtggaacgatcaggatgacaacgatggcaaacggccgaagacgctgaccttccatatttggggaaccagcaaacagccgaagagcggcagtaccgacgaaacggaagacgtgaccgaacaattggtggtgcaaaccgtgcgaaccaacggcagcaacacgcaatcgtggacgttcgaaggtcttcccaagcagaacctgtacaacaatccgtacacgtatacggtaaccgaggaatccgtagatggctatacggcaagcgacgtgacgctcgccggcggtacggaaacacgctgtgcggtgacgagcacggtcaaatcctgcgcgttcgatgtgaccaacacgcatacgcccgaaaccacgacattgagcgtggacaagacgtgggatgacactgatgcgcccagcaatgtgaaacggccgggcgacaaggccacgatctgggtgctttccagcgtgtggaccgatgcgaagaaccagacgctgcccggatggccctcaccgcaacacaacagcgagtgcaagaacaccggcgcgacggatggcacgaatccatggggtgtgagctgcatggtgctgacctcggagaacgccaaagcgacgcaggccaccacggccaacgtcaacggggctgacggaacaagcgaagcgaccacttcgcaagaggtgagcgcgaacacgtggacctacaccttcacgaacctgcccaaatactacaagggcaaggaaattcagtattcggtgaccgaagaggccgtgaagaactacacgccgacgctcaccggaggcaaagtcgctgcggctgacggcgccgagggcaaggccaacgagtcgggcgaatccgacaaggcggatgaaacaagcgaaagcggtcagaatgcggaatcctgggcgtacacgctgaccaacacctacacgccggggcataccagccacagcgtgcataaagtgtggaaggactacggcgacagcagcaaacgtccgaaagcggtatatgcgacgttgtatgcgaacggccaatccaccggcaagacggtggcgttgagcgacggcaacaactggcaatacacgttcaccgacctagatgaaaacaaggtgtacacggtgaaggaaaccaacgaaaagggcgaagcgatcagcggagtggacggctactgccagccggtcatcagcgatgaccgaaaaaccggaatctccaccatcaccaacaccatctccatcgtgcttccctccacgggcgggcaacgatggtgctacggcacacttctcgcggtagtggcgctcggcatgatcggcatgggctacggcatcgccaaacgtaacaagaccaacaaggaaggagacgcgcgatgaggcgtcacggagcgaaacaggggaatcggatggattaccgcatggcccgtcacgcggctgcacgacataccggcatgcgttcggtgcgccgcatcgcggccgcggcacttggcctggcgctttccctcgcggggctcagcgcgcaatcggtggcttttggcaatgacgatccgaccaatccggcagccactgacgtgaccatgatcgcattccagcaatcatggaagacgattggcgacgaatgcacgaaaacctatggtccggaaggcgtgaaatacgtgcaggtctccccgccgcaggaatccatccaaggcacgcaatggtggaccgtctaccagccggtcagctacaaactcgactcgcgtttcggtacggaagacgagttcaaaaccatgatcagccaatgcgacgcggctggcgtgcaaatcgtggccgacatggtgctcaaccacaccaccggacatgacgtgtcatgggttgacgaccagtatggcgtggccggaaccgaatacaacggatcatacggacgatacccgggaatcggcatctaccagtatgaggaaagcggcaacaaccaccaatacggccttcccagcggcgacttccacacctgcaagtcgaacgtgtcagacaacatctccgactacaccaacgccgacgaagtgtggaactgccgactgtcgaccatgtgggacatcaacaccggcagcgaccgcgtgcaaaacatccaagccgaatacttggcgcacctatgggaagacggcgtacgcggattccgcatcgactccgcaaaacatatggatcccaacgacatcgcatccatcaaacgcaagttcatgaccaaagcgggcattacggacgaacaaagcttcccatggtcgcaggaagtcatctaccataatggagaatccgaaaaattcgcgccggaacgatacgaaaagaacggacaggtcaccgaattctcgtacgcgtactcattgttgaaggatttcaacggatccatcaccaatttgaagaacatcaccagcgatctgctcgacgacgccgataatgccaccgtattcgtgtccaactgggataccgcacgcggttcggaaacactcaaacccgtttccggcgcccgatacgagctcgccaacgcgttcatgctcgggtacgactacgggcatccgaagatcctttcagactacgcattcaatgaaagcacccaatatgatgacggcgtcaaggattcgactgacaccaccgtgccgaaaatcagcatggacgacgtgtgctccacgcaaaaggacccaacgcagatggagtatggcgattggaactgccaacagcggtggacgtcaatccgaggcatgatcaaattccataatgccgtgaacggcaccagcgtaagcaactggcaggaatccggatccaacgacatcgccttcgaaagggttgacgccaacgggaaaagcaagggtctgctcgcattgaacaacaccctgcaggagcatgacgtcgactatacgacatcgttgccggacggggaatactgcaacgtgtacgcttcccgcacctgctcgcaaaccgtgaccgtcagcggcggtcacgccaaagcgaccatcggcaaacgaagcgccattgccatctatgccggtgcggtcaagggcgcgtggacggaaaccacggaacctagcggcacctacgctccgcaatacaaggattcgccgaacagttcgctgataggtgacaaaaccctcaccatctactacaagcccgacgaatcgtgggacgggcaggtgtatgtgcgttacacgtccgacaacggcagcggtagcattgcgatgagcgcggtcgatgtagccgattccacgaatgcggcaggctggtataaggccgatctgccggaaggggccaacctaagcgcggtgaaataccatttcgcatccacacaatccggggaatctgactccacggactggaacgggggcaagcggggaacggaatatacggcacaggtcggcgccactatgatcaacgtcagcgggcaccggcagcagacgggcgtgccctacacgcgcaaccatgcggcgaaaaccaaagtgaccgtcaacttccgttccgtctccggcgtcggtgagaacgcatccggcgtgaaggtgtggaacggcgacgacatggaaagcgccacgtatattccattcgaaagcacgccaacgcaatacggcaggaaagccagcggcgaactggacggcgatctggcaacagtgcatttcagaatcgtggatggtgccgatgcgactggagcgtccgcgggaaccgtcgaacaatatgaggcgagcgtgtggaaactcgccaaattcggtgacgcgcatgtgagcggtgccatcgaagcgtgggtggacggcgcgcaacccgataccgcttccgaccgatcctcggaaaaagcgtctccctcggcgacaccgcagccgaatgacatcaaaaatccgaaaaacctgaccatcaaactgcattattaccgtcccgacggcaattatcaggaatacagcatggaatccgacgcgtggaaaggctgggatctgtggtcttggtatgcggaaagcaccagcggcgaatcccaggaattcacctcccatgacgaattcggcgaggtcgcggaatacacgctgagccagacagccaaaggcgtgcgcaacccatggttcatcattcgcaacggtggctcatcatggaccggcaaggactgcgacgacaacgatcgcgagattccggaatccgtgatcagcatgaccgcgggaaacgtggaaaacggcgtcgcggaattctggatcgtcagcggggatccgaccgtgtacacgcatccggtgaacgtggccggaataaccttcgacacccaaggcggcagcagcgttcccgcacaggcggtcgccatcggaggcactgcgagcgttcccgaaacgcctactcgcgacggctacgtgttctcgaagtggaccacggacgtggccggtgaacatgagtatgatttcgccaccacggtgagcgcgccgataacgttgtatgcgcagtggacggaagcgaaaaccgtgaccttcgacgtccaaggcggcagcgagatcgccgcacaacaggtgcaaacagggaaattggccgtacgaccggaaaatcctgagcgcgtgggatacgcgttcgcgggatggtataccagcgccgacacttcgggtagcgaatacgatttcacggctgcggtgaacgatgatgtgaccttgtatgcgaagtggacgccgaacatgtacgccgtgaccttcgactcgcaaggcggcagcgcggtcgatgcgcaacaggttgcgtacggtggttacgcgacgcaacctgccacaccgacccgtgacggatacacgttcgtcggctggaccacggatgcggccggcaccacgccgtacggtttcggcatgcccgtcaccggcgatatcacgctgtatgccaagtgggatgatgcgggcgcgacgtaccataccgtcaccattcatttgaatgacggcgacgattattcgtcggacctgccgcaggatatgacgttgttcgtcaaggaaggggagaagcttacgatccccgattccgctccttcccgcggtggatatcgtttcgcaggattgaccagcgacgaacagcggaagacggactatgatgctggcaccgccgtaaccgccgacatgaccttgtatgccaagtgggtcaagacatggacggtcaccttcgacacggccggcggcagtgccgtgaacagccagaccgtggacaatggaggagtggccgttgcgcctgatccgtcgccgacacgcgacgactgccggttcaccggctggcagtatgacggcaaaagctacgatttcggctcgaaggtgaccggcgacatcaccctgaccgcgcagtgggtgcgcaccgcgcaccagtggaccataaccttcgatctgaacggagggcatgcgcccgccggcaaggatgcgaagaccctgtacgccgagcggaaagtctacgacggtgattcgctggtctcgcccacggcggacatcgccaacgagcctcagcttgacggctacaccttcgaagggtggagcacggtgaaagacgacgcgctcgcagtcagcgtggtctcctttgattcgtccgggaaatcgttgatgcccatcgatcgcgacggcacgctgtatgcgttgtggtcgcgggagaacagggtagtgaagccggaatcgtccggttcgacgggatcttcgacgagctattccggcgcgtattccgattcctacacgggattgaacgggttggcagcgttcgatgccatagtgagacaatcgggcaaattctcgggcacgaatttcggttccgtcgccgaggattatgtgaaacccaagagcgttcgctgagtgttggaatccaagggtggggtcggccttcatgtcggccccctttttttcatgtacggtgtatggattgttgcgtccggatcattgaatcgttcgttgttcgtggcgtttgaagccgggtgaaaccgtattcgcacatgaacgcggcaaggagtgtccactagttgagcgttacgtgtccacgtgctggtccgttgactagagtcgcgtgctatgagtgattctgcaaagaagtacaccatcgccgtcattccgggcgatggcattggcaaggaagtgactccgtgggcccagaaggctctggagaaggcggccgaaggcgtcgccgaattcgagtacgagcatttcgatctcggtgccgagcgctatctgcgtgacggcgcgatcctccccgaggaggaagaggaccgtatcaagaagaccgatgcgattctgctgggcgccgtcggcgacccgcgtatcaaggccggcatcctggaacgcggcctgctgctcaagctccgcttcgacctggaccagtacgtgaacctgcgtccgtccaagctgtacaagggtgtcacgtcgccgctcgccaacccgggcgacatcgacttcgtcgtcgtgcgtgaaggcaccgaaggcctgtactgcggcgccggcggagccgtccgccgtggcaccccgaacgaagtcgccaccgaagtgtccatcaacaccgcctacggtgtggaacgcgtggtgcgttacgccttccagctggccatgaagcgcaagaagcacgtgactctcgtgcacaagaagaacgtgctggtcaacgccggcgacatgtggcagcgcatcgtcaacaaggtggccgaggaatatccggaagtctctcacgattacctgcacatcgacgcgaccaccatcttcatggtgaccaacccgtcccgcttcgacgtgatcctcaccgacaacctgttcggcgacatcatcaccgacgaggcaggcgccgtggtcggtggcgtcggctattccgcttcgggctgcatcaacgcgtccaatgagtatccgtccatgttcgagccgatccacggttccgctccggacatcgccggccagaacaaggccaacccgaccgcagccatcctgtccgcagccatgctgctcgagcatctcggattcgacgacgctgccaagaagatccacgtcgccgttgaggctgacatcgaggagctcggctccaccacgcgttccaccgacgaggtcggtcgcgacattctggcgcgcatgtgagacgacatataaagatatgtgacggcatgtgacggttcgaaaagccgagaaatcggctgattccgacttccgtcccatcctttgagacgcccaccgaaaagggtttttcccgaatcggcgggcgtcttcgcatattcggggatttttcaggggccacctaaggtggaatcgggtggaaatgggcaaactttgggatattgttgaggcatgagtgataacaacgccgatttcaatggtgccggtcaagtcaacaatccaacgtcggataacgcagcccaggccgactacaaccaaccgtacattccacaacagaacgatgcgcagatgaaccatccggagtcgcagccggaaacccccgcatacggtcagaactccgccgcatacactcagcccgctcagccggccgagcctgccgttccggcgtacgatccgaacgcttccgcatacagccagtatggccagaccgcacagtcggcccagaccgctcagccgtcatacggtcagccggcgactccggccccggcgtacggtacggctcccgtctatacccagcccgctcagccggccacgcccgctgctccggcgtatgatccgaacgccgcatcgtacaaccagtacggtcagtatggccagccgtcccagcccgcccaatctgcgcagccgtcgtacggtcagccggcagccccggcgtatgaccccaacaacgcttacgcccagccggattacaaccaagcgaactacggacagcaaggctacgcggccccgtcttacaaccaatccgcctacacccagcccgcctacgcgcagcagccggcatacggccagcccgtcgcaccggccggatacgcccagaagtcgaaactggccgccggtctgcttggcatcttcctgggctgcttcggcgtgcacaacttctacttgggcaacaccggcaaggccgtggcacagctgctgctgactgtcatcggctggattctcatcatcggcccagccgtcgcaggcatctggggactggtggaaggcatcctgattctgtgctcccactacggctcgcaatggcaccgtgacgctcaaggcgttgaactgcaggattgatgactcgaggactttacaaacagccgggcggcaaactcgttggagtgactgtccggctttctcatgccgattcggattacgccgattcggattacgccgattcggactatattgattcggctcatacgaatgccgtgaaaacggttccatacgctgggccggctgcatcatcgactgttatcgaatgccatatcgacggcgatttcttcctcgacggggacgatgccggaacgcggaatctcttgcattccatggaatgtgcgctggaacagtgcgcggcccgttgcctcagcggttcgatggtttccgaacgtgacgtgaccgccgccgtcgaacggacgatgctgcaccatccggacgtgcgcatcgtcggcatgggcgcgcgtggcatcgccatcgcctttcaacgtgcgattgacggcatcgatggcgccgatggcattgccggtatcggcggtaatgatgttacgaaagtggaaccacgcgacgacctgcgcattcggcggcataccagcccaatggaaaccgcagaaaccgcggaaatcgcaaaaaacattgaaaacgctggaaccgcggaaagtgacgaaaacgctggaaccgcggaaagtgacgaaaacgctggaaccgttggaaccggcgacatcgccgaaaccggcaattgggcggaatacgcgcgacgctggcacgcactcaaaccgaacatcgtgcacgacgacccccgcaaaccgcaggaacaaatggacctcgacgtcgaatgggcacgcgaagtggctgccggaacccgcgaacccaccctgcgtttctgggaatgggccgagccggccgtggtcatcggcagattccagtcgctcgaagacgaagtcaacgtgcacaccgcgcaagacgaaggattccacatagtccgccgctgcaccggcgggggagcgatgttcatcgaaccaggcaacaccatcacgtactcgctgtacgccccgctcgacttcgcccacggcatgagcgtcgaggaatcctacgaactctgcgactactggctcgtcgaagcgttacgcgccctcggcctcaacgtacgattcgccggactcaacgacatcgccacacaatacggcaaactcggcggcgccgcgcaacgccggttcgcgcccacccacggcggacccggcgcgattctgcaccacgtcacgctcgcctacgacatcgacgcggaaaagatgacccgcgtgttgaacatctcacgagagaaaatgtccgacaaagcggtgaaatcagcggcaaaacatgtcgatcccatgcgctctcaaaccggcatgggccgagacgaggtagtggcgcgactggtcgacgccgccgttcgagttacaatgtagcccgaatggtcgatggtgcccgacttaacgagcgttggcatggatgtcgacaacggaaaacgcagaagcacgtcggaacggaggcacgtcgatggtcaccccgaatggaaccaatgggatcaatggttttggtggtttcgacgatgagcgtgagacgttgctgcacaccgcgctgttcaagcaggtttcgtccgaagaagcccgggaactgctgccgtatctgcagcatgccgaatacgacaagggcgatttcatcttccgcgagggagacaccgaccatcgcatgtatctgctggaggaaggccgcgtcaaactgaccagacaatcctccgacaagcgtgtgcagctgctgagcatccacgcgtacggcgaagtgctgggcgagattccggtgttcgatccgcatggcggaccgcgtaccgcttcggcggtggcgatgaccaacggcacgcgtgtggtctggctggaacatgacgcgctgttcgactggctcgacgaacatccgcgcgtggccgtggacatgctgcaggtattggcgcaccgcatgcgcagcaacaacgaacgcatctgcgatctggtgttcatggacgttcccggacgactcgccaaaacactgctcaatctggcatcacgattcggcgaaccggtcgaagccggcctgaaggtgccacacgatctgacacaggaggagatggcgcagctcgtcggatcctcacgcgaaacggtgaacaaggcgttgatggatttcgctaaccgcggatggatcgccagggaaggccggtccatcatcatctaccagccgggcatgctgattcgccgatcaagacgatgacattcggctggttttcggctgatttccaacttttcctaagaaattgtctgttttgtgagaaacccgtgacggcttccggcacatgcgttggcggggatgtgtttagtagacccgccactttagaatgggcgtcatgcccaagaagaagacccttaccgttcaacgtgtgctcgcattggtaatcgcatacatcacgttatgcgtgggcggcggcgttgtgacgagtattttctttatgcccgctgtgttcgccgccaataacgcggccaaagccgtcattccgtcccttgcggtcgaaggcatcgatttcgatgtgacctcgctcccgcaacgctcgacgatgtatttcaacgacggcaagaccgctttcgcggaattctatacgcagaaccgcgaggtcgtgccgctgaagaaaatctccaaagccatgcagcaggccgtcgtggcccgtgaagacaagcgcttcttcgaacataccggcgtggacgtgcagggcgtgttccgagcgttcttccaaacctacgtcagaggcggcgaccagcagggcggttccacgctgacgcagcagtacgtcaagaacgtgctgtccacccaagcccgtgaagacgacgatccgatcgccgaataccatgcgacggaagacaccgtggcacgcaagctgcgcgagatgctgatctcggtgcagatcgaaaagaaatactccaaagccgagattctgcagggctacctcaacatcgcgcagttcggccgcaacaacctgtgcggcgtggaaatggccgccaaacgctacttcaatgtctccgcttcggaactgaacgtgacccaggcggcgaccatcgcggcaatcaccaagaatccgcagaacttcgatccttccgtggaagccaaccagaaggaagccgaacatcagcgcaacatcgtgctgcagctgatgcacgaccagggctacatcacctccgaaaaggaattcaaagacgccatcaacacgccgttgaaggacacgctgaacctgcaggacgtgagctccggatgccagtcggccattgaaaacaccggcttcttctgctcgtacgtggtcaaccagatcctgaagaacaaggcgttcggcaaggacgacgaggctcgcgagaagctgctgaaggaaggcggtctgaagatcgtcaccacgctcgaccgcaacgccaacaacgcggccatgcaggcggcgaacagcaccgtgccggccacagacccgtccggattcgaagtgatgatagcggccgtgaagccgggcaccggtgaaatcctgtcgttcggcatcaaccgaacctacgacgccacggatgacgcccgaacggacgagaccaagacctccatgaactacatggtcgaccaagaggacggcggcggtatgggcttcaacgtcggctccacctggaagcccatcaacatggtggcgtggatgcagaaaggccactccatcaacgagtcgctcgtcacatccaccgtctacgacacgtcgaagttcaactgcaacggctacggtttcgtcggcccgtggagggtgcagaattccggcggcggcaccacctctccggaaagcccgctgcagggtctgatcaagtcgcacaacaccacgcaggcctcgatggcgtcgaacatcggtctgtgcgcgatcgccgacgcagccaaggagatgggctaccacaacgccatctccaacgcgtccgacatctactccgctaactcgttccagccgccaatgaccatcggtacggtgcaggcgtcgccgttgaccatggccaacgtgtacgccaccatgggcgccaacggcgtggaatgcactccgatcgccatcaccaaggtgaccgaccgcagcggcagcaaggtgaaagtgccgtccgcgaactgccatcaggccatcgacccggacatcgcgcagaccgtgtcctacgtgctgaaccaaggtgtcgtgcagcctggcggcgaagcgtcgaccacgcagcttgacaacaatcgcaagaccttcgccaagaccggtaccaacgagaacacggtgatggccaccgcaggtttcgtgccgaaccaggtcgcggcgttcgtcgcggtcgccgacgcgcaggacccgatcaacaacaccttcgacaacaagaccatcaacggcgtgtaccgcccgtcttggtacggcatgtacatcgcaacgccggcgtggaagcagttcatgaacacgtatcttgccgccatcaacgcgccgatcgacaacgattacggaaagggtgccgacaagtacacggtttcgaagggcgccaccagaacatacaaccagtaccaataccagcgccagcagaacagtcagcagcaaagccagcagcagaccaaccaaggccagcagcagcaatcgcagcaacagcctgctgagcagcaaagtgaccagcagcatcaatagttgcgattgtcggctattcatgccgactgcccgcattgactgaccgcactgattgcccacgtcaccggagcgtaaatcgcatggcaaagtgaacagtccatgaacgcccgccccaaccggcgggcgttctgcttacaatgcaatcggtaccatgcccgtcgcgtgggaacgcggtgcggatatcgacgattcaggcgataccaacgattcataagagagatgacaatgagcgaagacaagaagaacggcaagcagaacaagacggtcaaaccgttcgatccgatgacgttgcgtggcgtcaccgtgcgcaaccgcatctggctgccgccaatggacacgtattccgcattggcacaggacggcaagcccacgccattccactaccagcattacgtttcgcgtgcgatgggcggcttcggcatgatcatcatggaagcgaccgccgtcgcgccggaaggccgcatttcgccgtgcgatctgggattgtgggatgacggacagatggatgcgtggcgttggatcgtggccgacgcgaaggcagcgggtgccacgatggcggtgcagctcaaccacgccggacgcaagggttccaccggctgccacgcgatcggtttcgatggacagagcgtgccggaggagcaaggcggatggcggacggtttgcccaagcgccaacgcatacggttccctggcttgtccgcgcgcactgagcgtcgatgagatccacaccatcgtggaccagttccgcgacgccgcctggcgtgccatgaacatcggcttcgacgcggtggaagtccatgccgcgcacggctacctgctgtcgcagttcctcgacccgctcatcaacgagcgtgacgacgagtacggcggatcgttcgacaatcgcgtccgcatgctggtcgaagtcgtggatgcgattcgttccgtcgtgcccgataccatgccggtgctggtgcgcgtctccgccaccgattgggccgcaggcggttgggaccttgaccagaccgtcgaactggctaagattctgaaggcccacggcgtggacctgatcgacgtgtccaccggcggattgattcccgacgtgaccattccggtgaagcccgactaccaagtgccgttcgccgaacaggtgcgcagtcgcgcgggcattcccaccaccgcagtcgggctcatcaccaagccgaagcaggcgaagaagattctgaagtcgggcgccgccgacgccgtggaaatcggccgcgccgccctgcgcgacccgtattggccgctccgtgccgcccacaaactggacatgccggtcgaggaagccccctaccagccgccatacctccgcggcgccttccgctgaccctccttcccctcccccttttttcttattgcgaaaagtggataacaccccaacgcaacataacaaaaaaacgagtgggagggcgggcgtcctgttcacgaccgtaagcctggccgaacggccttgagtgtgtcgtgaacaggacgcccgccctcccacggagacgcgcctctgttttttacttattaatcgcctttatattgtcgaaaaatcgctttttaaatcgcaacttaaatcgcaattaaaaaagtttcacgcgtcgatgccgaccgcctcgctgacatgttcgaacccgtcgcgcctgagcagttcggccagtccacgcttcaacacggtgatctgctgcggaccacggtacataagcgcgctgatgaacatcaccagcgacgagccgcaacgaatcttctcatacgcctgctgcggggtgaagacgccaccgatgccggcgattgcgaaccggtcgccatattcgcggtagacctgcttgatgcgttcgttgctggccgcgtagcacggcgagccggacagtccgccctcccaatcgcgcggaatggacatgccggtgcggtccttctgcagattggcgatcgacagtccctgcacgttgtgctcggcgagcacgtccagcagatccttgaattccggccacgtcttattgagcggcattttgacgagcgtcggctgcggacggtcgattttgtccagttcggtgaacagcttgtcgagcgcttccgggctttggttgaacggttcgccggccatggtgttcgggcaggagatgttcacttcgaccatggcggtgcgtccggccgcgcggcgcatcgaaatgcagtaatcctcgatgccttcgtccagatcgccggtcttgctgtcgttcgtgcgggcgatcgaaaccgacacctgcatgctcttcgccttcgtccatgcgttctcggcgcgcggaatcaccaccgcggaaccctcgttggcaaggcccacgtgcaccatcatcgaatcgtattcaggcaggcggtggaaccatgggcgcgggttgccggggcaggggcgcgacgtggtggagccgaccgtttcgaaaccgaagccgacgttgtcgagcagcaccggcatctcgcaatccttgtcgaggccggcggacaggccgaacggattggcgaagtcgacgcccatcacgttggtttccagtatcgggtcggtgtagtcgagcatttcgcggcatagccacatcagcggtggaatgttgcgggtgaccttgcagaaatcgatcatctggctgtgggccacgtcgggcgtctggttgaagatgaaatgcggtttgatgatgtgcttgtagccgaacgtgaaaaggtcggtggtggctttgttcactgcgtcgtgccaaaagttttcggaaacgtatgtcatggttccttattctcgcacgttttcattggtttcgcatggcattttgggcaaaagccggtgtgtgtcggtgtggcatataggacgttcgtttttgttcgttttaggctgaatttgagtcgattgtggtgcggctttgagcgaaacacgcgcgaaacgctcaactcagttgtatttttgagtgaacatgtgcgataatgttcatatgatttcgtcacaacgccagcatttgattttgagccgtctgcgtacccgtggtgcggtgcgcatcactgcactgtccaaggaattgggcgtctccgcgatgaccattcgccgtgacatcgccgatctggcggacaagggtctgctgaagcgcgtgcacggcggcgccgtcagcaccagcacactgctgagcgaaccgctgttctccgtaaagtcgcagatggacatcggtctgaaggacgccatcgcacaggaagccgtcaaatacgtggcccccggcgacgtgatcgccatcggcggcggcaccacggcgtacgtgttcgcacaacatctgctcgaatcgcagcaatcgtcgggcatcaccattcttaccaactccattccggtggcggagctggtgcaggcgctcgaatcgaaagacgtggaagtcatcgtgacgggcggcgtgaccacccgttccaactcgctcgtcgggccgatcgcagacaaagtggtcgcctcgctgcgcgtcaacaccgtattcctgggcacgcattccgtgtccattccgcgcggtttcctcatgccgaactcgctggaagccgcaaccgatatggcgatgatggacattgccgatcgcacgataattttgaccgaccacaccaagtggagctgcacgtcactgtcgctgttcgcacgttttgaccaggtggatacggtcatcaccgatgacggattggaccccgattcggtgtcgagaacaagggatttggtcaaagagctcgttctggcacgccaggccgagccggttcaggaaggtgaataatcacatgagtgatttcgtcaactacactccgggagaatatgcgaaggagcatatccgtatcacgccgaccacgcttgccgatggccgcgacttcttctatctcgatgacgatccggaatacgtttccggcgtcaagactcgcgaactgaaggatccgcgccaacttccgtaccgtttctccaaccagctcaacgccgcgggcgaggaagtgccgtacgcggctccggaaatgcgccgcgacccgctgaccggcgattggattccgatggccaccgcgcgtatgaaccgtccgatcaccgcaggtccgggcgcgacggccaaaggcaatccgctggccgcgcgcaagccgggcgatccgtaccaggacggcgaagtgccggacaccgactacaacgtggtcgtgttcgaaaaccgcttcccgtcgatggtgcgcgtgccgggccgttccgaagccgtggaatacgtcaacggcaacccgctgtgggagaagaagctcgccgcaggccgctgcgaagtgatctgcttcgacccggatgaagacggcctgccggcggacctgccggtctcccgcctgcgcaccgtcgtggaagcatgggcgttccgtaccgccgaaatctccaagatggagggtatcgagcagatcttcccgttcgagaaccacggtcaggaaatcggcgtctccctggcgcaccctcacggccaggtctactgctatccgttcatcgcaccgaagatggaagccgaactcaagcagaccgaagcctaccatgagaagaccggcggcaacctgctcaaggatctcatgaactccgaaatcgaggccggggagcgcatcgtcatgcgcaaccacagctgggtcgcctatgtgccggccgcggcacgctggccgctcgaggttcatgtggccccggtgcgcgacgtgctcaccctcgacgagctcaacgaccaggaacgctgggatctggccgtcatgtactccacactgctcaagcgcggcaacgcgttcttcgacaagggcgatggcaagggcatggacctgccgtacatcgctgcctggcatcaggccccgatccacgacaagcgccgcgagaactaccgcctcaacctgcagttcttctcgttccgccgcgccgccaacaaaatcaagtatctggccggctccgaatcaggcatggccgcatgggtgtccgacaccacgccggaactcatcgccaagcgcttccacgagctcggaccaatcgatatcgaaggctgaaagccaataaaacccaaaggacaaaacaccaatgactgctgttgaattcattgagccgctctcgcatgacgagggtgtgaagaacgcgaccgacctgttccgcgccacctacggtgaggaaccggctggcgtatgggccgcaccgggccgtgtgaacctgattggcgaacacaccgactacaacgcgggcctgtgcctgccgatcgcactgccgcaccgcacgttcatcgcgctcaagccgcgtgaagacaccaaggtgcacgtggtttccgacgttgattccggaaacgttaccgaagccgacctcgatggtctgcaggccggtggtgtggaaggctgggccgcctacccggtgggcgtggcctgggctttgcgcgaagccggcttcgatgcggtgcagggcttcgacgcggcattctcctcctgcgtgccgctcggttccggtctgagctcctccgcagccatgacctgctccaccgccttggcgctggatgatgtgtacggtttgggttatggcgcatccgatgccggtcgtgtgacgctgatcaacgccgccatcaagtcggaaaacgacatggcgggcgcgtccaccggtggcctcgaccagaacgcgtccatgcgctgcactttcggccatgcgttgcgtcttgattgccgtccagagctgagcccgctggagaacgtctcccagcaggaattcgatctcgacaagtacggtctggaactgctggtgcttgacacccaggctccgcaccagctcaacgacggccagtatgcccagcgtcgcgccacttgcgagaaggccgccgaaatcctcggcgtggccaacctgcgtgtggtcgccgacagcatcgccaagtccgacgatccgttccaggcgctcaaggaaacgctcgacaagctggaagacgacacgatgaagaagcgcgtgcgccacgtcatcaccgaaatcgcccgtgtcaactccttcgtgcgtgccttcgccaacggcaagatcgacgaggcgggccgactgttcaacgcgtctcatgattcgctcgctgcggattatgaagtgactgtgcccgagctggatattgccgtggatgtggctcgtgtcaacggcgcgtacggcgcacgcatgaccggcggcggcttcggcggctccatcatcgcgctggtgaacaagggccagggtcacgagatcgcgcagaaaatcgccgaccgctttgagcaggaaggcttcaacgcaccgcgcgccctgccggcatacgcagccgccgcggccagccgcgaaatctgattggaacaacggctggcgcaaccgcaatatataagtaatatattttgtatatataaagtatgtatgaaatatgtacttgcgattgcggggtggacgattgcggacgcggccgtctcagtatgtaacgcaatcgggtaaaaggcacgtgttttggcacgtgccttttctatacttaaggacacgtccggcaatcgccgggacggtattggatattcacacctcacgtttagggagttccatgaacaaggcaatcatcaccgtcgtcggccaggacactgtcggcatcatcgcccgcgtctgcacctatctttccgcgcaccaggtcaacgtgctcgacatctcccagaccatcatcgacggtttcttcaacatgatgatgattgtggattattccaacgcggacgaggaattcggcactgtcgtcgacgatctcgacaagctcggcgaggagatcggcgtgcgcatccgctgccagcgcgaagagatcttcaccaagatgcaccgcgtctgatccgcggcacacgtaagccatgcaagcaaccgaagccacgaatcgtaccaatcgtaaggaaaaaccatgctgaatatcatggaggtccacgagaccaacaagatgatcgagcaggagaagctcgacgtgcgcaccatcaccatgggcatcagcctgctggattgcgcagccgacagcgtcgacgaggtctgcgagaacatctacaacaagatcaccacgtacgccaaggacctcgtgtccaccggccaggccatcgaacgcgatttcggcatcccgatcgtcaacaagcgcatcaccgtcaccccgatttccctggtcggcgcaagctcctgcaagagctccgaggatttcgtcaagatcgcacacgcactcgaccgcgcggccaagaaggtcggcgtcgacctgatcggcggctactccgcgctcgtgtccaagtccatgaccccggccgaggaaatgctcatccgctccctgccgcaggccctgtccgaaaccgacatcgtttgctcctccgtgaacgtgggctccaccaaaaccggcatcgacatgaactccgtcgaactgctcggccacatcgtcaaggacatcgcgcacgccaccgcagacaatgattcctacggttgcgtgaagttcgtggcgttctgcaacgccccggacgacaacccgttcatggcaggcggcttccacggcgtgaccgaaggcgacgcggtcatcaacgtcggcgtctccggaccgggcgtggtctcccgcgcgctggacgaagccaagggcaaggacttcgagttcctgtgcgaaaccatcaagcgcaccgcgttcaagatcacgcgcgtcggccagctggtggcccaggaggcctcccgccgactcggagtgccattcggcatcatcgacctctcgctcgccccgacccccgccgtgggcgactccgtcggcgaagtgctggagaagatcggcctcgaacaggtgggcgccccaggcaccaccgccgcgctcgccatgctcaacgaccaggtgaagaagggcggcatcatggcgtcctcctatgtgggcggcctgtccggcgcgttcattccggtctccgaagacaagaacatgatcgacgcggccaacaacggctgcctgaagatcgaaaagcttgaggccatgacctgcgtatgctccgtcggccttgacatgatcgccatccccggcgacaccaccgcggccaccatttccggcatcatcgccgacgaggcggccatcggcatggtcaaccagaagaccaccgccgtgcgtgtgatcccggtggaaggcaagggcgtgggcgagatggccaacttcggcggcctcatgggctacgcgccgatcattccggtgaaccagaccagctgcgaggccttcgtgacccgtggcggccgcattccggcgccgatccactccttcaagaactgacgttcttacgaaagaacccgaccttcctgcacggagggccgggctcttttgcgtttgtaaaactgtttttacttaccgccggcaaagttcaactgtcgccaggcttcgtagatggcgatggaggcgcagttggtgagattcaggctacgcagcgaaggacgcatcggcagacgcacctgctcggccacatgcgggccggccatgatgtccatcggatcggggatattgcccggttccggaccgaacagcaggatgtcggtcggcctgtattcgatgtcggtgtacagcttggtggcgtgcgcggtgaaggcgatgatgcgcgaatccggcatcgattccaccagatcctcgaaattcgggtgcagcaccacatgcgccatgtcatggtagtcgagccccgcacggcgcagcttggtatcccgcagattgaaacccaaaggttccaccaggtgcagaatcgttcccgtcacggcgcacaggcggatcgcggaacccgtgttgcctggaatacgcggggagtagtagcacaggtgcggggtggaggtctccgccttcgccgcgtccttcgcgctcagcatcgcgtccaccacggaaatcggattgccgtgcgcgtcggtcaccagttcgtccgggccgtaattggacttgcggtacccgtattcgaacatcttctcgaccttggcttcggccgcctgcgtctcggcgtcgcgcgttgcgccctgcgcgttatcggtatgttcttcgttcgtcataaatgctaagaataggaacgatgaacgacacgaacaccacatacgacaccgccgtacgtgacgccgactttgacgactttgccgattccgccaccgccgtcacctccgatgcttccgatgctgacgaaatcgcaacgacgctcgcgcaatggtggcagaccaacgcgcgcgacctgccatggcgattcggccgcaccacaccgtggggcgtgctcgtttccgaagtgatgagccagcagacgcagatgggccgcgtcgtgccgtattggaccgcatggatggaccgatggccggacgcagccgcgctcgccgacgccccgaaatccgacgtgatcaccgcatgggggcggcttggctatccgcggcgcgccctgcgattgcaggaatgcgcgcacgtcatcgcatacgattacgccgacgagctgccgcatacgtacgacgaattgcttgctctgcccggcatcggtgattacacggcaagcgcggtgctgtcgttcgctttcggcgaacgtatcgcggtggtcgacacgaacatccgccgtgtgctgtcacgtgcgttcgtcggcgtcgaatcgctcggcggcagcgcaagtcccgcggaacgcgcgctggcgaaacggctgctgccggacgatgattccgcgaaatgccgtcgtttcgatcgcccgtccgtcgtgtggaaccaggccgtcatggaactcggcgcgacggtgtgcactgcgaaatcgccattatgcgaagcctgtccgatcgccggaaaatgcgcgttcctacgcaacggaagaccgggattggggcagcggcgtacgcgaccacgccaacgattccaaggtacggaccggcaggtgcgcgggctggtgctgaacgcgctgcgcggcctgccggatggcgagacggtgcttgatcgcaagagcgtcgaacggctgtggaaagaccacgtgcagctggacaaatgcatcgcgtcgcttgacgaggacggtctgatcgaaatcctgcccgggggaggggtgcggctgccggtgtaacgtacacggcatgcgtggtgcgtgcggccgcggtgccgcacggaggatgacacgctagactgggagccatggctcacaagacctccccgcggaccggtaagaaacgtacgaaacaacagcaggcgatgtatcgccgccgccgcatcgttttcggtatcgcgacggtgctggtgctgagcttcatcgtattctgcctgtattcgctgacgcagggcgtcgtcgctgtcaaccgcgaaatccaccatgccgatgtttacgcgatctcccgcaaggaggtgccgtcgccgacccaacagcagaaaagcagcgtccccgattgcgacgcatccaacgtcgcgctgtcgcttactccggccgcatcgagcttcggtgtgggcggcacgatggacttcaccgcttccgtgaaatacaacggttccggcaaggctggctgtctgatcgacgtgtcccaggcgggcatggtgctgacgatcaagtcgggcaaggacgtggtctggaaatcgaacgtatgccccgtggacacggattaccggctgatagccaagggcgacgaggtcaagcagacgatcacttggccgggcgtgcgttccggcagcgaatgcgccgacgcggcggacctgccgaacgtggaccgtggcgtgtattcggcccaactgtcggtcaaaggacatgcgaaaaccaagtcggaaccggtcggcatcacagtggaataaaatctacaggttatgttattctaatgactttgcgtagatgcgtgtcatatagcgggcacgctgacaaggaagaggcgcccgcgtattaggcatatggtggccaatgagagcgcttccggggaaacatatcgatacgattagcgagcgataaggaacgtccattggctgaggctacgacgaacaccaccaccatcatcgcacgcgccgaccagcatgatattgatctgcacaaggcgtcggaccgtgtgaatttcggctccatccgcgagcccattgatgtaccctacctgttgggtgtacagactgacagctttgactggctcatcggcaacgagcgctggcagaagcgagtccaggaggatctggagaacggcaccaacaccgtgccccacacctccggtcttgacgaggtcttccaggagatctccccgatcgagaacttcgctcagaccatgagcctgaccttctccgatccgtacttcgaagaaccgcgccacaccgtgcaggaatgcaaggagaaggattacacctactccgcgccgctgtacgtgaacgccgaattcgagaacggcgacaccggcgaaatcaagtcccagaccgtgttcatgggcgatttcccgctgcagaccccgcacggcaccttcatcatcggtggtaccgagcgagtgatcgtgtcccagctcgtgcgttccccgggcgtgtacttcgaccgttcccaggaccgtacctccgataaggaggtcttcggcgcgaagatcatcccgagccgtggcgcatggctcgagttcgagatcgacaagcgcgacgtcctcggcgtgcgcgtggaccgtaagcgcaagcagtccgccatcgtgttcctcatggccatcggcatgaccaaggatgagatcgccgacgccttcaaggactacccgctggtcatggacgctctcgccaaggagaccgtgcagacccaggacgaggccctgaccgacctgtaccgcaagatccgtccggccgacaccccgaccccggaagccggcaagaacctgctggactccttctacttcaacaccaagcgttacgatctggcccgcgtcggccgttacaagatcaaccgcaagcttggtctggaaaaggacgtcaacgaccgcagcctgtcccgcgaggacatcatcgccaccatcaagtacttggtcaccctgcatgcgggcgataccaagttcccgggcaagcgcgacggcaaggacgttgacctgcgcgtggacgtcgacgatatcgaccacttcggcaaccgtcgtatccgccaggtcggcgagctgatccagaaccagctgcgcaccggcctgagccgtatggagcgtgtggtccgcgagcgtatgaccacccaggatccggaggccatcaccccgcagtccctgatcaacatccgtccggtgaacgccaccatcaaggagttcttcggcacttcccagctgtcccagttcatggaccagaacaacccgctggctggcgtgaccaacaagcgtcgtctgtccgctctgggccccggtggcctgtcccgcgaccgcgcctccatggaagtgcgcgacgtgcacccgtcccacttcggccgtatgtgcccgatcgagtctcctgaaggcccgaacatcggtctgatcggctccctggcaaccttcggacgcatcaacccgttcggtttcatcgagaccccgtaccgcaaggtcgtcaacggccacgtcaccgacgaagtcgagtacatgaccgcagaccgcgatgccgagcacgtcatcgcccaggccaaccaggagctcgacgagaacggcaacttcgtcaagaagcaggcccttgcccgagtcggcgaagaggaagcggtcgatgtgccggtcagctccgtcgattacatggacgtctccccgcgtcagatggtttccgtcggcgcctccctgattccgttcctggagcacgatgagggccaccgagcgctgatgggcaccaacatgcagcgtcaggccgtgccgctgatcgaatccgagcgtccgctcgtgggcaccggcgccgaatggcgcgccgccgtcgattccggcgacgtcatcctggctgagaagccgggcgtggtgacctacgtgtccgccgacatcatccgtaccatgaacgacgatggcaccaccagctcttacaagctggccaagttccagcgctccaaccagaccacctgctacaaccaggtcccgctcatccacgacggcgaacgcgtggaagccggcaccgtgctggccgatggtccggcaacccagaagggcgagatggcactgggcaagaacctgctcatcgccttcatgccgtggaacggctacaactacgaggatgctgtgatcatctcccagcgcctcgtgcaggacgacaccctgagctccatccacatcgaggagtacgagatcgacgcccgcgaaaccaagctgggtgccgaagagatcacccgcgacctgccgaacgtcggcgaggacgcggtggccaacctcgacgagcgtggcatcatccgcatcggcgccgaagtcgaagccggcgacattctggtcggcaaggtcaccccgaagggcgagaccgagctgactccggaagagcgtctgctgcgcgccatcttcggtgagaagagccgcgaggtgcgtgacacctcgctgcgcgtgcctcacggcgagaccggcaccgtcatcgcggtcaaggaaatcacccgcgaagacgccgaggaagacggcgacgaactgccgaacggcgtgaaccagatgattcgcgtctacatcgcacagcaccgtaagatcacccagggcgacaagctctccggccgtcacggcaacaagggcgtcatctcccgcatcctgccggaagaggacatgccgttcctcgccgacggtactccggtggatatcatgctgaacccgctgggcgtgccttctcgaatgaaccttggccaggtgctggaactgcacctcggctggatcgcgcacgccggctgggacatctccctcgacccggatgccgaggccgcttggaagaagtacgtgccgcagggcgccgaaaagggcgctccgggcactccggtggccaccccggtgttcgacggcgtccgtccggaaaccatcaagggcctgctcagctgcacccttccggaccgcgacggcaacaagctcgtcggccccgacggcaaggcgaccctgttcgacggccgtaccggcgaaccgttcccgaagccgatctccgtgggctacatgtacatgctgaagctgcaccacttggtcgacgacaagatccacgcccgctccaccggcccgtactccatgatcacccagcagccgctgggtggcaaggctcagttcggtggccagcgcttcggcgagatggaagtgtgggccctcgaggcctacggtgccgcctacacgctgcacgaaatgatgaccaccaagtccgatgacgtcgacggccgcgtgcgcgtctacggcgccatcgtgaagggtgagaacctgccgccggcaggcatcccggagtccttcaaggtgctgcttaaggaaatgcagtccctgtccctgaatgtcgaagtgctcaacgccgaaggcgtggccatcgacatgaaggacgaggatgacgatccgtccacttcctccgatgacctcggcttcaacatcggtgcgcgtcctgacgccgccgccaaggaagaccaggttgccgaggagcccgaattccagtgattgaaaggattggccgcgctgcagcacagcgtgcagcgcggccaatccccgaacaacgtgataagcattaagaatcgatagacaggacaatagagtgctggacgtcaacgaatttgacaaactgaggatcggactggccaccgccgacgacatccgtaactggagctacggcgaggtcaagaagccggagaccatcaactaccgtaccctgaagccggagaaagacggcctgttcggcgagcagatcttcggacctacccgcgactgggaatgcgcctgcggcaagtacaagcgcgtgcgcttcaagggcatcgtctgcgaacgctgcggcgtggaagtcaccaagagccgtgtgcgtcgtgagcgcatgggccacatcgagctcgccgctccggtgacccacatctggttcttcaagggtgtgccgtcccgactgggctacctgctggacatcgcgccgaaggacctcgagaaggtcatctacttcgcggcctacatggtcaccaaggtggacgaagagcagcgtcatcaggacctgccggacctgcagcaggagttcgacaacgagatcgccaacctcgagaagcgccgcaacgccgaaatcgaggagcgcgccaagaaggtcgaagccgatttggccgagctcgaagccgaaggcgaagccaagggctccgcacgcgccaagctgcgcaacagcgccgagcgtgaaatggccgccatccgtacccgctacgacgagcagatccagcgtctgagcgccgtgttcgaccgcttcaagaccctgaagccgggagacatggaaggcgacgtcgacctgtggcgtgagatggaagaccgctacggcgattacttcgaaggctgcatgggcgccgaagccatcaagaagcgtctgcaggacttcgacctcgaggcagcctccaagcagctgcgcgaagagatcgacacgggcaccggccagcgcaaggcccgcgccctgaagcgtctgaaggtcgtcaacgcgttcctgaccaccggcaacaagccggaggccatggtgctcgacgtgatcccggtcatcccgccggacctgcgcccgatggtgcagctcgacggtggccgtttcgccacctccgacctcaacgacctctaccgtcgtgtgatcaaccgtaacaaccgtctgaagcgcctcatcgagctcggcgccccggagatcatgctcaacaacgagaagcgcatgctccaggaagccgtcgactccctgttcgacaacggccgtcgtggccgtccggtcaccggcgcttcgaaccgtccgctcaagtccctgagcgacatgctcaagggcaagcagggccgtttccgtcagaacctgctcggtaagcgtgtggattactctggccgttccgtgatcgtggtcggcccgttcctgcgcatgcaccagtgcggtctgccgaagccgatggccctcgagctgttcaagccgttcgtcatcaagcgcctcgtggaccagggcttcgcgcagaacatgaagagcgccaagcgcctcgtggaccgcgccgactccgaagtgtggggcgtgctcgaagaggtcatctccgagcatccggtgctcctgaaccgtgcacctacgctgcaccgtctgggtatccaggcattcgagccgatcctggtggaaggcaaggccatccacctgccgccgcttgcctgcgccgcattcaacgccgacttcgatggcgatcagatggcagtccacctgccgctgtccgccgaagcccaggctgaggcccgttccctgatgatggcttccgacaacatcctgaagccggcagacggccacaccgtgaccatgccgagccaggacatgatcctcggtctgtactacctgaccaccgtcatcgacggcgccaagggccagggccgcgtgttctcctcgctggaagaggccgaaatggcgctcgacaagcacgagatcgacatgcaggccaaggtgctcatccgccttccgcaggacttcgtgctgccgaaggactgggagccgggcgaggtcaaggtcgtcgatccggaaccgggcagcccggacgtggtcaaggaggagcgtttccatgacggctccgtcctgttcgccacctcctacggccgtatcctgttcaacggcaccttgccggtcgactacccgttcgtcaacgagcaggcgccgaagaagcgtctgagcaagatcgtcgacgacatcgcgacccgttactccaccgctcaggtggccgtgacgctagacgccctgaaggatctgggcttcacccgcgcaccgtggtccggcgtgtccttcgcgttctccgacgttatccagccgccggaactggacgagtacatcgaaaagtacgaaggcgaagccgacaaggtcaacgagaactacgaaatcggtatgctcaccgaagaggagcgtcgtcaggaactggtcgacctgtggaccaagtgcaccagcgaggtctccgaggcggttgaggaacacttcgattccaagaacaacctggccatcatcgtgcagtccggtgcacgaggaaacatgatgcagatcaaccagatcgcaggtatgcgaggcctggtggcaaacccgaagggcgagatcattcctcgaccggtcaagtccaactaccgtaagggcctgtccgtgctggaatacttcatctcccagcacggcgcacgtaagggtctggccgataccgcactgcgtaccgcagagtctggctacctgacccgtcgtctggtggacgtctcccaggacgtgatcgtgcgcgaggaggactgcggcaccaagcgcggcctgaccatgaaggtcggcgaacgcgatgccgaaggcaacctgcacctggtcaaggccgccgacggtggcccgtactcccgtctgctcgcggccgacgtcatcgacccggccgacggcgagaccgtgctgtacaaggccggcgacgccctgtccatggacgtgctcaacgatctcgttgcccacggcgtggaagaggtcaaggcccgttccgtgctgacctgcgaatccaagcgtggcgtgtgcgccaagtgctacggctggtccctggccaccaacaagctggtggacgtcggcgaggccgtcggcatcgtggcagcacagtccatcggtgagcctggtacccagctgacgctgcgttccttccactccggcggcgtcgcttccgcttccgatatcacccagggtcttccgcgtgtcaccgagcttttcgaagcccgtaccccgaagggcgaggctccgatcgcggagttcgccggcgtggtcaaggtggaagacaccgagcgcggccgtcaggtcaccctgaagccggacgacgactccgtcgagccgatcgtctacccggtgacccgtcgtgcgccgatgctggtcaaggacggcgaccatgtcgaagccggcacccagctcatcgaaggctccgtcgacccgaagaagatcctgcgcatcctcggcccgcgcgccgcacaggtgaacatcgtggaggaagtgcacaccgtgtaccgctcccagggcgtggatatccacgacaagcacatcgaggtcatcgtgcaccagatgctgcgtcgcatcaccgtgatcgactccggcgacaccgacctgctgccgggcgaactcgtggacaaggcacgcttcaaggccgccaacatggaagccgtgaagaacggtggcaagccggccgccggccgtccggagctgatgggcatcaccaaggcttcgctggccaccgattcctggctgtccgcggcctccttccaggagaccacccgcgtgctcaccgaagccgccctgaaccagaaggtcgatgacctgaagggcctcaaggagaacgtcatcatcggtaagctcatcccggcaggtaccggcctcgcccgttaccgcaatgccacggtggagcccgacaaggccatccgcgacaccatctacccgaacttcggtttgggcggcgaaggcaccgacagctccttcggcgacaccgacctgtccgatgtggacttctccaacatcgacttcggcgacctgaagctgggcgatgacttcaacccggatgacttcctggacgacaacggcggccagaccgatctgggcgacaccctgtgagattcccctcacgatagtcgacagacgaatcatctgacatagcgaaaggcggaaccgaccaataccggtcggttccgcctttcgctatatctatatgtcgtgggattgcgaggttgtggattaatcgcgggggagggtttcgcagtcgtcttttgatgttacttgatcttctccgaaagcgtggtttccagatccttcaacgaaccgctgagatcggcctccttcgcggccttttgcaaatcggactgatccagggtcggcgaatcgatgtcggacatcttcgcatgaagatcctgaagcttttcgtaatcggcggacccatactcgatatcgttgagattcagatcggccatctgatccacaatgtccttcttcttgctgacgctttcctgcatatccgcgccatactcggcataggacttgatgggaaccttggccagatcgccggcgtcggcggcacagctttcgagcgccttggaaagatcgcgatagtgcgaagacatgtcggcggagtcgaatttcggcagcttcgtgcaggtatgcgtcatcttcatgagcgcgggcatggtctgggccagatcgttcatgtacctctcgtatttcgcacggtcccgctcgaacgcctcgtacttctccttgacgtccttgtctttcttcacggccttcatggcagccagcttgtcgctgtcctgcttgaaggtcttcaacttcttcttgccctcgtcataagcggaggatgaatcgttgtccgttgcgctcgccgccgagctgaattcctcattgatggctgtatagctgctttccaacgcctgcgtttggaccagcgcttcctcgtaatcggaacggctgacgcgattcgtaaggaagaacaccgctgccagcgcgatgacgacgactgcggccaccgcgccgatgataatggcgaccggcggcttatttttggccgcggcgccggcttgctgggaaggaaagttgccgggcattggcggttgcggctgtccgtattgaagcccgcccggctgtggctgactgtagtttggcgcctgcggctgcggaggctggttatactgcggttgaccattctgcggttgaccatacggaggagtgttcgccgtgagaaaagtccttcttagcctttttccttttttttgaatgtcgaatccgtgaacacggagggaaacatcgacgtgtccgtctcttttgacgagttacagcataatattttgagatggaatatgcgagcatcgtattgcagaatgagtatcgtcagacggcatggacgtcaccttcctacaatgggaatatgagttttctaccttacccgccgccgcccgaaccagggtggtatgacgatgacgtcacggtgatggcgcaacccacagccgaacccgtcgacaatgccgccgattccttggaaacacgcgaacggctcgccgcacagaacgaatcggacgaccacgatatgcaggatgtttccgttgcgaagggcgacgctgccatttcggacgaggacgatatcgactgggacggcaccgtgctttccgaagccttcaccatgaagcagccgaagcacacgtacgtgctggacaacgagcagaccggacagcaggtgatcgtggatatgggcgtgctccttggccgcaagccttcggccgaagtgcccgccggcgccaaatcggtcaagctggaggatccgacgcgcacaatctcacgcaaccatgcggcgatcagcttcgaccaggatggcacgctgtggatagaggattacggttcgctcaacggcacgtacatcatccaagacgatgtcgaaaccaaagtggaacacaagccgatgcagctggaggcgccatgcacggtgcgtatcggcgaccagttcttccaattccgcaaacagtgaggacgtttgtcagtgaagacacgattacgctgacggactgcgttgacgatttgcgttgacagcgtcggcgcggacggttagcggtaagacgataaggggttgtcacggagattcccgcgacaaccccttatgtttcaaatggtctgataatcggcgttagctcactgctggcgcagacgaatggccgcgttgatggccgaatcgttcaactggccaagccaggcaagcaattccggatagatgtacggattgcgcgcaagacacggacgaagctccggcgcttcgctggcgatacgggccatcagcatctgatcggtggtggtcatggccagttccgcggtgaaccccgcgtctgccggcgattcctgggccgcggcatactgctgttcggcatactgctgttccggttcgttctgcggctggctcgatgaataatcggccacttcggacaaatcggcgggattcatgtatgggtcgacatactcggtcgaagcctcgttagacgccgcataggcagcgtcctgaccgtattgctggttcaccggctgttccggctgatactgctgctcctgctggaactgttccgccactgccggctgatactgctgttccggctggacctgttcggcaaccggttcggccattggctgggccgtcggttcggcaatcggctgcggctgcacgccattttgcggaaccggccagcccatcgccaccagctgctggcgggcgcgctcatcgccgaattcggcgacccaacgcttcagacccgggtacgctcgcggattggcaacgacattcgcaccgaattccggattctcgtacgcgattttcgccaggaacacgggatcggcgttcggatcctgcacggccgccaccgcggcatcgaaatcgaccatcatgatctccttgtctcgtggtctgtaaccatcttattgaatgactcgtaacgtttgcaacgtaccgtccagcgcatcgtcgatatcctcgtcatcgccgatcttgctgacgttccaatcctcgtcgcacggcatatcggaacgcatgtccaccacgatgacggtgatgttgtcgcggccgccggcgttcagcgcggcatgtaccagcatgtccgcggccatctgcgggtcggcgtacgccgccgcgatctcggcaagctgctcacggccgatctgcgcatgcagcccatcggaacagatgatgaaccgtccgtccgcacgcgcggcgtaccagtcaggctggatgccggcaggcgcgccgacacattgcgtgatgatgttgcgcggaatgcaacggctcgcctcatcgggcagcatctgccccgaatcgatggcgttctgccgttccgaatggtcgcgggtgatgcacgtcagcgaatccgccagccacacgccattgccgtcggcgcgcatatggtacgtgcgggaatcgcccacattgacgatgtaacaccgttcgtcggaacatatcgcgtcatcgccgacacgcgtcggcagcagcacgccgctgatggtagtgcccgcaacgccgccgagctgctcacccagacggagcacctcctgctgggcaaggatcagcgtttcgtcaatcgcgtcaagatcgcgcgtcggcagttcggccaaacgcgcgaaccgttccgcaacatcggaactggcctgcttgccgcccttgccgccacccatgccgtcgcacaccacatacacgccgttgcctgcgcaggcgctgtcctggttgtctttcctacgcaagccgatattgctgttcagaccgacctcaatatgtttgacgttcatgagttccgccctttcacaccgattttccgcaagcggattttccggaagtggaacacgtccgcaagcgatagtttcgcccgccacctgcggaacgtcggcagcgagccgagcatgaactttcgttcttcggcgatgtcatgccagtagcgttccgcatgctcctgcgtgacatcgcctccggagaaggccgcgtaatcagcctccctgcccagcgcgagcagtgtatcggcttcgaagcccatctgttcggcgatggcctgcgcctgctcgtttctggtgccttggacgtcaaggccgctttgccgggcaagcgccgcgaccgcctgccatccggcagcgacgcgttgcgatgcgctgccatgtctgcgcgcccgagccagggcgatcgacttgatggcgagcagcaggccgcagacgatgagcaccgtccacagagggctgccgtagatggcgacttttctgacgattctgccgaaacgctgccagaacaggctcgtcggcgtctcgtcggccatgctgccgccaagcgacgttttgcccttggcttggttgtcgtcacgcagcggatcggtaagcggcaccggaggctgacgcaccaaggtctgcggattgggcggagtgagattctggttctcgtcgggaaccttcgtttccttcggtgtcgggtagaacgccacccatccgtaaccgtccagcttgatctccacccaagcggtcacatcgttgccggtgaatttcgtggtggtggttttgccatgcttctcggtgcggctgtcactgatctcgccctcgtcgttcttcggcaggaagcccagcactacgcggctcggcaagccgagactgcgggccataagcgccatcgcggaagcgtattgctcgctgtctccgaccatcgcactgccggcgagcagctggtcgatgcgatagttgccgtgaccggccctggacgggtaatcgccattcaaaccatgggagaaccagccggattccctgagcttgtcggcaagagcctgcgcggcctcgccgcccttggactggccgcccgcaatcgcggtggccagcttatccacgcaatcgggcacatcttccgccttgggctggctgatggaggaagcattcgccttggcgatctccttatccgtcggcgtccgcggaatgacgccggtttccgtataggacaatcccggagaggtgcgcgaagggtagatcgccgacatggtgtcggtgttgtagtagaacgaatcggcgtccgacgatgtggcgaacttcacgctggaagccgcgccggccatcggcagccaatagtcgctcaaaccgtcatcgaccgtgaatttcgcggtgaaccgcttgccggcggcgttgtttgcgatggaatcgcccacacgatggtagttggaggaatccgaagccatggtggaatcggacaggttccacacattgccgtcgaaacggtccataaccgccaaacgcaccgtggaaccggccggcagatcgtcgacggtcagcagcacatcgtccttatggttcttgatatacgaacgcatgccgctcaacgggctggtgtaatcgtacgggctcagcggcggatcataatggtcgcgcagaatggtgcggttttgcccgaccaccaagcatccgccgatcgccacagccgaagccagcagcacgatgactacggaactgagccaacggcccaattccaacagtttccaacgcgcgctgacccaaaccaccagcacgaccgccataatcgtgccgatcgccatacggtagaagccgctcgacgtgccaagcagcgcgcagatcgcaagattcgccacgacgggaacgaccgcgaccatcgtaagccggccatcctccgcaaccgcgaagataccggccagcagcgcggcccacaggcagatcgtccacacggcgagcagcgagccgtcgccggtgccggtcggcgggtcgatggccagcaggtatttgaacgagccgagcatccgcatccacccctgcgtcaacgtgcgcaatgtgggaatgacatgggcgatggtggtgccattcaggaagatgaccgggccgaccaccagctgcgcacacgccatgaacagcatctgccaccacaggcgcaacgcgggaacgagaccggcaagcgccacgagcgagccgatgatggtggcggggattgcggcgctcgtccaagacagggcggagccgtatacgtcgatgaggttgctggctgcggcgatggtcagcagggcggcgaccgtgaggcttgcgtattgcgcggcgtgcggctggttggtgttgggcatggctggggacttgccgctgcgggacatccagatgacggagtgggtggagttcgcccatgagccggtgcctgtgccggtgaggttgccggtgaaattgccggtgttggtgaatgtggtgctcatgccagcacccccatgatcatggggaggtcgttgaggtctcccacggttgccaaggtgaagtcggagtagcgtttgatggcgcgcggttggccggttgcggcttgaagcaccacgcaggttgcggagcgggggagtgcgaggaccatgtgtttgatgtcgtcgatggttttgagcctgccgacggtgaagaagtagaaggatgcgtcgggggcatgttcgagagtggtttgcgcgaggttgggattgtcgtcgatgtcagggtcgatgccgctgcagccatcgagaaattccgtggcgttgcgcggaatggcgtgcgtggaaccggcatgcgcggtgactggccggttctgctgcaggcattgcacgccgatggaggcgtggacggatacggccagttcgaattcctgggaatcgatgtaatcatccgggttcacgctgatggtcagagcggtgtcggtacggcgggtggcttcgtattggcggatcataagcgatccggttttcgcggagctgagccaatgcacgttgcgcacgtcatcgccgggctcgtattcgcgcaggccgtagaagtcgaggtcgtcgtcgacgatttcgccgcttggctggccttccaaatcgcgtggaatgccggcgttcagggtgctgagcagcacggtctgcgggtggatgaacacgttgatctggtccacgagtttcttttcgtggcggatcagaccgaacgggtcgcctttgcggatggatagcgggccgatgggcagcaccgcacggctgacggcggtgaattccacggtcgtcagccgtgactggcctgcggcgagcatgggaatggcgaaccgttcgtggttgtctccgatgggcaggtcgccgcgcgccgacgtggtgggggtgcggcccggattgtccacgcagacgtcgactttcaccgtgtctgacaccgtgacgcgtctgctggacacgtcgatggtggcttggaacgaggtgttgccaagggaaagcatgaccgccgcggccagcatgaccgcgaacaccaccgccatggccagcagctcatgccaccccagcaggacgaacgccaccagtgaggcgacggcgagcgccgtcaccgcccagccaagcggcgacacgtatgaggtggccagtcgcttgatgcgatgtttgaggcggcgtagggatcgttggatggtccgtctgcgctgcactgtgtgcgaatgccgcattccttgacctttcggattgtgtggtgcgtatgccggggtggattgtgtttcaggcgttggcgcccagggttggggccggcacgtcttcgaggatctggccgatcatctgttcgggggtgtttccggcgaaggtggcttcggcggtgagggtgatgcggtgcgcgagcacgggtacggcgaggtttttgacgtcgtcgggcactacgtagccgcggttgtcggaggcggcccatacgcgcgcgcagcgggtcaaggcgagcgcgcctcgcatggaggagccgacttggatgcgttcgttgtggcgggtggcttccaccagtcgcacgatgtattcgaggatcgcgtcgtcgagatgcacggtttcgctgatgttgcgcatgcgcagcacgtcttcgccggtgagcaccggatgcacggtggcggcgcggtcggtgacgttgacctgcttcaggatgttgacgctcacgtcgtggcttggatagccgatggtggttttgatgaggaaacggtccatctgcgcttccggcagcttgtaggtgccgagctgttcgatcgggttctgggtggcgatgaccatgaacggctgcggcaccgggtgggtgacgccgtcgacggtgaccttctgctcttccatgacttcgagcagtgcggactgtgttttcggtgaggcgcggttgatttcgtcggcgagcacgatggacgcgaagatcgggccttcgcggtattcgaattcgccgcgcttctggtcgtagtaggtgacgccgaccacgtcggacggcagcaggtccggggtgaactggatacgtttgaacgacatgtcgatggagttggcaaggcctcgcgccagctgggttttgccggtgcccgggttgtcttcgagcaggatgtgcccgccgaccaccatggctgtggcgcattggcggatgggtgcttccttgccgaccacgacctgggagacgttgtctacgagcttggcgaacttctcatggaattcggtgatgtctttgctgggtgcggtcatcatggacatgtcgacgaccggctgggattgtttgacgggctgtacaggctggctgggctggacgggctgggttggctggacgggctgctgcgcgggcattgcgactgccggatcggcggccggttggcgaaggttctgcggcatcggctgacggaaccgcggctggttcggcgttgccggggcggactgttgcggcaacgccggtttggtggtgccgtgcgcgctcagcagcgtgccctccggatcctcatcggcttgcggctgctccggcagattcggcgtgtggaacgccggctgctgctggccgggttggctgggaacgcttggattatggccgatggaacccagctgggtggcgtcatcgaaatcgttgctcatgggttgctccttgcttgttgtgttgctcgtgtggatggttcgttgtgtttgcgattgctgtgatcgtccgtttcaccatctggcgtagtaggccaggccgcggatccaaggcttggatgcgccgtcgacggtggacagggcgatggaggatgccacaggccggtcattccgcgtggccgcttcgccttccgtggacgcgtcagaatccgatggttccgacggttttgatggttctgaaggttccgacggttcgggtttcggcgtgggagtcttgtacctgtcatggtccagcagtgtgccgccattgtcctcgttgttgagcgcggtgtcggtgcccaccaccttcgccttccacgcgtaatcggctccggtcggcagcacgtccttgacgttcagtttgtcggagcccaatgcccaggcgacgtcataggatttgccgtccgcggtgaaggtgatcacggttttgccgggctggccgtacatgttcaccgaaccgccgctgaccttgatgatgttcggatcattggcgtcccacgtcagcatcggcgcgttgacggcggccttcaccttgcggacgtatgccggatcggccctgccggacttggaggtgcttgccgcgccattgaaatgctgcgtgacggagcccgaggaacaggactgccattccttgagcgggaaatcgtgcgatcgttcggaagcgccggcatggtaggagccgagtccgtccgcgctcaccgtgaacccgtcggcgtggccgttctccttccaactgactacgcacacgtcgtcatgccctttgacgctgaccgattcgggcgccttcaccgcgtatttcggtgtgaaacgtacggtcgaatcgtcactggtcgttttctccttgccgaccaccgccgccttgatggtgtattccctggtgttgagatcatggtccggaatcttgaaatcgtaggatccggaacatccgtcgatgcttgcgctgacatctccggaaatctcgacggccttgcatcccgcgttgcgggtgttgcccacggattcgacggtgacggttcccgtggtgtcgtcgttcgtcacggagatcttcggcgcatcgggcttgccccacggcttgacagcgtcggacgccttggacggttggctccaattcaccttgttgtgggcgcgtaccgtagccgtgcacgagtcgccgtcggaaatcgcgttgttatcgaaaacaaaatcgattccggtggaatttgtcgtctgcttggacggtgcgttcctgccggacaaagtcacctcgtaattgtccaccgacgagaaattgccgtccggagccttccacgtgacgctcaccgtgttgcccttcacactggccgtcacatccgtcggcgcatcaggcagcttgtccggcgtgccctcgacggcgttggaatccttggaccagccgacctcgttcctggcctgcaccttgaacgagtaggtcttgccgttcttcaacccgtcgatgagacaggaggtcttctgcccgcacgagcgctcgccggacgcgtctccgccccacatcaccttgtattcggtgatcgggctgccgttggccgaaccggccgtccagctcagattcacggcgccatcctgcgggtcgccggacaccgcggaaagcagcggcgcatcaggtttgtccatcaccgaaacgctgatggtgccggtcacctcacgttcttttgttttggtggcgtcgcgcacggtgacgaccaccttgttggtgttcgcgccgatgtcggaagccgccctgatggacaccacgccgttggatgggcaatccaccgtcagcttcgacgcgccatcggacgtgcatccggtcaccgtcagcggagtgtcggggaacggattgtacgcgtcggacagcagattcacctgctcgctggaaccggccttgattttcacggtcttctcggtgacacgggcgagcggcctgttggacgcggtgacgcgcacggtcataccggcgctcaccgtacccttcgcatatttgatcgagacgggcacgctcaccgtggtgcccggcgtggccgtcttgtccgcggacacggtcaacgtgccggagggagacactctggcatccacactgccggaattcacgccgccggaatacgagtactgcttctcatcctcgtacaggcccgacgccgaatgggtcagcgccgtcagatcgatggtagtggccttctcaccggccaccacatcgacggtggaggatgagaacgtcggcggcggaacctcacgtccgatcaccgtgatcggaagcgtgagcaccgccgaattgacgatcttcaccttgtcgttcttgtctcgcttgccgtccaccgcggtgaaggtgatggacgcgggacccgcgtaatccttcggcgcggtgaacctcaacgtctggtcgttgacgtacaggtcgccgtccgcggccttcgtggcgctcaccgaatcggcgccgtccacatacgcggtcttgcccgcgcccacacgcacgtagtcggcgatgttgatggtgatggtctcacgcgcattgaccttcaacgccggcgccttcggacgcagaaccggcggaaacacgccatatgcgggcacttggatgaacgcggtggacgtgatgccgtacgtcgtgttcgtgacggtgtatggcaccgcgcgcgcctcatcggtcagatcaacggtgatgatggtggaatccttgccgcccttgacatgcgcatggtcggtcgcggaaggatccacgcccacctgaagctcgtcggcggtgccggacggattggcaatccactgcgaaacgtccacgtccacggatttcttgtcgatcgtggcggcggccggaacacggtaatcgtacgcggtcggcgggtcgatggcggcgttctcgtcgacattcaccgtcaacgtcgccgaatcggacaggccagccttgtccttgacggtgtagaccacgtaatacgtgcccgcctgcttcggcgtggtgaacgacagcatgttgtcaacgacctgaatgccgccgatgccttgcgattccacgtccttggccacggtcagatcagtattgtccccggaaatgtcgttctgcgccaccggcacggtggccgcggtgttcggacgcagcgtgatctcgtcgtcgcgcgcgtacacacccgaatcggctccggatttgaacacgcccacacgcacctgcgcggtggccctctgaccggtccaatcctccacggcgtaggagaacgtgtccgttccggacgaatcggcatacgcctcatacaccagatacgtggcgcccacctcgctgatacggcccagtttcggcgctttgttgcccaagccgagcagctgcacgtcatcgccgtcagcgtcgatgccggtgagcgtgatcggaatctgcaccttctgaccggccgccacctgcgcctcgacgtcggacggtgtcggagccgccttgttggacgcgtccttctgatgcacgttgatggtgatggtggccgaggccgcgttgccgagattgtccttcaccgtgtaggtgacggggaaggagccggtttgtctggtggcctgatagcgcacggtgtcgccggacacgaacaccagacccttgaacgtgttcttgtcatactgcaagtcgttctgcaggctcaccgtggtgccgtcggaatacgtgacatggtcgagcacgtccacggacacgatgccttcggtgcgcacctgtgtggtgatgttctcggccttcggcacggaattcgacgtggtcagcgccggcggctgcaggacgatgacgccggtcgacgatccggccgcgttggccacggtgtaggagatccgcaccggctcggtcggcacctgacgcgcggtgatatagacgcgcttgttgctcaccacaccggttttgatgccgctttgcgcgtccgcggtgacgctggtcaccgacagcacgccgcccatcgggtcgacgtcgttggcaagcggctccacaatcgcggtattgtccgcgcctagcagcgccacatcgttcgccgcgatcggcttggcggcgtctccggccaccgcctgcacctccacacgagccagaccggtcgacggaatggaaccctgcgtgatggtgtacggcacatagtaggtgccgggattggaggcggtgaatgtgatcgacatgtcggtggcgttcatggtggtggccgcgccggacggcgtctccaccgcggtcaattcggccggttcgacggacgtgccgtgcacgtacggcttgagcgcgatggtggtgcgggtgtcgggcgtggtctgtttgaccacggggtcgatgaccgcgcccagcgtgttcgccggcttcacggagaagtagatcatgccggtgccggtctgctggccgtcggacaccgtgacctcgatgcccgccctgccggacgacatcgaaccggcgttgaagaccaattgtccgtcggctcgcgtggacaccgtcacctgatcggtgttctgcggcgatgccgacaccaaggtcagcggatcgccgtcggggtcggagaagctgcccaacgcgttcgcggtgtacgaagcaccctgctccacgtcgatttccggcggagtgtcgctctgcagcggcgcatggtcgtcgccgccggccagcgtgagcgacacggtggcgctggacgtctgcccgcgcccgtcggaaatctcatagctgaaggacacgttgcccgcggcggcaccggaggcgtcgagctgcagataccggccgtcatacacgggggagacggtgatgttcgcgccatccggagcgctcaccgacgtgatgcgcagcacggaacagtcggtctgctcgtcgttgcgcaacacgtcgagaatctgctgcgatcccacgcgcgcgccgaacgaatcgtccacggccttgatctgccccgactgcgccgaacagttcttgctgaaattatgctggttgttggcgctgtcgttgttctgctgctgttgcttcgactgcttggtctccaccttgttccactggattttgatgaccttggtggactcctgcggattccacacattgccgttgaccacgtcgttgagcaccaccagacgatggttggtgcggaacacgagctgcgaggtgggattgacatcttccaacgaggaaaactgtgcgtccttgtcgttcgccgcgcacaccctgatgtaattgttggccttctgcgcccacgcggcgaacacgcagccattggtggacaccggctgcgcggcatcgcccttgccggcattcggcagctgcgtgacctttttactacccaaatcgaccatggcgatgccccgcggcgtggaaaccgccacccagccagtctgcctgccatccgtggacggcgcctgcaacgtcgcctgatcctgcaggccgatatccgcgctgcccttcggccagaacaccttgccggcaccggctgcgaccggcgtcttgccgaccacggtgaacgattcgacattcgtggcgcccttgatcgtcgcatccttgccgggcgttccctgaggcccgtcgacactgagcaccgcgccgtcggacgcgcgatagccgtagacgacaccgtcatgcgtcaccgcgatacggccacccgaccccagcttcatcttcggcgaatcggtggtcggattcatggatttcacatcatctgctgacccgacccacacattgcccgtcttgacgttgatgaacgccgcggtgttgcctccgacgacggtccgcatatccgatttgatggtggtgttgccgctttcgctgacggtggaggcctcgatgttgctggccttcgtaccttcggagatcacggtggagccatcatgctgggccacgtcgaaccgggccgcagtggaggcgacgcccgcatcggcgtcccggttgcgcacgttgaaacgggcggccttgcggtccttgagcgaagtgacccacacggtgccatcgtcgagctgcacgtgacgttgcgtcaccgaactgacgatgacggccccggcgacgatgcccagcaacagcagcagcatgacgatcggcgtgatccaccggcgactgccggaaggcagcagcttgcgcagcatcgacccgaatcgcaactgccgttcgtacgattgcgccgactggttctcggcgttcctatgcttgctcatcgactggctcttccctgattgtgcccaaactttgcttgaccgcgcatccaaccgcatgcgcctacctgtttgcccgcatgcatgccgggctgtattggttcgtatcggttcatgtcacccgcatccggccgcaaactcacggcttggccgcgcacgcgatcatgggattctcggacatctgccggtccgcgcgaaccagactcacctgcacgcacgtctgcgcgccgtcggccggatcgatttcgatactcgtcgactccgtggtggtgccctgcgcgttcgggtcggttcccgaatcgccgaccagcgaccacgcgtacgaatcgccatccttcggcgaaggattgacccacgtgaaccgcactttgccgtcggcggtgtattcgcccgtaagatcctgcacgctcggcacactgcccgacgtgatcgccgaatcgggatcgtcctcggcatggttctgggcgccatggttctgcacctgcaccttgctgttgtcggaagccgcatccatattcggcatgacgacggtgacgaacgccaacgccatcacgaccacggcggccgccgccgcaaccgtgacggccaacggcttcacccaccgggcatgctgtttcgcaatcggggcggactggtcgaatgcggaagtctgcgcgtacatgttctgcggataatccggcacaccctcgacggtggtctgcgcggcacggccatacaaggcctgttgcacgcgctgcatgtcgcgcgcgaactccaacgcggaatagtaacgatcctcgggcgtacggctcaaggccttacgcaacacccgttccacttcgaccggcacgtcgggacggttgagcttgggcagcggattgttgagaatgacggacttgagccgttcggcccgcacctgccgttgggaatcgcccagcacatcggcgtagaaatactcgtacggcgattggccgatcagcatggcgaacagcgtggcgccaagcgaatagatatcggacgattcattgccgccaccgccttgggcaagcacctccggcgcggcccacgcgatggtgaagccgacacccggacgcccatagacggacccggcgatgccgaaatcggcgagcatgggcatattgtgcgcgttgatgagaatattgctgggcttgatgtctcgatggatgatgcctttgcgatgcgcggtgaacagcgcgctcgccagatcgataccgacggtgagcatctggtcggcggtgagacggccatgctcgaggaacgtcttgtaattgccgcccggagcgtattcgaacacggtgtagccgcgcccgttgacggtcacgccgttctcatagacggaaagaatgtaggggtgtgtggagatctgccccatgaaattcgcttcggaacggaagcggaccgcggcacgtgggtcgagcgtgttcttgctgattttgatggccacctgacgggccggggaaagctgctggtacaggtacacgtcggcttcggaaccggagcccagccgtttgatcagtgtgtagccgggaatctgagggggaatgctccttgaggcttccatgcttcctctttcctgtagttcctgcccggttccgtgcgttgcgtctatgcttcgactgtactcgtcgtcacgggcaggccgtctgttcgctgttgaaccttcccgggctgcgccgctagtcaatcttattggtggcggtgtccgaaaaactttgtagagggtatcgatgtccatatataaagatggcggtgtccacgatgacgttttcaggacggcttcggacgatgatatgcgattcgtggccggaccgttcggctaagctggggagacatgatggatgtggacgatctcgatgacgcgacattggttgcgggggtaccccgcagcggcaagacccggttcgcgcttgacatgctggtcgccgcgatgaagcggcatggcgacgcgtacgccgtgatgacggtctccggcagacaggtggccgaccggctcggcgacaccgtgatccgcgaactgtccgcgatctcgcaggcacgccccgccaccaccctgccagccgtcgcgttccgcatcatgaccgccgtgcgatcgcatgccggacaacccctgccgaaactgctcaacggggccgaacaggacgtggtcatccgccgcgtgctcgccaggcatgccgaacatgccgagcacggcgacgaatgctccacctgcgcgctattgcgcacctacttcgtggtcgccgactggtcgggcatggtggtggacgacgccaccgacgccttcgccaaccagctgcgcgacatgcttgcccgcatgaacgagatcggcgcgaaaccggaactcgaagacatgctgatcgcccgcgctgccgacgagcacggcacgctcgacgaacgacgcgaacgactgcgcgtgcaatggcggctcgccttcgcgctgcgcgccgaatacaaccaggccatcaacgaggcatatccggaccaataccgtctcgacgcctcgcagctcatgatcgacgccgcggccgccgtgaacgaagccaaaacgtccgacctgccgaaactcgtcatcgtcgacgatttccaggacgccacactcgccggcttcgactttctcaccgcattgcgcaaccgtggcgtgcgactgttgctcgtcggcaaccccgacgaggcggtgcagacgttccgcggatcgtaccctgaatatttgttcaacatggcgcaatcgcgattgggcgcgcgactggtacggctggaaccgtcccatatggccgaaggcacggacctggccgcggtggcgagccgcgtgagcctgaccatcgccagcacggaatcgaccgacgacgcgctggcgaaccgccccggcaaaatgccggccatcgccataccggagacgcacgacggcagtcttgaagccgcgatgtaccgttccaccgtcgaagaactcgacgacgtggtgtggaaaatcaaaaccgaacatctcgaacacggccgcgactggaacgacatggccgtgatcgcccacgacaacgccaccgtgcgcacgttcggcgaacggctacgcgccgacggcgtgcccgtacgctattcgagcgtgacccaccccctcaaggacgaaccgttcgtgcagggcctgttctccatgatcgaactggccgaactgaaacggcaaggcatcgccacctcgtccatgaacctcgacacggccggcgcatacgtgcgctcacgcgtcgcatcaatcatgaactcgccgctgatcaccacccccggcgaacgtccggctcggctgtgcgtggtcgaatcggcgatgaacgcgctcggctcgctggccacggttttgcatgacgatacagccgatccgaccacgtccgacacgtccggacgcgcgctgctgccacagctgatcgacgattggaacgattacgtcgaagccttccacaccgcacgcgcggcggcatcggcgtcggacgcggaaaacgctgccggcatgggcctgccggcaatcgacaccgacgaccggctgatgacgggagagcgtgccgctgaggatgcggacgaaccatccttcggcatgaacgcgctgtacatcctgctattggaaggcgacactgaccgcgtgctcgacgcgatcgcctccgtactgggccgcaaagacccccaagcgcaagccttcgcacgcctgtggaaagcgctcgacgataccctgcggtcggaggcacgcctgacatcccacgaaccgcaatacgtgctcgactgtgcatggcaggcgttcggcaaagccgaaatctggcagaaaacggcgttgcgcaacaacgccgaaggccgcgcggccaacgaccggctcgacaccgcgatgcgcctgttcagctacgcgtccggcggcgaatcgaacggcgtgacggcagcgcacaccatcgacgcgttcatcgaacaggtccgcgcgctcgccatcgaagccgactccctggcgcacaccgcgccgatcgatcaggccgtgacgctcgccacgcccgccggagctgccggaaaacattggaaactagtattcatgcctgcgctccaacaaggccaatggccgaacctcgcgccgcgcaacaccttgttcggcggggaggagctcgccgacatcatgctgcatggacgactgtccgacgacatcgtcacctccgcaggccgcgaaaacgcgcagctcgccgcggtgctcgcctccgaacagaaaagcctccttgtggcgctcacccgcgccgatgagcgcgtgacggtaagcgcggtcctcaacgaagaccatgtgccgtccgacttcctctacggctacttgccggaatggttcgaccgcgaccgggatgccgatgcggaaacatgcgtgtacacggcggtcggcgaggccggcgaatacgcgggactggaagccgacccgcgtggcctggtcgccgccgcgcgaagcgtgctggcccatgtgccggccgattccccccaagcgcgcgatgccgcgcaagccttggcgttgttggcatcgcatggcatcgtcgccgcgaatcccgacaattgggcgttccttacggaacatgcgggagccgacgatatgacggaaatcgacggcaagatggaatctgacgggaaaacggagcatgccgacaaggcgaagcttatcgaacaaccggaatccatcgaaaaaacggacggccaatccgacgtggtcaccctttctccatccgccgtggacagtttgtgggcgtgcccggtgtgctggatgctggagaaccgtttcgccggcccacgcatgggcagcgcggccaccagcttcggctcgctcatccacgccgtcgcgcaacaggccaccgaagccggcctcgacctgccccaaaaccacaccgcggtaagcgacgaggacaacatcgacgaaatcacccaatggatgatcagccgatacaagaccctacgtggcgacctcaacgccatcgacgaccccgaggaacggtacaaggcgctcggcaaggacgcgaaggcgtcggtcgcattgcgcaacatcgccacatatttcgtcaagtcgaaccgtactggatacccgtcgaacaacaccgaaaccatcaccgtgggaacattggaccatgccgaagcggaacggcagttcgccgcgcgattcgacttcgacgacatcctcgacgcctacaacgccatcgacggcaacgctccgatctcccgcgacgaactcatcgccatcatgggcgcgctcgtcgacggctggccggaaaccggcatgagcgaccggctcaccgtacgcctgtcgggcagaatcgaccgtcttgaacaccgccgtaccgcagacggccgcgaacaggtacggctgatcgactacaaaaccggcaaagtgccgaacggacgctccctgttcagcgacctgcagctcgtctgctaccagctgggcctcgcattcccggaacacggcggaaaacgcggcgcgcaggcgatcgcagccatgccggacatcacccaaagcgccctgttccacgtcatggaatacgcggcacccgcgccacgcaaagggcaaggcgacgaagcgtaccaccagcaggcgctgttcgccggcggaagcatcaacgcgggcgatttcataccccgcaaatacgtgcccaaaatggccagcgtcttcaccagcggcctcgacgacgtcgaacggccggcgcaggtcagcgaagaacattggaagcaacttctggaatcgcggtcgaagatgacggtatggtcgctgaccatgatctcccgcgtcttctatgcggccgcggcgagccgggccacccgcatcaccgcgcgtccgaccgtggaacacgtcggatactgcagaacgtacggcagtggggtctgcccggcctgccaaggcgagcagaacaccgtattcgaaaggaccgtggcatgaacgggagtaacggtatgaacggaagcatatcaacgaacggggccacagcaaagggcgatgcgatgggcactgtgccggccgccacgccgaaattcaccgacagtccggaacaggccgccgtcatccaagccccctcatacgaggacgtggtcgtggtggcgggcgccggctccggcaaaacctacaccatgacccgccgcatcatcaccctcatcgaccagggcatcagtcccgagaagattctgggcctgaccttcacacgcaaagccgcctccgaactgctttcgcgcgtctccgctgccgtgacacgcaaccaagccggacgtggtacgcgcgtcgccttcctcaaaccggaagtctccacctatgacgcgttcttccaaaccatcgtgcgccaatacggcctgctcgtcggcttcgaccaaaacacgcagccattgagcgaagccggagcgctgcagctcatccacaccgtgctcgacaagcacatggaccagctcatggccttcgaccaaggcggcgacgaactcggcaaattctccaccatcgccggcaacgtgttcaccctatccaacgccatcgcaggagccatgatcggcagcgactgcaccagcttcgacgaagccgtggaacgcgtgcgcgcatgggataaggcgttcgtggcgcaagtggccaaagcgcttgaagacgaggacgttcccgatgacgagccgaaagtgggcaaggctccgaaacagaagaaaaaggaatccgacaccgccttcgaaacccgcatgcgcgaataccgcgcccaatgccaccaactctgcgtccacaagaccgcgcaattggccggcacggcccgcaaacgcgacctgctactcgacctcgtggccgactaccacgccgaaaaacgcgccctcaacatggccgaattcagcgacttcaccatcgccgcattccaactcgtcacccgattcccctccatcggagccacctaccgcaaacgctacacgcacgtgctgcttgacgaataccaagacacctccaccacgcaggcggccctcctgaccgcactgttccacgccgattccacccatcgcagcgcggtgaacgccgtcggcgaccccttccaatcgatctacgcatggcgaggagccagcccaggcgcattccgcatgctgcaacacgacttcggccacgacgccaccgacaagccctacacgctgaccgtcacccgacgtaactcgcgcatggtgctcgaagcggccaacaatctgacgaaaccattgcgcctgcccgccagacgtcgcggcagctcgcttatgcgcgaagtggacgtgcccccgctcgccaacatcgacaatgcccccgaaggtacgctcggcgtgctcggctacgccacattcggccaggaaatcgacgccatcgtacgcttcgccaaacaagcgatcgcactgcacacgccaaccgaaaacgagctcgccgacggagccaaagacaaccgtccgcacgtggcgctcctgttccgctccaaaacgcagatgccagcctacgaggacgcactggaacaagccggcctcaccacactcgtcgtcggccaggccgcactcctggaacgtcccgaaatcaaagacatcctcgccctgctgcacgtcgtatgcgaccacaccgacagcgccgtgctcatgcggctgctcgccacgccacgattcggcctgtccgccgacgatctgcaggcgctcgccggcatcgccgaacggctcaacaccgcgcaacgctaccgcgcgctcgtgtcggccggcatcgtggaggcggatgcgaatccgtccgacgccgacatccgcgccaccgtgcgcgcctaccgcgaccaagtgcccaacgccgtcttcctgatcgacgtgctgctgcgcggcgatctgcggcacctcgtcgacggcgtattgagccgtacgggagccgcgagcgtcatccacgccggtcgcgtcatccaacaggtgcagcgcacggccggccatccgttgccggaagtggtacgcacggccatcaccgcgctcggactggacatcgacctgctgctcgccgaacggatgcggcatccggatgccggcaatcgtgccacatcgcatgccgcttcgtcactcgacgcgatgctgtctctggtggacacctacttgcaggaaatcgccgcgcagggcacgccaagcctgcgcgcgttcatctcgtgggtggattcgctgcgtgacgcgtccgacgacaacgccaccgcaccagatacccccgtcgatgtggtgctcatgaccgtgcaccagtcgaaaggcctggaatggaacgccgtggccgtggtcggcatgcgcgacggcaccttcccgtccagtcaaggcgaccacctgagcgtcaaaacggacgaagaccatccgggcggtcggcgcgacggcgtatgggagccgccggaatacttcgaaaaagcccacacttggctggaagacccgtccgcggtgccggttccggtgcgcgccgacgcggatatcctgccacgattcccgcacgacgcgcccatcgggggcaatcccgtggaatcgctcgacggattggacgatgcggaagtgatcgacgacgaggtgttcggcaccttgcgaaccatggccgtcgacgatatggaaggaatggatccggcaagcctgtacctgacgcaacaggaggaatacggccgccgactgcacgccgacgaacgccgtctcgcctacgtggcgttgacgcgcgcccgctacgaggcgctgctcgtatacagcggatgcaacgagacgagccgcgactcccgtctggcggagggaaagaaaagcgccgcgccgtcgaatttctggctggagacgcgcgattcgatgaacggaatcgtcaccgcggtacgcgaaccggacaacctgtccgacgatgtggacggctccccgcacacgctgggacttgacctgcccgacggctatttcgtaggcgaacacgcccgcgatttcgagaatgccgtggtgggcgatgcgtggaacacgccgctcgaaccggtctcggacgaccatactttgccttggccgtgcgatctgagcgccgatgtcgccgacaagctgcgtgccgcggccgaacaggtacgtgccgtcgaatccgacgaaccgaatatcgctgaatccacgggaacgcagggcgacgttgccgatgaatccgccacgccatcgccggaaaccggaaactcactgctgcgtctcgccaaactgctcgtcgccgacgaacatctcatgccggaaccggacgcggctgacgcaggcgaatcgcaggacgccttcgacgaggccgtgcgtgccaaaggcgaacgtatccttgctgccggccgccaaaacgtcacctcgctgcaagcgcgcgccggctccatgggcgagcgtgactcccgcgcctactggcgtggtctggtccgtccgattccgcacgtcgcctcgccggcggcacagctcggcacgcggttccacgcatgggctgagcgtttcatcatggcggatgcggacgtcgacggcatcggcggtacggaaggtgctgccggcatggccgcgcagtcgcgtgcggaactgatcgcattgataggtgatacgcaagtcgacgcggacaacggcggcgtgcaatcgcaggacgcaccatcgcaggacgcccaattgcgagacgaacggaaactggccgcttggcagcgtcgtctcgtcgcctcgccgtgggcaaaacgacgtccagcatgggcggaacgccagctcgtcgtcgacatgccccagctcggcaccatcgtcaacggcaaactcgacgcggtgttcttcggcggtctcgacgaaacggacgagacgaaacgctacaccgtggtcgattggaaaaccggcgtaaaaccacgcaaaccggacgaaatcaaggagaagctcgcacagctcgacctgtaccgcctgctgctcgcggcgatggaaggggttccgttggatgcaatcgacgcctgtctctactatgtgagtgagcctcacgaggccgatcgggagcttgacgccctcgacaaaacagaagaagagatccttgccgagttgagctacggaattccgcagcaatccgacaacgactagtgccggtgcgcaatggctccttgaccgaagaaagcgggggagcggcgctttccggcctgcctgcgggagaaaccgctatgcaggcagcgttgtggaggaacgccgctaccctcgtgcagcatgtgtgggcgggcgcacatgccggacgcaacgacagttaaggagtgtttgatatggctgcgaacagcgcaaccgcaatcccgaacgccggcatgggtgccggaacaaacaacgcatcggcaatcgtcttccgtcccatcgtctggggcgatctggacgcggtggtcgacctgttcgaccgtacctggccgcaggatgtggacaaggtcggcgcggacatgtcgcggctgatctcccgatatttcgtgctgcactacctgctgccgaccacgttcgccaacggcgcgttcgccgccgacggcacactcgcgggcgtcacgttcatccgcgtcgccggcgaggcgccgcagctcgacgaaatcgaagtcggcgaggaaatgaaggccttggaacgccgcatcgacgccgatccggaggccgccaagcatatggcggcgctgaaatccggcttctcggtggaactcgatctggaacgcgaagggcgcgccaacgaaaccaccatgggcgagctggaactattcatcgtcaaccccgacgtgcgcggccacggtgtgggcgggcagctttggagacgcatgcaggagcatttcgccgcatgggacgtgcccgcgttctacctgcacaccgattccgactgcgacgtgagcttctacgaccacaaggggttggactgcatcgcgcaccgcacggcaagcgagacggtcgcccggctcggcggcagcgccgacggcgaagtgccgccactgttcgacgacatgttcatctaccggggaaaggtgacggcgtgacgagcgcgaaaccgcaatcgcaatcgcacgaaccgcacgaatcgcagaaaacgcaatcgccatacgcgcagcttttccgcattcccggcacgaaggcgttctgcgtgtccggagccatcgcgcgactgccgatgtccatgatgggcctcggtatcgtgctcgcgctcaaccacatgtacgacaattggacgatcgccggcgtgatgagcgccgcgtacgtgctcgccaccgccgcggtcacgccgctgtacgcgcgcctgttcgaccggttcggccagcgcaaggtcggtccggtgatcctgacggtgcaggtcatcgtcatgctgggcttcgcgttcgccgcactgatgcgcgtgccgattccgctgctgttcgtgcttgccgtggtcatgggcatgacgcagttctcgttcggcgcgctcgtacgcacccgttgggcgtacgtgctcgaccgcgccgacaaggaggacctgctcaacaccgcgtatgcgctcgaatccgccatcgacgagatcgtgttcatcttcgggccgattctggcggctttcctggccgcgtccgtgcatcccgtatcacagctgttcgtgccgaccctcgcctgcgcgttcggcggtgccgtgttcttcgcattgcgtgacactcaaccgccggtattgcgcgaaatcacggtcgtcgcggccggtacggacgatgctgacgtgcgattggcggccggcggtgccgctggtgccgcggtttccgcggaccgtttcgatttggatcggctcaagacgggcgatcgcgaccgcaggaaacgcaacgtgctcacctatgcgggtgtgctgccgctcctcgccgtgttcatcgtgttcaacatggcgttcaccgcgttcgacacgtccatgaccgccgtcatgaaatcgctgcacctcgactccgtgctcggcgtgcagctggccatgctggccgtcggctcctgcatgggcgcgctggtcttcggctcgcgcgagctcaaaggctcccgctggcgtcacatgatcatgttcctcgccttgatgaccgtcggcttcgtggtgatccacctgtgccagggcaacctgatcgtgatgggactggtggagatcctcaccggcctgaccatttcgccggtattcgcctccggcaacctcctcgtcaaggagaccgtgcccgaggaatcgctcaccgaaggcctgtcctgggtgagcaccgccggcacgatgggcgcgtcgttcggctccatgatcaccggcatcgtgctcgaccatttcgatccgggcgtgggattgagcctgcccgccgtgttcgtgggctgttcgattccgttcgcgctgatcggctggctgctggtgcgccgccgcggctgaccgacgttcgatcgtcaagcgtcatagccgcctgcctccgcgtcgaagcgtctctttagattcataagtggaacacgttatggacgcggacacgcgatttcgaacacatgcgcacggcaaacgtacgacatgcgcaacatgcgcgtccgcgaaaacatcaaggagctgcaatgatcaaggtttccgtagtcggcgccaaaggccgtatgggctcgcatgtggtcgacgccgtcgattccgccgccgacaccgaactcgcgctcgcgctcgacgcaggtgacgacctggccgccatcacccccgaaaacaccgacgtcgtggtggagttcaccgtgccgagcgtgtcgctgggcaatgtgctcgccctcgtcaagcagggcgtcgacgtggtggtcggcaccaccggctggaccgaagagaagctcgaccaggtgcgtgccgcgctcgcagcagctccgcgtgagggccagagcgtgttcatcgcgccgaacttcgccatttccgcggtgctcgccgaccatttcgcaaaggtcgcggcgccgtatttcgaatccgcggaagtcatcgaactgcaccacccgaccaaggtggacgctccgtccggcaccgctttccacactgcgcagggcatcgccgaagcgcgcaaggcggccggtctcggcccggttccggacgccaccgaaaccgacggcggctcccgcggccaggtggtggacggcatccacgtgcacgccgtgcgtcttcgcggcctcaacgcccacgaggaggtgctgttcggcaactccggcgaacagctgaccatccgcgccgacagcttcgaccgcatctccttcatgccgggcgtgctgctggccgtgcgcaaggtctccaccggaacctacccgggtctgactgtcggcctcgaccacttcctcgacctgtaaccgtaattcttttttcaaactgccgacgggtgcatgtgtcttccgtcggcagttttttatggcggatctgttccgattacttggcaaggcgtgcgatggcggcgctgacttccgccagcttttcgtcggcaacggtaccgccctccgccgcggctttggcgacgcaatggtgcagatggtcgtcgagcagcagtagcgccaccgacttcagcgcgctgtccgctgcggaaatctgcgtcagaatgtcgatgcagtattcgccgttttccgtcatctgccgaatgccgcgcacctgcccttcgatgcgattcaatcgtgcgatgatcctcttctggtcgcttgcgtacccatgctgtgtggcgttcatatcgtcctcctcgctgcgctgaaaattttatctacggctgaagtttgctcgtccttcttgccaatataccctataggggtatattgtgatggtgtttgccgaaatcgaaggccaattacggacggaaggcggctggaatatgcacatcgcaatcgcgcttattgtggcgctgctcgttactgcgggcgtgctgtggttcttcttcgcgccgcgcaaagcgtatcgtgcgccggtgcgcgacggcgtgcaggaagcggtcgtcgaagtcaaaggcgggtacagcccggccgtcgtcgaagccgaagccggcgtgccgttgcggctgatcttcgatcgcaaggaagacggcgaatgctcgtcgcatgtcgtgttctccgatttcggggtcgatcttgcgttgcccgccttccgcacgaccacgctgacgcttcatcccgaccagccgggcgagtatcccttcgcatgcggtatgaacatgctgcacggcacgttgcgcatactgccgggaaagcatgcaagtgtcggtgccgccgccggttccgcggttggttccgtcggcgccagtatgtccgattccggcgattcggacattcgcgcgactgctgacggtgcccacgcatccggttccgcggaaacaggcgtgcaatgcgcgcaaaaaggcgccgtccaaacgtccggttcgggtgattcgggcaaatcgcgcggatcggaatcggaaattcgcgccctcatcacccgtcttatcgtggcggccgtctgcacgattccggtattcggctccaccatgctcatgctgtatccgatgccgaactggctgcagttcctgctgatgctgccaatcgtcggctatgcggcattgccgattttccgcagcggtttcgccgcgatcgcccaccgctcgccggagatgaacgcgctcgtcagccttggtgcgctggccgcattcgcctactcctgcgtggtcaccttcgcaccgaacgtcctgcccgagaacgcgcgcgaaccgtatttcgaagcggtcggtgtggtcgtcacgcttatgcttgtcggccagctgctcgaagcgcgcgcccgcaaaggcaccggtgaagccatgcgcgcattggcgggtctgcaaccgaaaaccgcccgcgtggtgcgagacggcaaggaaaccagcatcgccatcgatgacgtgcgcgtcggcgacatcatcgccatccgtcccggcgagcagctgccggtcgacggcatcgtcatatccggcacctccaccgtggacgaatcgatgatcaccggcgaagccatgccggtcgccaaaaccgagggcagcgaagtgacgggtgccaccatcaacggtggtggctcgctgcggtaccgcgccacgaaagtcggcaaggacaccgtgctcgcgcagatcatcggcatggtggccgccgcacaaagctcgaaagcccccgtgcaacgattggcggaccgtatctccggcgttttcgtgccggccgtggtactcatcgccgtatggtcgtgcgcgctgtggttcgcgttcggccccgagccgcgtgtcacgcacgcgctggtcgccgcggtgtcggtgctgctggtcgcctgcccgtgcgcgctcggactggcgactccgttgtcggtgacggtctcgactggccgcgcggcccgtatgggagtgctggtccgttccgccgaagcgttggaaacgtgcggtaaagtcaatgccgtcgtattggataagaccggcacgatcaccgccggcaaacccacccttaccgatgtgctgccgttgggcgtgtggcatcggcgtcccgatgatttgctgacgattgtcgccgccgccgaacgtgattccgagcatccgctcgctgctgcgatcgttgccgcagctgcggaaaaagccgacgtcgcggacgttgcggaactcgcgcaaaccaccgattttcaggcgattgccggccgtggcgtcaccgcgcgcgtcaccttccgcggtctgccgcacaccgtcgccgtcggcaacaccgacctgatcgacgaccttgacgtcgacatgcccgacattacgtccgatacctccgaaattgcctccgagaccatccacgatacgaacctcgacgccatcatcgccgacatggaactcctgtcacagcaaggcaaaacgccgatcctggcggccatcgacggccatctcgccggcatcgtcgccgtcgccgacgtgccgaaagccgactcgcgccaagccgtcgagctgctccgcaaacgtggcgtcgaagccgtcatgctcacgggagacaatccgaccaccgcacgcgccatcgcaagccaggtcggtatcgacgaacgtcatgtgatcgccggcgtgcggccggaacgcaaggccgacgaaatcgcaaaactccaatcgcaaggctatacggtggcgatggtcggcgacggcatcaacgacgcgcccgccctcgcccgagccaacgtcggattcgccatcggcaccggcaccgacgtggccatccaatccgccgacgtgacactgatgggcggatcgctgatgggactcgtgcacgcgctcgacctgacgcatgccgccatgcgcaacatcgcgcagaacctcggcttcgcactcggctacaacagcatcggcatcgcgatcgcggccggcgtgctgtatccgttcaccggaacgctgctgaatccgatgatcgccggcgccgcgatggcgttctcgtcgttgtgcgtggtgacgaacgcaagccggctgcgcctgttcgatccggacgcggaggcggcgaaaaacaagacgtatcgggtacgcaagcccgatccgagcaagaataatggcaaccagcacagtcggaaaggaacgatcatgggactgttcagcgatcacaaggccaagaatgaagccgagaacatgggtgcgatgggcgccggacactgctgcggcggtcatgacggccacggcatggcttcgaatatgggcgattccgcggcgaacgttgcgaaggatccggtttgcggcatgagcgtcgatccggccaccgcggccgcgacccgcgaatacggcggcgtcacctactacttctgcaaccccggttgcgccgacaagttcgcccagaacccggccgcctacctgggctgagacctgattctcgtccgtccccaatctgccgacatcgaatgacatccggccgtcggcgggttggggatttttgttgaatggttgatttacggattccgattcacggacgaacgataagattcccctcccgcactccggagagcgcgtcccgccccgctacaaacgtgcgcgtgacgacgccgttaagcgtcatgccatcgcaggcgcagatcggattgcggctttccaaagcggtagcatccacaacaaaccgttcgtacgggcgaataatcgccaaatcggcccgcaatgccggcgttatatcgccacgatcgtcaagtcccacaagccgtgcggtgttgcacgacatccaccgcacgacgtcggccaaactcaagccgcgccgcatcgcacccgtcaacaccgcgcggaatccgacctgcagactggaaacgccaccccacgcggtggcgagcgtgccggctttcatatccgcgctggccggggaatgatcggtgacgacaccatccaacgtgccgtcggcaagccccgcccatagcgcgtcctgctcatgcagatcacgaatcggcggacagcatttgaccgcggtggcgttgtcgggaatatggtcgcaatccaacgtgaggtaatgcggacaggtctccgcgctgaccggcagtccttcggccttcgcccgccgcagcacgtccacgctcagaccgctggacacgtgcagaatatgcgtgcggcagccggtgcgtgccaccagccgtacgatcttgcgcaccgcgttcgcctcgcattcggccgggcgcgatgccgcgttcaacagtgttcgcaacagtcggggattttgttgccgcgttagtcgcccatttcgctggtttggcaccgtttcttctatgccgaatccgcccgatatgcgatgttgattgtgtggggtaatctgtttttgccatggtcggtcatctcctgatggtgggtcgcgttgccaagaggcgccgccactgcctgtgatggatgcatttcagtgcttacggcatctgaaattcttcattcgtcgtgacagttgtcggcggccaaacctggtgaaacccagaaagcaaggggtagcatcgtcaggagagcggatgcgccgcgtgagaatgtactgcagggaagggcgatgagcgtgacttctggaattatgctttcagacaatatgggggcttcgaaggacgccatggacgaggaaggcaatgctgccgcggacctcggcttggtggcgcgcatccgggaatccttcgattcgctgactgcgacggaacgtgaggccgcgcagttcattctgggtcatctgaccgacgtgctggtctgcaattccgtggaattgtcgcagttgagcggcatctcgcagccgacgctcagccgcctgtatcgcaagctcggctatgcgaacgcgggcgaattcagacgtgacgtgcgtcgcgtccatcgtcctggctctccggagctttcacggcacacccagtgcgacgatttggtcgccgaccatctgcgccgtgacgaggaaagcctgaaacgcacgtttgaaggcatcgaccgcgcgcaactgtcatccgcatgccaagccatggccacggccccgcatgtggcggtggtcgggtaccgcagcggctatcccgtggcgctgcacatgcgcgaacagctgatgcggctacgcggaaacgttgatattctgccgaatccaggccagtccatagccgaagatctggttgattatgcggcaggcgacgtaatcgtcatcatcggcgtgggccggcgtcttcccttcttctcgcggctcatcgacgtgatgcttgagcgcggcctgaccgtggtggtgattggcgacatttcggcgcgcaacgccgtcatcggccgtaacgtcgccttcttcaaagtggtgctgaactcccacgtgctgacgagcttcaccgcggcgttcgccctgatcgccctgatggtggacgaagtcggaaaatgcctcgtcgataccgaagacgaggtgcacgcgcgtatcgaaggcatcaacgattgcttcgatgcgctcaatgagcttgaagattgatagggaaaatctaggcgcggcacgtcccgttggaacggcggtaaacggaagtggaagcgggaatgggaacggaatgaattcaaaacgaaacatgctggcgtacgaccggtcctccaccggattgtgggtggctttgattttcctcgtatcgctgaatctgcggcccgccatcgccgccgtcgggccggtcctcgcccaaatgggaaccgaccttgcgtggggtgagggcgtgcagggcgtattgacggcgattccgctgatcgccttcgccgcggtcagcccgctggtcacgttccttgcacgccgcatcggcatcgacatgtcgattctgctggccctgctgtgcatcgcggcgggcgacgccatccgctcgttcggcggcggcgttggcatctggctgggcacggtggtgttcgcttccgccatcgccgtcggcaacgttctggttccggtaatcgcaaaacgtgactacgccggccatgtcgcgatggcgaccggcgtctattccggctgcatcaccgccggcagcgccaccgcaggtttgctgtccgcgccgcttgcgcagatgtggggcggttggcgtgcgtcactcgccttctggagtgtgcctccgctggttgtcgccgcgctgtgggcgttgcgtatcctgcacaatcgcaaagtcgttatcgcttccgccggcggcaccatcgaaaccagcgatactggcgatatcgatgatattggcgatcgcagcacgacggccaacgcacaaaacccgcattccgcacagcgaccggcatgttccacgcaatcgtcgcatggcgtgttcgcccgcgtgctgcgccgtccgatgacgtggtacgtgacggccttcatggggctgcaatcatccgctttctacaccatgtccaattggatgccgtccatctccgcatccatcggctacgatgcctccaccgccggcgtgcatctgttcatcttccaaggcatcggcatcctttccggcttggtcattcctaagctcatgaacgtgcgcggcaaccaggtctgcgcggcgctcaccgccagcgctcccatgctgatcgccggccttggcatgctgctgttgcctcacctcatgccggtatgggcgttcgtcggtggttgcgcgcagggcgcttcgctggtcgtggcgctcgcactgatcgcgctgcgcgggcatgacagcgccgaaaccgtggtgctgtcgggcgtcgcgcagtcgttcggctatctgatcgcgtcgctcggcccgcttatgttcggcgtgctggtccaggccaccggcggccaccatgtgccgctgatggtgttcacgttcgtcgctttcctgcagtgcgtcgtcgcggtcatcgtcggcaggccttccaaaatgtgacttttcgcgtctcatgaaatcgcaagcgtccgcagagggaagtaccgttagccgtatgacaagccctaagactgacgacggtacaatgcatctgctcgatcctgctcccttcggacgtatccttccggccatggtcacccccatgaaggccgacggagccgtagatttcgaagccgcgcaacagctggcgaggcagctcgtggcggatggtgccgacggtcttgtggtcaacggcaccaccggcgaatctccgaccacccacatggaggagaaggtcgagctggttcaggccgtcaaggaagtcgtggacgtgccggtcatttccggcgccggttccaacgacaccgcgcacaccgtgcgcatggtggagcagacccaggaggcgggcgccgacgcggtgctcgtggtcgccccgtactattcccgtccgtcgcaggagggcgtgttccgccactacaaggcggtcaacgactccgcggacaagccgatcatcgtctacgatgtgccgggccgtaccggactgcacatccagctggagacctaccgccgtatggccgaactcgaccacgtcaaggccgtcaaggacgccaccggcgacatcgcaggcgcggtgcgcaagcgcatggagaccggtctgacctggtattcgggcgatgacggcctgttcctgccgttcctgtccgtcggcgccgtcggcatcatctctgtgatcgcacacgcggccgccggtccgatgcgtgacctcgccaacgcgttcgatcgtggcgatatccacgaagcgcagcgcatctccgtgcagctggcgccgctcgtcgaagcgatgaacggcaacggcttccaggccgtgatggccaaggcctcgctgaaggtgcgtggaatcctcgactccaccgaaatgcgcctgccgaacgtcggtccgggcgaagcggaactcgtgcgcgcggaaaagggcatgcgcgccgcgggactgctgtgaaccgaatcgcatgatgcgactggcctgtcgcgcatgaacgccggcaggcacccaaattcctcgtttccgcataggcggagacaattagtaatagaaatccaactaggaaatggctacagaagaaaccacaaagacaacaacacacaagcgcggcagcaaggctgccaagcgcactgaaaccgcagtcaaggcatccaagaccaccaaggccgcgaagtccgagaagaccgccaccaagaaggccaagtcctccacccgcagccgtggcaacggtggctcgcgcaacggcggctcccgtggatcccgtggcggcaacggttcgaaccgtcgcccgtcgcattccgcgccgcaatccaccgcgccccagcaggacgaggtgctgatcgccccgccgaagtaccgcaagggctccatgcgcatcgtgccgctcggcggtctgggtgagatcggccgcaacatgaacgtggtcgaatacaacgggcatatcctgctcatcgactgcggcgtgctcttcccggaagaggagcagccgggcgtggacctcatcctgcctgacttccactacatcaaggaccgtctcgacaaggtcgaggcgctcgtgctcacccacggccacgaagaccacatcggtggcgtgccgtacctgctcaagctccgcccggacattccgctgatcggttccaagctcaccctcgccttcgttgaggccaagtgcaaggaacaccgcatcaacccgacgctcgtcgaggtcaagggacgcgacaagctcaaggtcggcccgttcaacctggaattcgtgaacgtcacgcactccattccggacgcgctcgccgtgttcgtgcagacccccgccggctcgctcatcgacaccggcgacatcaagctcgaccagctgccgctcgaccaccgcatcaccgatctggtggaattcggcaagctcggcgaaaagggcgtggacctcctgatgatggactccaccaacgccgaggtcccgggcttcgtcaagccggagacctccatcggtccggcgctcgaccaggcgttcgcacaggccacgcgcaagatcatcgtggccagcttctccagccacgtgcaccgcgtgcagcaggtcgtcgacgcggcccacaagtacggccgcaaggtcgtgttcgtcggacgttccatggtccgcaacatgtccatcgcagcagatctgggctacctgcgtctgcccgaggacaccgtcatcgacctgaagcaggcccatgacgtgcaggacgacaagctcgtctacatgtgcaccggctcccagggcgagccgatggccgcgctcggccgcatcgccgacggcaaccatcgtgacatcaccatcaacgagttcgacacggtgatcctcgccagctccctgatcccaggcaacgagcatggcgtctacaaggtcatcaacaagctcgtgcagctcggagcccgcgtggtcaaccgagacaacgccgccgtgcacgtctccggccactgcaacgaaggcgagctgctgtacatgtacaacatcgtcaagccgaagtgcgccatgcctatccacggcgaaaaccgccacttggtggccaacggcatgatcgccgtcaagaccggcgtcgatccgcagaacgtcgtgctggccgaagacggcgacgtcgtcgacctgtaccacggccaggccgcggtcgtcggctccgtgccgtgcggctacgtctacgtcgatggcgattccgtcggcgaactgaccgacgaagaactcgagaagcgccgcatcctcggcaccgaaggcttcgtgtccagcttcgtggtcgtcgacaccgagaccgcggatgtcatcaccggcccgaagatctacctcaacgcggtcgcggaagacgaaagcgagttcgacaaggtccgtcaccagatcgtcgagcagctgcaggacgcgatgatgcagggcacgcgcgacacctacaagctgcagcagatcatgcgacgcacgctcggcggctgggtggcacgacagctgcaccgcaagccgatgatcgtccccgtcgtcgccgacatcgcgcaggacgtggatgacgcgatgggactgaacgccgcgaaataagccgtaaatttaccataaattgaatcaaggcgacgtgatcggcacaactgatcgcgccgccttctgttaccagaaagaaggagtgacatgccaggagcaaacctcacccgaatcgaagcggaagaacgcaaaagcatcatcgccgcgccaatccattacacggtcaagcttgacctgacccgcggagccaaggatttcggctccgaaaccaccatcaccttcgacgcgaagccgggggagtcaagcttccttgacctcatcgccaacgaagtcagcgagatcaccctcaacggcgaaaccctcgacccggccgaagcatacgcggacagccgcatcgagctgaagggcctcaaggagcacaacgaggtcaccgtcaaggcgatgtgccagtactccaacaccggcgaaggcctgcaccgcagcgtcgacccgtccgacggcaacgtctacctgtatacccagttcgaagtgccggacgcccgccgtgtctacgccgtgttcgaccagcctgatctgaaggccgtgttcgacttctccgtgctcgccgccaaatcctggatcgtcacgtccaacatgcccacctcctccgtgaccgacaacgaaaccgtcaccgaggaaggcacgctcggcgatcacgccgccgaaaccaccaagctgtgggtgttcgagctgaccccgaccatgagctcctacctcaccgccatctgcgccggaccgtacgccgaatggcacaccgaatacgccaatgaggacggccgcaccgtgccgatggccatgtactgccgccaggcgctcgccaaggccttcagcaaggacgtcgactacctgttcgacatcaccaagaaaggcttcgccttctacgccaagacctggggcgtgccgtacccgtacgccaagttcgaccagatctacgtgccggaatacaacgccggcgccatggagaacatcggcatggtcaccatccgcgaccagtacgtgttcgaatccaaggtcaccgacgcctatgcggaacgccgtgtggtcaccgtgctgcacgagctcgcccacatgtggttcggcgactacgtgaccatgaagtggtggaacgacctgtggctcaacgaatccttcgccgagttcacgtccaccctcgccaccgccgaagccaccgaatggaaggacgcctgggcaaccttcagctccggcgaaaagagctgggcgttgaatcaggaccagctgagcaccacccacccgatcgtcgccccgatcaacgacctcaacgacacctacgtcaacttcgacggcatcacctacgccaagggcgcctccgtgctgaagcagctcgtgtactacgtgggccgtgagaagttcttcaagggcatcaacaactacctcaacaagcacgcctactccaacgccaccctcgccgacctgctcgccgaactggaactcacttccggccgcgacctgaaggcgtggagcgcccagtggcttgaggaatccggcatcaacaccatcgccaccgaagtcgaagagaacgaggacggcaccatcaagcgtctcgccctgcgccagaccgctccggccgagcatcccgtgctgcgcgcccaccgtctcgccgtcggcttctacaacgaggatccggaaaccggcaagatcgtgcgcaccgaccgtttcgaactggacgtcgacggcgaactgacggtcgtcgacgcggccgcgggcaaggcacgtccgtcgctgattctggtgaacgacgacgacctgacctacacgaagctgcgtttcgacgacaagagcctcgcattcgcgacaagcaacctgtaccgcttcgacgacgcgctcgcccgttccgtgatctggctcgccctgtgggacatgacccgcgacggcgaactgccggcacgccagttcatcgacacctcgctggccgcgctcgccaccgaacacgagtccaccaccttccgttacgcgctggcacaggtcagcaccaccgcatggcattacaccgctccggcagagcgtgccgagatcgtgaagcatgtggccgacgaactgttcaagctggcgggtcaggccaaggccggctccgacgaacagttccagctcgtcaccgcctacctgggctacggcgagccgggcgacgaggcgttcgtcgccaacgcgaagggcctgctcgacggttccgtggcattcgacggtctggaaatcgacaacaacttccgctggaccatcatcaacgcgctgagcaccgtcaacgcgatcgaccaggcgggaatcgacgccgaactggccaagcgcgaaaccaccgagaaccgtgagttcgcctatggcgcacgcgccgtggccggtaccgccgaagcgaaggcatgggcttggaacgaggccctgcacaacgacgagctgaccaacatgcagcttgaggctgtggccggtggcttcgcagccaccccgcgcgccgacttggccgaaccgtacgccgagaagtatttcgaggtcgccgactggatttgggagcacaagaccttccacatggcggaagcgctgctcgaaggcctgtatccgggctatgccgatccggcgaagctcgtggagctgggcgacgcctggctcgcctcccataaggacgcggacaacgccttgcagcgcattgtgcgtggcaacgtcgaggcttctcaccgcacgctgaaagtgcgcgacttcaacgccgcgctctgatagcaggggcgacaggaacgttcccgcttaagagccgtcatgtcgtcgcacgactttgattttgggtgcgattttcaaagttgtgcgacaagcgtgctggctttcataccctctaactcttattttttgctggttttcaacggaaaatgatagttagggggtatttctttatcaagtgttgccgcacgacttgattttccgccttgaaatcaaagtcgtgcgacacgaaaagggcattgcgcgccgtgaaatgctttgaattgtgaagtgttatgcgattgcgtcgtcacctgctggtttcggcggcacggttgagtacgataggtcacggaaatatcgtttgcagatagcgaggatttgagactcatgccacgtatgttcggaaccgacggcgttcgaggattggcgaatagggatttgacggcacagctggcgctcgatttgggtgacgccgcggtgcgtgtgctgggcgatgacgagcggagcgaattcgaaagccgtcgccgtgcgctggtcggtcgtgatacacgagtttccggcgatttccttgccgccgcattgtccgctggcatgtccgccggcggcttcgacgtgatcgacgccggcatcatcccgacgccgggcgtcgcatacctgacgtccgtgctcaacgtggaaatgggcgcggtgatctccgcatcccacaatccgatgcccgacaacggcatcaagttcttcgcccgcggcggcttcaagctgcccgacaccaaggaagacgagatcgaagcggtgctcggccaggattgggatcgtcctaccggcgccggcgtgggtcgtgtcagccatgacaccgccaccgcaaccaacctgtacatcgaccatctggtttccgccatcgcgccggtcggtccggacaagtcgcagccgacgccgctgaagggcctgaagatcgtggccgattgcgcgaacggcgccacgtccgtggtcgctccggaagccttgcgccgcgccggcgccgacgtgaccgtcatcaacgcgtcgccggacggctacaacatcaacaagaacgccggctccacccatcctgagcagctgcaggccatggtcaaggcctccggcgccgtcatgggcgttgccttcgatggtgacgccgaccgttgccttgccgtggatgaggatggcaacatggtcaacggcgatcagatcatgggcattctggcgcgcgccaagaagaacgcgggcaagctcaaccatgacaccctcgtcgtgacggtgatgagcaatctcggtctgaagttggccctgcgttccatgggcatcaagaccgtgcagaccaacgtgggcgaccgttacgtgcttgaagagatgctgcgaggcgattattcgctcggcggcgagcagtccggccacgtgatcaaccgtgaattcgccaccaccggcgacggcaccctgaccgcgctcaccctgtgcaacgaggtcgtcaaatccggtaagagcctgaaggaactggccgccgacttcccgcagctgccgcagacgctcatcaacgtgccgaacgtggacaagatggccgccaagaccaacgccaaggtgcaggccgcggtggaacgcgaagagaagctgctgggcgacaccggccgcgtgctgctgcgtccgtccggcaccgagccgctcgtgcgcgtcatggccgaagccgaaacccagcagcaggcagacgaagtgtgcgatcgcctcgccaaggtcgtcgccgacgaactcaccctgtaagagcccgcaaggagatatgccccatgttcggacacaactcgaaagtggacctcgaactcaaccgcgaggtcgaaaagctcatcaaaaccggcggcaaagagaaaatcatgccgattgtgcaggccggcgaaccggtattacgccagcagaccatcgcctacgacggccagttgagccgcaaaacgcttgacaagctcatcgacaccatgcgcaccaccatgctggaagcgccgggcgtgggcctcgcagccacccagatcggtctcggtctggctttggccgtcgtcgaagaccacgtatgcgaaggcgatgatggcgatccgcgcgaagctgcggaattccccttccacgccatcatcaaccccagctacgagccgatcggcaccgaaacccgcagcttctacgaaggctgcctgagcttcgacggttaccaggccgtacgcaagcgttggcttgacatcaccgcccgttggcaggatgaggacggcaacaagcatgaggaacatctgcatggctggccggcccgcatcttccagcatgaaaccgaccatttgagcggtgaactgtacatcgaccaggccgaaatccgaagcctgaccaccaatgagaaccttgaggatttctggtgcgaggatccggtaccgaccgaagcggcggccgaactcggcttcgaactgtaatcgcgtaaacgaacgagacaagaacgatgaatgcctcccaggcgaacacttgggaggcattcatcatattcgggattattggaatgttcgaaacatgagtattccaaatattccaatatttcagtattccggattcactagcacatcgtacgtatccgtgttccgctcggcatccgaacgcagatcccagccaggcttgcgcattccatacaacaccagcggcggtaaaccgagcacaagcacgactacagccacaagaatcgcatatgaaacgctatccaaaccggtgaaaccagccggtctcacgaaagtcaacacgaatgccgcggcggaagcgacgaaaccgacgcccgcgaccaaccgaatcgcaggaactcgatacgtgcggcggacttctggatgggtgttgcgcagacgaatcgcggcggcaaacatcaacatgtacatcaccagatacagcgcggtcgccatatccaccagcgtcgcgaaagccgtgttgccattggggatcaacacgaacagcaacgccagcacggtcacgataatgccttgcggaatcagaatgccttcctgcacgtcgtgggcattgcgcttctgcagcgcgggaggcatcagtcccgtgcgggcggccgctagcaaaccgcgagaaggaccagctatccaagccaccacggaagcgaacgcgcctagcgcgatgagcagcgaaatcaccggggtgccccaacccatgccaaaatggtcgaagaactccctgaacgccagattgatgccgtcgatgagccccagctcacgatgcggcacagcaaaggcgattgccaaagtcggcagcacaagtaccagcagaatcagcgcggtcgctagtgcaatggcgcgtgggaattgacgtcccggatgctccaagtcgttggcatgcacggcattgacctccatacccgcgtaggcgagcacattggatacgattagcacaatcgacgcgatgcccgtccacggcggaagcagcgcggatgcgtgcagggaggtctgcactggcttaccgatcgccagccagataatgccgaagacgataagcagcaacgcaggaaacagcgtgccgataagtcccgaaatcgacccgaccttggcgaacagattgccgccgcgcaacgccaccatcgtgcttgcccaatacaacacgatgatcaccgcggccacatatacgccattattgcccaagccacccatgccgaacacatacgacaggctgacggcgatgaacgcaatctgtatcggataccacaccacattctgaatccactgcagccaaatggcgagaaatccgatgcgattgccgaacgcctcacgcacccacacgtacacgccacctttccagccggtggccagttcggcagccaccagcgcggtcggcaccaggaaaacgaccgccggaatgagatacagcagaatggaagcgagaccataatcggccatggccggcagagagcgtagcgaggccaccgccaccacggtcaacatcgccagttggctgactgtcatcatggttttgccggttttattggcaacggttgccgtgcttgcgattgcgccgtgcccgtcagcgccgttccctctattcgccccggcatgcgcaggtatgcccgtacgattgcggtttcctgcgacggcagacggattgcgtggcgttgttgtcggtgccgtcgcagcgttcgtcgtggaacgtgcggacccgggatgtgcagctgcgcttgcatcgtgcgctaccacagcaagcggctttttcatatgaactgtcattgcagccagctttcgtaaacataatcgttgtgggaatgaacatgaatttccttaatgcgggaaacgatggaattcgtggaatgaccgcgaaatatcagtggtggaatccggatgcacgagcctcgcttggcattggtgaacgcagtccgtccagatacttcacacacgacttcaaatccttgatgaatgcttcggccatatcgtggctgaaaccgttacgcaccacaatgcgctgcacggtcacctgcgtcagatccaccggcatcggataagccggcaccagccatcccttcatgcgcagccgatcctgcagatcgtacagattccacttgcgatccggcttgtcgttgagcatccatgcgaacaccggaatgtcggaaccgtcgttccacagcgtaaaatcatccatctgctcgatctcgcccgacagatatttcgccacatcatgcgaagtctgctgcacccttcgatacccgtcgaatcccaaacgcaggaacatgtagtactgcagcagtacctgtgcgcccggacgggagaagttcagtgcgaaagtcggcatttcgccgccgagataactcaccttgaaaataaggctttccggcaggtcagcggtttcgcgccatacgatccatcccaaaccggggtagaccagaccgtacttgtgaccggaggtgctgatggagtagacgcgcttgacgcggaagtcccatgcgaggtccggctggatgaatggtgcgatcatacctcccgaagcgccgtccacatggatgcgcacatcaagtccggtgcgctcctcgatgcggtccagtgcttcgctgatctgttcgaccggctcatacatacccgtataggtcacgcccatgatggccaccacgccgatggtgttctcatcgacatacttgtcgagatcatggccgtcgagtactttgtggtcctcggaaatcggcacatagcgtggttccacgtcgaaatagttgcagaacttctcccagcacacctgcacggcgctgctcatcaccagattcggacgatcggtcggcaggtcggccttttcgcgggcttccttccaacggcgcttcaacgcgagtccgcccagcatgcaagcttccgacgagccgatggtggaggttccgatggcattcattggatcgggcgcatgccatagatcggcgagcatgtgccagcagcgcgattcgacttcggcggttttcgggtactcgtctttgtcgatcatgttcttgtcggccgcctccatgtacaggcggttcgcatgatcgtccatccacgtgctcacaaaagttgcaagattgagtcgcgcgttgccatccagcatggcctcgtcatgcaccacttggtaggcggtttccggcagactacccttctgtggaatggtaaatttcgagaacgcctgggcttccttcggacgggcgaacagcggattgatttccacgctgtcaggaacaacgcggtcgtcggcattgccgcaggtgttgtcgcagcaatgcgaattgttgttttcagtggtggaatgtgtttctgacattgcagttcctttcgttgatttggaacgtttattgcgttccgggattcaaaaatgaaagtcgattctggatttttgctgggaaatggtcacatttgcgctatgtgaaaattcgtatgacaaccgcttcgcacggaggtatctgcgcgcggtttcgtaatgaacaccgtcattcgaactcgcatggttgtgttctcacaaagaggaatgcgcacgttggtttgttgcacattcttacacgctgaaggtgggtatcggctacgatgggcaggtatgaacgaatcgacgatgaatctttcctggctggatgacgcgaagcaggacatcgaacaatggtcggcatcgatgccgaatgacgccgacaaccagccgatcgactggcgatgggtgtcttcccttgacctgcgtaacggcattggtgccgccacaagacagcacgttgatttgttggcaatgctgcggtcctcgtcgccgcaactttccgccccgcagctgcacgccctgttgaaagatgatcttgcgattcgagatcggctcgaaccgaccatcgcgcagtgcaacagcacgttcatgatggattacgaccgacttatcgcttcctatcggctgccgcgcgcgcttgcttacgcgaaccgtcggttgtgcgacgaaatcgctgttctgcgacagattggcgtggcgatgggattgtggacggtcaccgaggaacgacgtgagcgcgtgacggttccggtgctgctgcccggttcggctttggcttccgggggagtggcgttggatgatattcaggatcgaaccgctgacatcgttaacggccgcgccgcccgtcgtgccgcagagaaaagtcagaagcgagccagtgactatgccatgtcgcgtgcgaacctgagtggagtaaccagtccgggcggctccacgttgtttgattacggttcggaaacgaaatccgctgaagcggcgcagttgcgtcggatggctgaataccgcaaatcggattggcgcgacgcttatcttcctggacgcgatgtggacaatgtcatgggaatcgacatcgaaaccaccggtactgacccggcgcgtgtgtacatcatcgacgtcggctttgaatatatgaacatgatttcccctcgccctgctgccgcacctactggataccaatacgagcagagttattacgaaacgggcgatgcgtatggtcagtcgcgtctgtcgttcggcgttcctgccgcgaacgcgacgctcggtaatccgctgattctcgatttgaccggtatcgatgtacgtaatcgtgcgtccggcttccgcctgttcgatgagtggccggaggctcaaatcggtttgctgcagcgattggagcagcaaccgtacgtagcgcacaacgctcgtttcgaacatagcttcttcatgttgaatgtggctggatatgcggaaagctaccgtgcgggcaagattacgattatcgacacgttgccgatgagccgccgttgggatgaagggtcaattccggacgacgagcatccgtacggcaataacacgttggacgcgtacgccaaacgccagggtgcgcttgacgagagcaagtcggaacgtcacctcggtttggaagatacgcatatcatgctggttgccatgaaacatcacttgggtgtattgcatggcgaaggccgcggtccgtggggtgcgaatggcaagtctggcatcggtggcaagcattgcgggcgccgctggtagcatttgcgattcgtgtcgcagtttcctggttcttcttcccgtgaccgtcccgttttggctttcccttccggcttttgttacccgtaacgccgttttgcggttacaaaatgcggatgcgattgcggatttgcggggatggaatgggcgattgcggggatggtttcggtggttgcggggttggtcgggcctggtttgtcaagtttcgacacgccgatggaacgttggatttccaacggttcgcgcgttgttcatgcggcccgggttgcgcggatcgcgatcgtgctgtaagtttatctcttgctgccgctcagcgagtggtccggatggttccggtccgcgaggtgggtgagtggtggtggtttgagaactcaagagcgtatttgtactacttctttatagtcaatgattgccagttcgtcgtccgctccttgcgagtggccgggaggccttgaaggacggtgaggtttttgtgcgatgcgcctttccttataaggcgatcgtcaattttcttatttcgaattggtattgccctcgatcgtctggactcgctcatcacccttcatcagcgtaagtatgatggctgcgccaatcccctatttttagaaaggcgcatctcatgcaggaaaccatcacatcagaatcgctgttctgcgactactacgcccagtgggtgaaaacgtacaaggaaggcgccatcagagacgtgaccatgggcaaatatcgacttacgcaatcctggctcggcaagctcatccctgaactcagactcaccgatatggatcgaaccgcataccagcagctcatcaacggatatgcacagcatcatgagcgccaaaccaccatggattttcaccatcagatcaaaggcgccattctcgatgccgttgacgaaggactcataccccgtgatccaacgcgtaaagtcatcatcaaaggcaagcagccacgcattaagaaaatgaagtatctcaaccaattcgagctgcatgccatgctcgcggaccttgatcttggggccgaggcaagctgggattggcttatcctccttatcgcgaaaaccggactccgattctctgaggcgcttgggctcacacccgatgactttgatttcgcacaccagacgctttccgtcaacaaaacttgggattataaaaacggcggcggtttcgtacccacgaaaaacgaatcgtccgtgcgtaaagtgcaactcgactggcaactcatcatgcaaatgtctggattactcaaggatcttccgcatgataaacctattttcgtgcacggcaaggtctacaactcaacagccaacgacgtgcttgcaaaacattgcagaaacgtggacgtgccagttatttccgtccatggtctgcgccatacacacgcatcgctgctgctgttcgccggcgtatcgatcgccagcgtgtcacgccgtctaggccatgccagcatgactacaactcaggaaacctatctgcacgtcattcgcgagctggaaaacaaggatgtagatatcgtcatgcgggcactatcgacacttatctaatgggggttcctactcttttcagatattcgaaataatcgagccactcgaagcggcatataccgtttttcaccatcttcagtaaaagcgccaaacaccgttgccagactcaattccgtaggtggttttgtggttccgtaggtggttggttctggtattggtgtctgagaatggcttaatttaagccgtttctcaaacgcctttcctccggcaaccacctacggaagcgaaaaaccacctacggaacacccgcttgggaacaaacccgccgcaagtcaccaggccaagacgaatctcggcacacgaggaaccggaaattgtcgttccggagcgcagccgcacggtcacacgccacactccggaaccaaaggcttttagaaataggtgctacagccaagcttgacggcgaggacgatgccggtgagcacggcggcggcgcgcatgatgttctcggggatatggcgtgtgaccggaggggcgatggaactgccgatgatgcagcccaggcacatggcgatggcgaacggccagtagacggagccacggcagatgaacatgatcgcggcggagatgttcgcgccgaagccgaccacggtcttcagcgcgttgatctggtggaacgggccgatcttgccgaggtcgaggatcgccagggcgagggtaccggcgacggcaccgaaatatcccgaatagatgccgacgaagctcacgccaacccacagccaccacgggtcgttgcgcagactgccattggccgtcctactggcgatcagcgccgcgcgctcgccttgctgcgattggggcaacgcctgcgcgacagcgtcgcgtgcggccgctttcttccgcgggttcagcgcgatgataagcgcgctgaacaggatgagcggcggcacggcgaattcgaagaccttcgcgggcaattccaacagcagcaagccgccgatgatgcctccgaccaagccgatgcaagcgtagacagccacacggcgtccctggcccttgagctccttgcgggcggagagcaggccgccgatgccggtgccgcatacgcccaccgtgttcgtggtgttggacagcacgggcggaatgccgaacgccagcagcgcaggataggagatcagcgaggacgcgcctaccgcgtatccgacgaatcccgcgccgattccggcgacaagcaccagcagcaatgtggtgatggacactcctgcgatcatgaccgcttccccttcgtaaaactcctacgtagtcctcctataagtaacgggagccaagcttaacggctcggctcccgcatatcacgcgtttgcccagaacgtggccgggcaaacgtcatatcagtggttgcgcttggcgatcagcgactcggtccagtaggcggcgagcggaatcagcgcccactgcagcgcgagaccgggcaggccggcggccaggtcgctcgtccatgtggcggcgatggccttgctggaaccgaacgcgaacacggcgatcgcggtggctgcggtcagcaccacacgtccggcgagctgtgcgatgaccaccttcgccaggctcggcagcttgatgccgcgcagcagaccggctaccaggccgtatgcgcacagttcgaccatcatgagcggcagcatcgccagcatcggcatgccggacagcaggaagctcacgagcggagcggcggcgccggcgatcgcgccgacggcggggcccgcgatcaggccgacgaagatgatcggcagatgcatcggcaggaacgcgacgcccagcatggtgccctgtccggagacggcgccgatgacgtggaacagttgcggcagcacgaccgctgcgacgatggcgagcagggtggctgctgtcttggtgccgagactcagtttcggcaggtcggtgcggcgcagggcggccgcgggcatggttgcggaatcagacatttgttttctccttaatgtttccttctcttcggatatgcgtatacgtcataccggctcgacgaccgacccaccgtccggcagcgcggtgtcgaccagcaaatcggcgacggcttggatattggtcgcttcgaaatagcggttttccagcggaatccactcgtcgacgaatcgttgcaacatgcgtggattgcgtcgttcgagccgacgcaactgttcggcaggatcgaccgcaagacagatcatgcaatcgtaatacctccgcaaggcggggtgcatgctgtagctgccttccacaatggtcagctgggccggttcgacggcgtacgcgacggcgaaatcgcctgtatggcaatcccatggccggtattgcgcggcttgtccggcggcgagcggtgccaacacttccgtttcgaaccgttcacggtccacgttgccgccgggttcggcgaaacgttccggcgtgcgctgttcgggacggaggaagaaatcgtccatgtgcagcacgttgccgccgaaacgcctgttgagcatcgcggcaaacgtggttttgccagacgtgcatggcccgtcgattgcgacgaacacacaatcacgttcggcaagcaacgtttcgatacgtgcgattgcgatgctggcttccgtaggcttcgcgggtttcgtgaccattgcgttcgccgtcagtcgagtacggtcagacggtacgcgcgcgaaccgatgccaagttcctcggcgtattcgaggatgtgttcgccgtggagcgaggcgatgcgttcggtgacggacgctccgtcgggggcggtgtggatgaggtcgacgcatgcctggtcgagtgccaccgggtcgagcgaggacagcacgccgatgtcatgcatgtccggttccgtcggggaggccaggcagtcgcaatccaccgacaggcggttcatgacgttcagatacatcatcttgccatgcatgtggctgatcacggcctcatcggcttcggccatcgattcgaggaatgcatcctgaggagtttccacccacttgtccttggtgacgccggcggaatggatccagcgtttgccgttcgacgaggctatgccgatggacacgttcttgagcgcgccgccgaagcctcccatcggatggcctttgaaatgcgacagcacgaaaatggaatcgtagtcgtcgatatgcttgccgacgatgtcgtaggcgatgtggcggtgcttggccaccgggatctcgatttcgccgctcatgtccatgatctggattggcgcaagatcggcgtatccgtgctttttgaacgtggcaaggcttttttcgggggtttcacgattgccgtcgtatgcggtagcgcattccacgagcgtgccgccgatctcctgcacgaggtccttgacgagcgaaggattgagattattggatttttccgattcgccggaatggactttgatggccgttttgccttccggcttgcgtccgagcacatggtaggcggcgacgaggctttccggtgtgatgatcggcgtgaagaacacttccggtgcggactgcgcgtcggtgcggtgttccagtccttccagtcgcgaggcttcgaattgcatcttgaccctccttgattctgcctgtgtttttggcttgcatctccagcgtaccaacttaaacccgacttgaagcaaacagacctcaaacccgttcgagatatgttgcaaaatatggattcccgcgcgtgtctccccatccggccggcttgtccgcatgaaccggaacacttgacgctcgtgattgatttttgcaagaaatggtggactcgcatagccaccaaggaaatggcgttcattggcatcgtcacgttggcggcctctctggtggcttcgtggctcaagcagtttccgggattcagcctgttcggcgcgttgatcatcgctctgctcatcggcatggtcgcgcagttcccgatccgcaaatggtattcgagccgttccgccgaacataaggccggtgtgaaggatgcggccgggctcatttcgaacaagctgcttcgcctgggcatcatcctgcttggtttcaagctcaatctgacggtgctgttcacgcagggtatcaagtgtctgccgatcgcggcagtggtggtgacgctcaccatcgtggtgtgctacaacatcgcacgcaagcttggcgtcgatccgcagctcgccattctcgtggcgggcggtaccggcatctgtggcgcggcagccgtcatgggattgtccggctccatcaaggtgccgccggaaaaagaggatgagaaggccaacaatgaggtgatggccgtggccatcatcgccatcatgggcaccatcttcgcattgctggaaatcgcccttgggccgttgacgggcctgagcaagacgcagttgggcatcaccgctggcgcgtccctgcacgaaatcgcccatgccgtggcggccggcgacgcgttcggcgcggtggacatcgccaccatcatgaagctttcccgcgtgctgatgctggtgttcgcggccatcgtcatcgccatctggtgggacagaaaccattccgaaataccggccgacggcaaacgcaaagtgtcgttcccgtggttcatgctcggtttcatcggcgcttccatcatcggcacgttcgtgccgttcatcggtgccatcgcaccgaatctggtcgatttcgcatacatcgtgctcggcatggccatggccgcgcttggcatcaacgtgaatttcagcgccatcgccaagaagggacagaaagcgttcctggcgagcttcctcacgtccgtgctgctcatgtgcttcgcggcgggaatcgcggcgctgttcttctaatcgccttccgttgtgccacgctgtcgttttgcggagggcagttggatttcggacagcagaatcgcaccgaaaatcagcgcgaaaccgcataacgacggcacggtcagcgtttcgccggtgaaaatcacggataccagcatggcgaagatgcattccgtgcttaagatcacggacgcctcggaagtgggcagattctgtatggcgatggtttgaaacacttgggcgatcaccgtggagccgatcaccaggtaggcgatgcacagcacgatgtcccaccgcgcccaagccatggacggtccgccttcggtaagcaccgcgccagcaccgaacagcagggcgcaccacacgaattcggcaagcatcagcgcgatcgcgtcgaaatccttgccaatgaaaccaaccaaaaccagattcaacgcgaagaaaaacgcgccgatgatagtcatggcgtcaccgaagctcatatgcatgagttccgcgccaccgccgccgctcagcgacaccagaccaatgccgaacgcgcagacgaacgcggccaccagatgctgccagctggggcgtttgcgcgtgaacgcccacaccacgaacggcaccatcacgcaataggtgtcggtgaagaagctgttgcgtccgggagacgtggtttcaagtcctttgagctggaagatgaatcccagccagtaagtcaacgcgagtatcagaccaggaacgatatagcggcgcaggcgaatcctgcgaagacgtgggaaaaacacgatggccataagcagtaccgccgaagccatgcggaagaacatcatccactgtgtcggcatgttctcctgcacatgcttgagcatggtgtagccggacccccataccgccgcgttgaccagcatcatcacgcgggcgaccggcttcgatacgctaatgccttccgatgattcctgccccgcgtctgccatccgtccccccttacacgcttccacacatccgacgtcgtattcacgtcatgctttccgaaggaaactttagacgtggctgcggaagcaacacgcgggagcatgctactgcgctttggccgcctggctgttcacccagttgtcagccatgtcaatggcttcgtcaagcgtgaccttggccgccttgtaatacttggaatccttgatgttgctgctttcgacgagcttctgtccggagtccgcggccttggacagcgcggacagcagtttgcgcccggtcagggtcagggaatcgtccttgctgagtttgtcgaccagtttgtctgccttgtcgatcgactgttgcagttcctttttggattcatccaacgatttcgtgtcggaggtgccgttcgaagaagtgctgttcgaagaggctccgttcgattgcccggatgggttattggacgattgtccggctgccgcgccatccgaatcggccttcggatcctgcaacgcggtttcggcgtttttctcttggatgcttttcagactggcgttcagggaatcggtggcgctgtccaacgttttggctacgagattgagctgcgtgatggtggcttccgccttgcagccttccgtatcgactgtgttctcggcgctggtggccgcgtccgcgaacgcgtcgatgatgtcgttcacgccgagcgcgcctcgaatcagcttctgcagttcgctgccgttttcggaagtgtcgagcacggctttgcgggccgagctgaattccgcgagcgattgccggcatgtggccaatgcttcctgctgcttgttgcggtaaacgcacacgccggcaccgcatgccacgatgagggccacgaccacggcaaggacgatcggccatgccttgcgggggctggaaggctgttcagtggtctggtactgataatccatacgtgtcaccccttgcgaaccgatagctgtcatcgttcttcgtcttgttaaccttgcctattgtacgggcttgaagatgggaatatcctgaatgggcatcctgcgcacaccaatgacgcaggatcgggctggcatatcgtctctccgcaggcgtgccgcatgtccatcacggccagcagcccccgtttgtccgctcgttcgacagccatgtccacgaaatcgaccggcagatgccgtttgtcggcgatttgccgcaccgtcaatcctgcggcgatgtcgccggcgatgcgtgcgacgatatcgttccggccgtcgccgtatgtatcagccgtacgtggcgtgcgccgccatccgtgcgcggaagcgccggaccgttccataccgctcaccatatcaaccgcaatgtttggaaggcgatgatggcgatgacgtatgccacggccaagctcagcaggacggatcgcgccgcgactttcgtgccgaactgccgtcgcatttcggcgaccgttgcaagacatggcgtgtaggcgagcgtgaacagcaggaaggcgatggccgccgccttgccgtggccgtgcgatgactggtcgaacgaggcgcgcagcttctgtcccagcgttccctccccggcttgttgggacgtcgcatcatccggttcgtccgcatggtatgactgcgacatcgaaccgaccacgacctctttggccacgaatcccgtgatcagcgcggccgaggcatgccagtcgtcgaaaccggccggcgcgaacacgggagcgaccgcgtcggcgagcacgccatacgcggaatcatgcacgtcgtcgacatgagcgaaaccgcctgcgttggcggttaccggaatgccctgcagcagccacagcgccgtgatcattgaaatgatgatcacgctggctccacggatgaagccccatagacgcagcagcaccgaacgtgccagctgcaacgcgcgcgggcattggtatgcgggaagcgccagcatcaacggttcgggttcgaggccgcggaacatggtgtggcgcagcagcacgccgaccaacagaatgaccatgaccgaagccacgtacatgaggaagaccacgagaccggcgtatttcgggaagaacgcgtgggcgagcaccaaaaacaccgatagtcgcgcggaacatgccgcgaacggcaccagcatgccggtaagcacccgttgccgggaatcggatagggttcgtgtggcggccaaagccggcagattgcagccgaagccgacgatgatcggcaggaacgcgcgaccgtccaatcccaaggcgcgcatggcacggtccatcacgaacgcggcgcgggccatgtagccggaatcctccaagattgacagcagcaggaacatgatgcccatcaccggaatgaacgtcagcacggtgaccacgccgtcaagcagaccgtccaccagcagcgaacgcagccagccgccgctcacggatggtccgaacaggccgagcagcaggtcgagtccatctgtgcaccatccgcggaaggtcacgtcgatccaatcctgcatggggctggcgagcgtggtggtggcctggaacacgacgaacagcaccgcaaggaagacgaggacgccaatcacggggtgcagcagcacgcggtcgatgcggtcggacaaggtgacgtggtcgaccgcatgcatgtcgagaccgcgcaatatgccggcggtccaatcgagtcgtgcgtcggcccgcgattcggcccagacgctcaggccgtcggcggttttcatgtcggcgtcggctgtcgcggttggcagtgcggtcagcccgtgcggaacgggcgttccctcgaaacttgcggcgatcgcgtcggccaaagccttgccgccgtctccggtacgtccgtcaatcgcaacgaccggcatgccgtccagcaaatgggacagtcgttccgcatcgacgccgcagccgttgcggacggcgaggtcgttcatggtgagtgccacgacggtgggcagcccgagctccaccaccatcgacagcaggtacagcgatcgggacagcgcggtggcgtccagcaccacgacggcaaggtcgggaacgggcatgcccgacgcgccggtcaacgcgtcgacggcaacctgctcgtcgggactcatcggagatagcgaataggttccgggagtgtccacaaactgccaattctgcggatttttcgtcgttttcgagcttttgtaccggtattgcccgcaagtgatggacaccgtggtgcctggcgcgttcatcgtacgggtcctcgcgccaagcagcgcgttgaacatggaagatttgccaacgttcggattgcctacaaacacgacgcgttttacattttcgacgtttcccatattgccggagtcgccgcccatgccgtcattcgcgggtctgttgacacgacaagcgcgatgccggcaacagccattctgcgaacggcagcagtcgccgcccctcaggttccgtagattcaacattcgcgcatattcccgttctcttcgcgttacgcaacgtcgtcttgcgcatgttcatcccgcgcgaaccgtacccggacggcacgcgcggtgccgccgtccaccgcgacacgttcgtttccgaatgcgacgacccttccgccgaaagcgctccgctgcatgacccgtaaacccgcgcccggagccaatcctatctcacataggcggaaccggtgccggtcatccaggtcgatgccgtccacgacaacgcgcatggcgcgcggacagtcgcgcagcgtcatgatggcgccgcgctcccccgcccgacgccgcaccgtgtcatcgaagcggcgagcatgcgtattatccatgttttcacacatagcaggaaacgaagcaaagcacaagagtgtttttcacggaactgaaccgcaccccaattgttggacgtcggtaagtgggatgcagtctgagaccgcgatctggcacgcatcatccagactttggtcgacgatcccattgagcaacgcattcgcgaacggcgcgtccaagagcaggacggcgaggccgttgccgacaatgccccggtcaatacaggctgtggcaacgctgccgacaatgccactgccgaaaaacgcaagcccagtgccgccacattggcggcaataacagtaccggcacaagcggcaccgacgcggttgccgacaatccgctggagctggtggaatccggttggtctgtaagccaacaggggtacgttagctacgcattcgccctgcgcaacaccagcacaaccctgcaggtacagtatccagaagtcgccatcaccggcgaaccaaagacggctccatcgtgttctcgcagacgcaaacgctgaatatggcgttcccgaatcagactatatataacgccgggcaagcgggtcaaggtaccgcaccggccaccgtggacttcgttgcgctcagtccgaatgagtacaacgtcacggaagcacaaggcactgccactttccccatcagcggaatctccaaagtgcgcaacaacgacggcggcacgaccttcaatggcgaagtccgcgccgtgaccgatggtttcaagccttcagatggacagcagatcaaggtttccctagtgttgcgggataagcaaggtgccatcatctatggagaaatggcatttgtggattggccggacaatggccaatccatgcctttctcgatactggtgtacgatttgccggactacacgtcctacgagtcgtacgcacaaatttggtagttcggcttaatcgccatcaggccgcgttacgcgccgcatcgacactagtgttgcgccgtgcctggccgaatacacggccagccatcttctcatcggtctcggtctggatgatggtgcgcatcgggcccatgcagatggccgaagccaaaccgttcaccacatcaatcagcaaatacgccagcagcttatggaccacgccaagaccaacgacggagacgcccaccagagtgacgccgaaggcgaccacgcgcatgttgttgcggacgatgatgacgccgaatcaccgatcatcctttgggaacaacgcgtcgaaggcatgttccatcacggacttacggcggatcacaccgacgagtctgccatcaccatccaccaccggcagtttcttgaactgcttcttggcgaggattcgggccacctctccaacatgctggtcgggcgtggcggcaacgaccttacgcgtggcgatgtccatcaccttcttgccggagagcgcctgcaccttggaggccacggtttcgtcgtcgaacaccaccatcgtcgaaccagtgccggtggaaaccgtacgggattcataggtggcaatcgatttcatgacatcgccgtcgctgacgaagccgacgagcctgccatcgccgttcaccacgggaaggctggaaacgttgaggcggatgaactcgcgcaccacatgcgtgatgtcatcgctgtccaggcagctgtagggatgatcgtccatgatcccactgatggactgttcctgggtctgcttgaacagggaggaggcaggggccacgtatgcgccggcgtagtgatgctcggcgggctggccttcagtggtttcggccgcgacttcggcggaggcttgcgcctcgtaggccttggcgttgcgtgcggccttctccttggcacgactggtgacggtgaagatgcagatgatcagggcgaccagcgagatggcggcgcacagcaggtaggagaacgcgatgccgctggccgtggcggacttcacaccctgggacatgtgcgaggcggtcacggatgtttctgcggtaaccagaagcgaggtcgcaatggctgccgcgatctggcggccggtgttggcgatagcgttgccatgggcgatcatgtcgttcggcaaagcgttgacgccccaagtgttgatcggcatgttggcgatagcctgaccggatgcctgcaatgcgcagaacacggcgacaaacagcactgatgtcctggtgttgatggtgccgagaagaccaagagagatggtcatgagcgcaaggccgccgatgcccacgccgcgcgggccgaatttgtcgaatgcggcaccggcgaccggactcaggatgatgccgaccgccgcggcgggcagcatgaccatgccggtgacggtggcggattggccgagcacattctggatgaagataggcaacgtcacgttggttgcggcgactgcggcgttgatcagagtgaccagaatcgcggagttgcggaagttgcgggtggcaagggtgtcaacgcgcaacaatggctcatcgagcttgacttgcttgtatacgaatgcgacgaaggccacaagaccaacgacgattgaggtaatgacgaccggactggcccatcccatcgtggaagcggacgagaagccatagagcaggccaccgaacgcgatggtcgaaaggatcacggacaggacgttgagctttgggttcttcaactcgctgacgttcttgagcatcatcgtgcctccgacaaggatgaccagtgccacgactgcgatgccaatgaacatcgggcgccatccgaaaccgtcaatcaccagaccaccgacaaccgggccgatagccgggccggcggccatgacgataccggccatgcccatggcggtgccgcgcttatccggcggatagacgagcatcggcactacggcgaccaatggcaacagcacgccggagccggcggattgcagtatgcgtccgacgagcaacagcacgaaattcggcgcgacggcacacagcagtgtgccgaccatgaaagtggcaagggctccggcgaagagctttcgggtggagaatttatcaatcagatagcctgaaatcggcaccatgatgcccgagaccagcatgtagacgctggtcacccactgcacggtgccggtggtgatattgaaatcacgcatcagtgccggcaaggccggtgacatgacggtctggttgagcagcgcgatgaacgagccgacgacgatcacgcccacgacgatgaatcgggcgtgcgaatcaataggctttacggaactggcggcggacccgaattccgcggttttctgtgaggtcacagcatttccttctgttggtaacggcatgtgtgggcgatccggccccatacttgtgtcaagacgcggggacaccgatgagtccggggtaaaggaaaagccgccatccgttccgcattcatatacggcaaacgattcgcggctttgcgtaagttgatggctatggtgagcgattcatgcgacgtcgaccgcggatgggccatcggtacatcccggcataaggcgtgtccccgctacaccagcatcgagaatagggccatttgtggattggcaaacagaacattgccgacgaacgacccacggcaggtgcgtgcgatgaacatcgcgtagcgatacaggttcatggcatctccttgatgggtcttcgtacggcagacatcgagaagcctatcatcattcagatcgacggtgaaacccacgcatgctcgacaatacacaaaatctttacaaaaggattgggcttaccgcatacgatccgcctgggtaacggtccgaggatgaatcaggggcgagacaagggttgcgtctcgtgtttccgtcatgatgtctggcaaaatagtgaagccggacatgcgaggcatcgaccggaatcggaaaggggcaaatcatgcgagttctcggcaatatcctgtggatcattcttggtgggttggccatcgcaatcggatgggcattggtgggactgattctgtgcatctccatcatcggcatcccgctcggcattcaagcgttcaagatggcgggactcaccctgacgccgtttggcaaaaccgtgcaatacggcggcggagtcggctctgccttggccaacatcctgtgggtggtgctggtcggctggtggatggcgctcggctatctgggagccggcgtactcaactgcatcaccattatcggtattccgttcggattgcaatcgttcaagatggccaagctcgcgctctggccattcggagcggaaatcgtcaacctgtagattccaaatactacaaagccgccaaagcaacccttgacgaggcggtcaccgacgtcaacaattggattgaccagcaagccgccaaggccgaataataaaacacacattatgctgctgcagcagccagtccttgcagaacaatgtcatgacaaaggcctgagaagacgacttctcaggccttatccgtgccgctcatcagtcgcttgtagcgacagctcccctcaaagaggggagccagagaaacacttacttcgagatgttgaacttgaactccacaatatctccgtcggccatgacgtagtcgcgaccctcctgacggagcttgccttcctccttgatcttcgtcatggagccttcggcggccacgaaatcgtcgtaggagacgatgtcggccttgatgaagcctttttcgaagtcggtgtggatcacgccggcggcctgcggggcggtgtagcccttgtggatctgccatgcgcgcacttccttctcgcctgctgtgaggaaggtggacaggccgagcgtgtcgtagccgacgcgtgccagctggtcgagaccggattcctcaagaccggcgtcggcgagcatttcgcgcgcgtcgtcctcgtcgagttcggtcaggtcggcttcgaactgcgcgttgaggaagatggccggagccggagccacggatgcggcgagcttggcctgcatgtctttgttctgcagttcggcatcgtccacgttgaacacgtagatgaacggcttggcgctcatcaagtgcagatcgtaaacggaatccttgtcgaaacggccttcgcgagccgccttatcaatggtttcgccggcttcgagaatggtcttcgcctgtttgacggcctccatgtaggccggttcgatcttcttgccgcgcaaatccttctccagcttcggcagcgcgttctcgatggtctgcagatcggcgaggatcagctcggtgttgatggtttcaatgtcgtcggacggatcgaccttgccgttgacgtgcacgatatcatcgtcttcgaaggcgcgcacgacctcgcagatcgcgtcggcttcgcgaatgttggcgaggaacttgttgcccaggccttcgccttccgaagcgcccttgacgatgcctgcgatgtcgacgaaggtgacggtggccggcacgatcttctccgtgtgcacgagcttggcaagcaccggcagacggttgtccggcagcggcacgatgccggtgttcggttcgatggtggcgaacggatagttttccgccagcacgttgttacgggtcaatgcgttgaacatggtggacttgccgacgttcggcagtccgacgattccgatagtaagagacatggttccttagcttagtattaggcttcgatggcgtcgaccgctttgatgaccgcaccgcggaacgcgctttcctccaacgatgcgacgcccttgatggtggtgcctcctggagagcagacagcgtctttcatggcacccggatgcatttcgtcggccaaatagagcgcacccacgccttccaccattttggcggccagacgatacgcggtggcacgctgcaaaccatatttcacaccggcatcgcccaacgcttcgatgtacatgtcggtgaaggccggagcacagccggcaatacacatggcgatgcccatgtgtgcggtgtccacgcgttcgatcaggctgattgacgaaaacaggttttcgaaggtttccgtctgttcctgcgtgagcgtgttgtcgacttccgtgaccagcacgcctttgccgacagccatcggcgtgttcggaatggtgcattgaatgtgcgcctgttcgaaagacgttccgaacaggtcacggaatttgttcagatcccagcctgccgcaatggacacgacgatggtgtttggctgcgccagcttgtcaacgatcggtgagatcaccgcttcaatctgatatggtttgatggcgatgacgaccacgtcggcggcttcggccacttgtgcggcggtatgcaccgctttcgcaccaagtttggcggcgctgcgttccagcttgtcatagtgtgccgcgcaagccacaatgtcgctgccgttgatcgtgccggcattgaccaggccttcggcgatcgcctgtgccatattgccgtatccgatgaatccgatggttggattggccatgtttctttcctttgctatcgatgctcgtcgttgctgaacgatcgtcagaacaactccgccaaatctccgcggttcaatgcttcattgaacaggtgcctgaacactgttgcaccatgcacgccgtcatgctcgaactcattggtagtccaataatgtgaacgaccgacgcgggacagcgtgtcgagctgcaatccagaatctacgtacatgtcgtcgaaatagacggcagcctgcagcggaacctcattgcgcgccaactggtcggcatcgtagatcgtgccgaaatgcgtgtcttccataagcacgtccatggccggtttgaacggacgcaacgcacgttcctgctcgaacatccacgggaacatggcctcgccggtgaaattaagcggacggatgtcacccgcgaattccggatgctcgccgcgcacgcgctgggcggcccagcaaatcggcgtttccagctcgccgttggcgtagatgaactcctgcaacggccagtacagcgggcgagacgaggtcgcatccatcacggaagacaggaattcgtcagacagttccgccgaggtcgaggccgaaccgtcgccgtcgaggaatgcctggtcaagaatccaatgcacgcgttcgaaacttggcttcatgccgaaatcggatcccaagcattggaagcgttccaccgtgagcggatcgccgttcggcaatgcgaccttgtgcgactgcagaatgtcggcgatggccgcggcacgttcgacatcgatcgggtaacgctcgtagaactgcttcgtctttgccgccatgcgcgggaacgtatgacggtacacgtcggtcgcatcggcgggaacatgaggaatgccgcccgtggtgaaactggcgataaccccttgcgggaacagcgaaagatacgtcagcgtcaggaatccgccatagctttgaccaagcgtggcccaacgtgcgcccccgaattcggtacgacgcagatgctcgaaatcacgaacgatcgaatcggcgaggaagcgcttcaaaaacgcggcaccggccttgccgccgccatccatgccctcaatcacatgcgtatcgacacgagacgaacgcccagtaccacgttgatccggcaacaccacacggaaatgcttgatggcctcctcaatccaaccatcggaacttggaccgagcggacgggggccggaaccaccgggaccaccctgcaggaacacgagcagcggaagatcatcatgcacatgttcgggagcggtgaccacacggtagaacaggctgattgattcgccatcgaacccatgaccgggctcgtggcccgtccaatccaacggcaccttgatggaacgatcctcaatatgcaatccgggcacgtagtattcgctcagcaacgtcatgcattcaccttccctttggcgtcatcggcatgttcaattcgggtagtgactttttgatggcttccatctcacccacatgcggagacaaccttacctcacaaaagcggctttatcctgccgctatttcattcctgcgcatgatggcgtcacagcatatctggcgctagggtggaacgtatgtcgaatttcaaacagcgtctcttgtcatggatgcatggccatgttttcgccggcgatctcatcatcacgcttgttataggtgttctgctgttcggcgtgaccggcggcatcacctataatccgggattgctgtttgaccttaagccttccatgcagatggcatgggaagcggcaatgcttatcccgctgctgatccgtcgatggcggccgcagaccggagcgttgctctgcgtggcattgaccttggcgcatctcatattcggcccttgcctgttgggcgccgatattctggcattgttcatgctgtattcggtgatcgtctacggcaatcccaaaaacacgaaagccttcattattctggcgttgatcatcggtcttctggcttcggcgctggtggcatggaccatgtccaatggaccgctgctcaccggaggcaaagtgcatacatggagcagctggaatgacccaaatccgaatggcgttatggtcacgaaagacactctcggttccatctacacaggaacatccatgtcggaagtcgccgacatgatggcgcaatacatgctggtactgacgccgattttcgaagtatgcattatttccaccgtcattgtagcgttctggcagcgtgcccgtctggcaaccgtttgcatgatgcgggaacgcaatgaggcaatcgccgcgcgagaccaggatgaacgcgatatcgccgcgttggcggaacgcgcacgcatcgcacgtgacatgcacgatgtggtggcgcacaccctgtcaatcatcatcgtgcagtctgatggcggtcgctatgcaggcacgcatgatcccgcggtggccagaaacaccatggagacgattcgacacgaatcggaacgcgcactgcatgacatgcaacgtcttctgggagtattcgggggttcaccgcacgccgattataacgatatcggcaatcttgtggaacaagcgcaaaacgtctcccccgacattcgaatccgacggaatatcaccggcaccgccagcccagaacaactcggcgaacaagcctcgatagcttcctaccatgtagtgcaggaggcgctgacgaatatccgcaagtatgcggggccgcatgtcgatgtgcatattaaagagtcatggaacaacggtttgctcactttgaccatcaccgacaatggtcgtggcgcggcggccaatatcgacgggcatacgccaggttacggcctgctgggcatgaaggaacgcatcgaatcggccggaggctcgttgcaggctggccctcaactcggcggaggcttcgaagtcatggccaccctgccttacggcggtaaagaacaggtgacagaagaaaccggcgaacagtatgcctcggaacagtccgaatcttgcaacacaactgccatatccagcaaagcgaaactatccgacgaagcaatcgcacctcacacagtcgtcaacatatcggcgcgaatcccagatcagccatcggagcggacgcaggaaaccaaccaaccgaccggtcgcgatcatcgttcgaatgccctgcaacatttgcgcatcaccgcacccaatctgcatgatttgctcaaatcgttgaaactgaaatccgtagaatttgcaaatacatccaattcgcgagggctgaattgggtggaacgtgtttccgcgtggacgcagcaccattatgcgctcatggattccgttggtgccgtggtattggtcatgctgctgaatcgcatgtcggttacgttcttttttgatagttcacctcatgcgcagctctcaaatgcgatcgccgcatgctgcttgctggcgctggctcttcgacgcaggttccccgagacttgcgcgcttattgtgttcgtattgtcggttgtgcaattggtgtttttgggatcgattgaggttggacatatcgtagcttcgctgtgtgctctgtattcagccgtattgtatggacgcgaacacgcatggcgttggaccggtcctgccgctgtcgcctgttcggtgctgatgggcttgaaaatcgcggccgatcaacacggatacattaccttgttcggcgccatcaccgcttccgtgggcctgacaaaaccggtttcagccgcgtcaagcagtactgcggcgttctttaccggcgttatgtatacggttgcggtgttgatactgtgcgccggcattatggcatgggcgcgttggactcgctccagtgattcaaacgcactggtgttgcaggcgcgagaggaggcgctggtggccgagcaggagaagcagcgtattctcgcggcgaatatggaacgcgaccgtatcagtgccagcattcaggctgaagtcaccgccacgttgaacagcgtgattagtcaagccgtcgatggtatccgcatgttggacgctgccgaagcacaaggcaaggagcctaccgccgacgagatttccgcagcgttcaaagccatcggagaacaggggcgcgccgcgcttaagcgtatgcgcgaactgctcggagtgcttcgtgagactggtttcagcgatgacgctcatgccggtagcgcgagcgaactgcagttgcggcccgcagcaccgctggaggagcagctgcagcgcgcgtcccgatagccggttcaagtttttcagggagatttaagggtttgtttcgcgctgtgagcggaacgatgccgataaggtggagagtatgagtgaagaacagaagattcgtgtggtcattgccgatgatcaggaattggtgcgtgccggtttcgcgatggtgatcggctcgcaaccggatatggcggttgtcggccaggcgcgcgatggcgcggaagcggtggctttggcggagacgatgcatcccgacgtggtgctgatggacgtgcgtatgcccggtatggacggcattgaggcggcacgtcggatcagcgcgttgcagcatcgtttcgcacccgatggcagcgcgcttgacgatgcgcatacccgtgtgatcattctgacgacgttcgatttggacgaatacgtgatggccgcgatcaacgccggcgcgtccggcttcctgctgaaggacacggaaccggagacgctgctcaattcgattcgcaccgtgtaccaaggcaacgcgatcatcgcgccatccgccacgaaacggcttatagagaagatgatggatggcgatttcgcaggaacggccgccgcagcgcccgtttccgcaacgtccgcttccgcttcgacggcaactatgtacaccgatccggaattggacgaactgaccgaccgcgagcgcgaggtgctcatcgaaatcgcgcatggcctgtcgaatcaggagatcgcggacaagctgttcatcagcctgcctaccgtgaaaacgcatgtcgcgcatattctgtcgaaaatcaatgcgcgcgaccgcgtgcaagccgtcgtgttcgcctacgaaaaccatctcgtataaaatcttcataaaacgtattcggcaacaaaaatgctccttctttcgaaggagcattccgtttatcgcctaagcttctgcgagcgcctcaacaggcggtactttgaccgctctgcgggcaggtgcgatgctggcgagcaacgcagccacggcggccacggcgagcacgatgccgttgacgccccattcgaaggggaacaccacggtgccgtacaggctgaacaccacgtatgcgcccagccagccgaacaatgtgccgagcaggatgccggcgatgccggagacgagcgagatgagcagcgcttcgatggcgagcgatgccctgagctggccgcgggtcatgccgatggcgcgcagggtggccgattcgcgggtgcgttcgatcaccgacagggacagcgtgttcgccacgccgacaagtgcgatgagcacagccacagcgatcaatcccaccagaagcatcatcatggagtcgatcatcttcgcccatacgatgcgttcggcgatcggtccggtcactgtcgcatcagtgctcttctccaatgcggcctgcatgtcgttgtagatgccgtcaacggaaactcccgacttgtcagtatccgccttgaccagcagcacatgggtggcggcatcgaggtcaccattggtgaaatggctttcatccacgaatccgacagctccatactgtgcggatacgcgacggtagtcggcttggtttgcttgcaatgtcagcgaacgcgtagcgtcgccgtcctggttccattcggtagagaaatcagccgtaccattggcgaactgcagttccttgccggtttgcgcattgtatgttggcatgagcacgccatcactgtcgatggaggcgttacccaagttggcacgcatgacctgcttgacctgatcgatattcttcacgccgaccagcaatgcggacgtaggctgggttccatccgctttctccaaggtcacggaaaccgccggcgcatacaacgtgtcggacacgccgttgatgtcggctacatccttgaccatttgctggctgatgtcatcgcccatggccacgatgtcgacgctataacgggtggcgagcgcaccattcatagtctctttggcgctggcggcaccggttgcgatggtggaaaccagggtgacgccgatgagcagagcggcaccggttgctgcgatgcgtcgctgattcttctgaatgttggcgtgcgcaaccgttgcggaaggtcctgtcagcgaggccaacgctccaacgcccttcatgagggccggcatccagaacaccgctgtgaccaccattccgaggaacaccagtgcggcgccggcgatggctacgagcagaatcatcgtgaattgatcgctgctcgcatcctcgccgccattggtggcctgtacccgccagatggaaaataccaccatggcgataccgaccaccaccatcagaataccgattatggctcgcgtgaggctggaacgacggttgtcggtcagttcaatcgggcgcaatgcctccaatggcgtcaccgcagtagcggaacgtgcggatcccagggatgcgagcaccgtcaccacaataccgaagagaataggtatgacggcggcctgccaagagaaattgaatcgcataccctcttgcatgatgtcgctgacgcacatgccccacatgagcagacttcccagcatcacgccaagcacggatgcgacgaagccaagcactgccgcttcgaacagcacggaaccatacagctggccttttttcgcgccgatggtgcgcagcaaggcgagtgtgcggcggcgttgcgccacgagtacttggaacgtgttggcgatcaccagtgccgccacgaacatggcaagcacgccgaagcacatgaggaatgtggtgacgatgctggtttggttgccggttaaggatttgatgctttcgtcactgacctgctgtcgcgacatcagatcgaaatgctttggcagcaacgctttcacactgttgatggtttttgcggatacgctatttccatccaaggcaaggtcgaggtataccgttgttgttccggtggtgtcgaaatcgtccgttccctgcattgcggcaagcagattgtcggatcctacgatcgcaccaccatagtacgagtaggcgccgttcggatcggaggtgagtccgaccacgcgcacgttgtccgctttggctttgccatcggtgcctaccgcatattgggaggtcagtcttacagtgtcgccaatgccgacgttcagctgtttcgccatgtcttccggcagtgcgacttcgttggagtccttcggctggtccccttccgtaatattcacgggaagcatgttcttctgtgccgcggtagagatgatctcgccgctgatggcgctgtcccccctggaaacgctgacgccggtttccaccgaggcgcggacaccgtcaaccccttcgatgccggcgatctggtcgagatggaagtcgccgacagtgctggagtacgcttcgttgagttcctcatcgctcaggtcggagctgttgacggtcaccgcatagttggcgtttccgaacatggcggtcatctgccgtgtcagggagtcgttcatggcattgccgaacaggaaggtgctggcgatgaacgccgtgccgatcatgatggcgatgcctgcgggtatgagcatgcgcttggtttttcgcatgagtttcaaagtgatggaccacatggttaattctgtttccttcttcgaatgcttctacagtgcgtttagcgggaatgtctcgcggaagccacattcattgtggcggcttcgcgttccttcatcagcagttcactcatctggtctgctgtcggcttgttcacgtccgccacgatctggccgtcggcgaacacgagcgcacggtcggcgtaagacgcggcgaccgcatcatgcgtgaccatgatgatggtttggccaagttcgttgacggaacgtttcaggaagctcaacacttcggcgcttgatacagagtcaagattgccggtgggctcgtctgcgaacaccagtttcggtttggtgatcaatgctcgcgcgatggccacacgctgctgttggcctcccgatagttcgttcggacgatggttaagacgttccttaaggccaagcgtttccaccagcagacgcaaccactgtcggtctggtttcgccccagccaaggtcaagggcatgagaatgttctgttcggcagtaaacatcggcagcagattgaagctttggaagatgaaaccgatctgatggcggcgcagcagggtgagctggtcgtcgttcatgcgggtcagatccttgccgtcgaacatgacgtgtccgctagtggccgaatcaagtccggccagcgtgtgcatcaacgtggatttgccagagccggaagggcccatgatgacggtgaattttccttgttcgaaggcgatattgacgtcacgtaacgcatgcaccgcgttgcttccggaaccgtagtccttgacaagatcgatggcttcaatggcggtgttattggctttgatggcgtccctgatgtccatggaagttcctttctttgtgaagttacttccagcatacggaacattcgacgtcaacggcatcatgcgttggtctgaaatcctgctgaaccgcgactcatccttgagtatgagatcaacgcgggaacagcgaaaactggatgatcagaaaccatgttccaagcatcgggcaatcgtcaatcgcctagcaatacgccttcgtgcggcggctcaagccaatacgactccttttccacactgacggtggacgcccaccaggtctgttccacgcctggcaatgggcgaatggattcgtccaccacgcgccataggtcctcatcgttgtcggcgatgatttcaatcaggtaatcggcaccgttcaatccgacaccactcatcgcgtacgtcacttcgtcgatggccagaagctgttcggagtcaagccgatatggaggtttcactccaagtccgaggaatgcctgtcggaatcctcccaaacgcatggggcttaccgtggccataatgcgcatcacgccggaatcttcgagttttttgatgcggccgcgaatcgccgtatgggtcacgccgagacgctcccccaacgacgcatagctggccctgccgtctttctgcagttcgttgaatgtgtgcacgaaccgtggatccagacgatgcgagggaatatcggtgccgacactcgcctcgcgtttggtcaggaagccggtttcgccatgcgcggcgagcagacggttcaccacgctgacattgtggtcatcaagcaccagccgtccgcatgagaacacctgcagacgggacaatcccggcaacgcgcgcagaccatgtttgaggaaatgatccatgccttcagccgaatacaccacagcctcagcgatgatgtcggcatcccccagagcgcagaccacgtaggtgacctgtggcatggattggagcatggcaagagcctcatccctgctcccgtcgagacgaagtcccaccagcacctggctgtaattgcccagactcaatggattgcacaccgggacgatgctcatgatgccggattcagtaagcctgcggtagctttccgtagccgcgtagacggaaatgccgattttgtcggcaagcgcctgcatggtcatacggccgtcgcattgcagggccgagaccactttcaggtcgcgtgctgtgatggtgatgcgttgttcgttctggaacattggcctgcctcagaactgccacagcatcagccagatgctgcctgccgtcgcggcgacggtgaccgcaaggatgatccaatcggagagtctcatcttcagctgtatgcggtaggtgcgtctcacgccttggaggttgagcccgcgcgattccatagcccagccgacgctttggctcattttgtaggcgcggatcagcaccgcgatgatgatgggcagatacgatttgaaccggtccaccaagcgtacgaatacgttgcgtttcttgccggtggcgtctttcttgccgttcaagtcgagtccgcgggcccgttgcgcggccgatacggattggaagatggagaagaacaccggaatgtagcgcagcgcggtggcgagcgtgagtccggccttgtacggcatgcccagggaggtgagccctcggatcagcttggtctggctggtggtgaacaacgtgaggaagcacgcgaatccgagcgccggaatgcgcaatcccatcaccgcggccatgacgaggttctctcgcgtgagtttcagccatccccactgccacagcacgtgcgtgccggatgggtcgaaaatcggccagagcaccacgatgaacacgatgatcacggcgaggatcttccacacccagccgatgcgtttcagcggcacgccgtcggtgatgagcatgagatgttcgatgatcagaacgtcaagtatgaacgcccagttgcgccataccaggcacaacaccaacatgaccacggtgatgaggaatttcacacgggggtcggcgcgatgcagccagccgtcgcccggtacatacaaatcggcgtccatcagtgtcgtccttcctcatgcttggtgactttcagcagcacatgcgtcgccgaaacgggcccattggatttacgcggtttgcggatggtccgagactgcttctgcgccgcttcggacctgtcgatcggcccatactgcacgacttttccgtcctccaattccagcacatgcgtgcagtaccggtataccgcgcgcatgtcgtggctgatcatgacgatggtgacgccgcgctggttgagtttctcgatggtgccgaggaagcgtgctgcgagacggtggtcgagaccggccgtaggctcgtcgagcacgaggatcggcgtgcgcattgcaagcacggatgacagcgccaccgcacggcgttcgccgtagccgagcgtggccggcgagacgtcttcataacggtgcaggtcgaacagcgtcagcatctcgtcgacacgtttgaacacggtggctccgtccagtccaagcgcggtaggaccgaatgcgatttcctccttggtggtggagcagaagatctgatggtcgggattctggaagacgaatccgacgtgggccgccatttcgccgacgctgtgtttggaggcgtcgagcccatccaccgtcaccgtgccctgcgtgggtcggatcagtccgttcaggtgtttggcgagtgtggtcttgccggagccgttacgtccgatgagtccgatgaatgagccacgttcgatgtcgaacgtcacgtcgtccagagctttcgatgcattgccgccgcgctcatattggtaggagacatggtccaggctgatgaccacgtccttggaccgttccggctgattctttttgtccttcttatgctttttgccctgctgtacggccttgacctgcggcagtggatcgtccgcgacctgcacgccggaggattccagcagtcctttttcacggacgaacaggctggcgtcgccgttgcgcaccaattccccattgaccatgaacagcacttggtcggcccaataggcgatatgctccgtgtcctgttccgccatgatcaccgtcatggaacgggtctgccggatgcgttcaagcacatcgaagacttcctgcttgccttccggatcgagcgccgcagtcggttcgtcaaggatgagcacgtcgggttccgccgccaatgccgccgcgatggccacacgctgcatctgcccgcccgacaggctggccggcacgcgcttgcggtagccggtcatgccgaccagatcgagcatgacgtcgatctgcttgtcgatgatgtccggtgcgatgccgcggttttccaaaggaaaggcgatctcatcctcaacgctcgcgcagaacagctgcgcttcgggatcctgctgcacgtagccgatacgttcggacaacgccgatacggaatgacggctggtgttcatgccgttgacttccaccagtccggtcatggtgccgtccgccagattcgggatgattccggccaaagccatgcacagggtggatttgccggcgccggtcggtccaatgacgcccacgaacgagcctgatttgatatcgaagctgacatgcttgaggctatccaccggcttgccgccatccaccaatggctcatactgccaactcaaatcacgtaccgtgatcatgcgctcttctccatatctttcagcacatcagcccattgcaccggccgcgaacacagccactacggatactatatgaacgaatatgtataaataaagcccgtggaatcgccgttcatcggtgaacccacgggctttatttatacaagacaataatgtatcactcgccggccttgacgctgaggttgccgagtcgcaccagcggcggataagccttgcgcaccgcggagaacagtgcgaagccaacgatcaggccgacaaccatctggaatgagttgccgatgatttcgcctagggccggaccgaagccggacaggatgccgccggcgatgaagtagccgaacaccttccacacgccggccaccagagagccgatgacgacgttggccggtttgaattcacggaccagcagacccacgagcaccgcctgcagaccgtcgatgatgaaggtgaagattgcccactgcgggtatcccgagatgaggtcggacaacgccggtccaagaccgccgatgatgccgccgacccacgggccgaacgcataggagctgaagaaaatcatcgtgtcggacaggttgaggtatccacgggtcggggtcggaatcttcacgaacatggtcagcacggtggtgaccgcggtcatgatggcgaccaacgggatggtgttgacctgaatagctttcttgatatcgttcttgacatcctgcgtcataatacagtcttcttctctcttttttaccaaaatagcaaaatcatcttgcttttcctacgatttgtaaagaaatcgcaaggaatttctttcgatgtatcaaattgcgacataccatatcgcaacaagcgaaaattttatcccatccgcgttacaagcgcagtgcaaagcgggcggcccgcaacacccccttctcatggtgcagcggaccgcccgacagttgtttcagaccaaagtcacttggccagaccggattcgcgcaaggccttgaagccgctttcgaggtcctcgatgatgtcgtcgatgttctccagtccgatggacaggcggatggtgccctggtggatgccctggtcctcgagctcctccagcgtctcctgggagtgcgtggtggaggccgggtggatcacgaggctcttggcgtcggccacattggccagcaggctgaacaggtgcaggttgtcgatgaacacgcgtgccgcgtccttgccgcccttgatgtcgaaggtgaagatggaaccgccgccgttcgggaagtacttcttgtacaggtcgttgtccttgcggccttcgatggacgggtgggagatggactcgacctccggcacggtcttcaggtagtcgatgaccttcagcgcgttctggacgtgacgttcgacgcgcagggacagggtttcggtgccctgcagcagcaggaaggccgcgaacggggacagggtggcgccggtgtcgcgcagcaggatggcgcgcacgcgggtcacgaaggcggcgccgccgagggcctcatagaagttcaggccatggtaggacggatccggctcggtcagggtcgggaacttgcccggcacttcggcccagttgaacttgccgccttccacgatcacgccgccgagggtggtgccgtggccgccgatgaacttggtggcggattccacaacgacgtcggcgccgtgctccagcgggcggaacaggtacggggaggcgaaggtgttgtccacgatcaccggcaggtggtgcttgtgggcgatggcggtgatggcctcgaagtcgggcaggtcggcgttcgggttgccgaaggtctcgaagtagacgagcttggtgttctcctggatggcgtcctcgaactcctgcgggttctcggcggagacgaaggtggtggtgatgccgtcgcgcggcagggtgtggcgcagcaggttgaaggtgccgccgtacacgttcttggctgcgacgatgtggtcgccggactgggtgatgttgcgcaccgcgtattccacggcggccgcgccggacgcgacggccaggcccgcggtgccgccttcgagggccgcgatgcggtcttcgaacacgccctgggtggagttggtcagacggccgtagatgttgcccgggtccgccagtccgaagcgggcctcggcgtggtcgaagttgtggaagacgtagctggtggtctggtagatcggcaccgcgcgggagtcggtggccgggtcggcctgctcctggccgacgtgcagctgcagggtttcgaaacgatagttcttgtttgccatgatgcgctctccttggataagggttcgttgttctcgtcttggttggccacccgccctgccgtgtagggcgcttggccaggtgttggtagcgacaataaaccggccggcgagcgcaacgcaagccgaacgttatcgcacttgcctatatccccttataaaccgttggaatcattggctttccccactcccccaaccgttgaaaaaaccattcggaaccattcgacacgccgaagtcccgcatgccggtgacccaccgtgaggaacggatgcgcgtcaggtcaggggaacggctaaagtcatgggcaggcaaatcgcaagagaggttccgatatgagcgatgagattctgtacgaccgtgatccgcggtatattccgcgcgtcgccgcggtgcatgacatgtgcggttatggcaagtgttcgctgacggcggccattccgattctgtcggcggccggctgcgacgtttgtccggtgccgacggcgctgttttccgcgcacacgcgctacgaggtattcacgttccacgatacgaccgagattctggacggttatctggacgcatggcgtcaggagaacgtcgatttggatggcgtctattccggttttcttggttccgcggaccaggtcgcaatcatcaaacgcctatacgcggagtatccgcatgccttgcggttggtggatccggtgatgggcgacggcggagaaatctacgccacgtacactcctgagctgtgtcgggcgatgggcacgctggtggatggcgcggatgcgctgatgccgaatcttaccgaggcatccattttgacgggccgtgactatccaggccaggatatcgacgacgcgcaggtggatgagattcttggggcgttgcttgccgccggcgcgaagaacgtggtgcttaagggcatcgatcgaggggatggcatgattcgcaactatgtggcgtcagcttcgacgggcgtcgccggaaaacaggagctggcgcatgccaagctgccgttcatgacccacggcaccggcgacgcgttcgcgtcggcgctgtgcggcgcggtgatggctggccgtcctctggccgaggccgcgaacatcgccggcgagttcgtccgccatgcgatggaaagcacccagtatcagccgaatcatgaggaacgaggcgtgagcttcgaactcaatctcgacgaattgaccgctttgacccgtcgttgacggttcatcggtcactcttttcgcacagaggccttggatcgtgttgtggataggtgtggatagcgtcgactcatccaccgactatccacgacacgcccgagatacgtaagttatccacattagcctatcggccttgtcatgcgtggcttctgtctgttggactagggccatgaaccattcatcatcacatgatgttccggccccaacgcagccgccggagcagattctcgattccctagcgcggcgtctgcatgacggcacgctgcgttcccgacagatcggcgagctgggagaacagtacgccgccgcatggttggaaagccaagggtggcggacgctcgaccgcaactggcattgccgatacggcgaactcgacgtcgtgtcgcgcaatccgatgggccagatcgttttcgtcgaggtcaaaaccagacgtacgatgcgctacggcacccctcaggaggcggtgaccgcttccaagcaaatcaatctgcgccatgccgccgtgcaatggctgacggcgccggagcaccgcatgccgaacagtggcgtgcgttttgacgtcgtcaccgtcgtggtgcagggagacagacctttgctgcatcatatcgagggagcgttctgatggccatcggcagcgccctttccgtaggactgatcggtttgaaagccttcatcgtccagattcaagcgttcgtatcccctggacttccctatttctccatcatcggcctgcccgacacctcattgtccgaggcgcgcgaacgggtcaagtcggcatgccaggcaagtggtttcaaatggccggaaacccgtgtcacggtcaatctctccccagcgtccatgccgaagaaaggctcttcgcatgatctggccatcgcggccagcgtgctcagcgcggccggcgcaatcgcccatgactgtctggccggcaccatcgtgcttggcgaggtgaatcttgacggcaccgtattgcccatcaacggactgctgcccatcatgctgcatgcgcgggagcagggaatcgcaacaatcatcgtgccttacgccaaccttgatgaggcccgtctcgttccggatgtcaaggcgatcggcgtgaggcatgtcggagagctcatcgaactgatgggaggcgatgcggactaccggattcccgaagccacgcatgccgtgaacgccgatgtcggcgccacgggcatgtgccctccgcccggcgacatgagcgaagtgatgggccagcaagcggccaaatgggcgttggaggtggctgccgccggaggccatcatctgatgatgaccggtccgcccggcacaggcaagaccatgctcgcttcgcgcattcccggcatcatgagtcctttgaacgagacggaacagcttgaagtggcctcgattcgttcgttatgcggcacgcttcccggatacggaatcagcgacgttccaccgttcgaggcgccccaccataccgcgtcgaccgccgcgctggtgggtggaggcgcaggattggcccagcccggagccatcacccgcgcgcatcgcggcatcctgttcatggacgaggctccggaattctcggcgcgtacgctgcagacgctgcgcgaacctttggaatccggatatgtcgcgatttccagagcgaaaggcaccacatactatccggctcgcttccaactgattatggcggcgaatccctgcccgtgcggctacgcgtacggcaacggcgagcgctgcacctgccgagaaaaggaccgcgtcaagtatttcagccggctttccggaccgatcctcgaccgtatcgacatccagatcgaggtgcctccggtggagcggataagtccggggaacgctccctccggcgattcgagccatgccatacgtctgcgtgtcatcgttgcccggcagatggcgcaggaacggttccgcgaattcggctggtgctgcaacgcgcaggctaccggcacctggctgagagccaacacctcccccaaggccatcgaattggtcaaccgcgccttggcgagcgagcggctgagcctgcgtggcgccgaccgtgccatgcggcttgcgtggacattatccgatctggcgggaaagacttccccaggacctgaggaaatgatgcagggaatatccatgagaacgaggctggcatgatggtgacgatcgacgacgagaccctggcccgcgcggtgctcaccttctgcctggacagcgccgacgcgatgatgtacgcgctggtcaaaggcaccggctccgcggcaagcgcgctacagctgatcgctgacagcggccctggcaatcacgaaaacgtgacggccgcggcctgcacgtcattggatgcggcgttcatcaacggcgtcactcgttggggacgcaccatcaacgcccgcggaatggcttcgttccatggctcgctggtgtcatggcagcaacgtctggcatcgttgcccagcaaggatccggacgcattgcgagactggttcacagcagacggcacgcagtggatcatcgccccgcatcacccctgttggcccagccaactgaacgacctttcactgcgcaccgactgggcctccccgctctgcctatggggcaaaggcgatccgaaggcgctggtgtcatgccccgagccggtgggtatcgtcggctcacggggcgtaagcgactacggtaggcaaagcgcccacgaattggcccttcggatggcgcgtgccggacatctggtggtatccggcggcgcgctgggcaccgacgccgcggcgcattggggcgcggtcaaagccatggacgaaatgagcgccgctctggcgggacgcaccgtcgccgtattcgctggcggactgaaccatatcggtccgaaaagcaaccagaacctgttcgagcagatcgaaagccattcgggcgctttgatttccgaactgtgccccggaaccgtgccggaggcaagacggttcctgctgcgcaaccgtctgatcgcggcattgtcatccactctgatcgtggcgcaggcacgtgcgcgttccggcgcgctcaacaccgcaggctgggcgaacgaactcaaccgcaatctgttcgccgtgccgggagacatcaccatgccgcataacaccggctgcaatcgccttatccaagacggcagagccaccatcatctgctcactggcggagatcgacgaactatgccatagcgcgcatcgcccgcaacatgtcgacctgccggatgacaccgaacatccgcaggaatcgacagacgaatccgacgatgccatactcgccgccattaaaacttgcgccgaagcaaacggccacgtctccgccgacgatctgctcgatctaatggacaagacgcatccgggagaatatcccatctcgcgaatcatgcgcgaactgggctccttggagcttgaaggccgcatcagcatgcggtccggatggatcatcgccgagcagcgatagcaggcccggcacctccacctcagccgcgtcgaacgtgcgaggtcacaccttgtgcgagaatcggtggtatgagtccgaagcatgttgaagatatgtatgatgcagtgatcgtcggcgcaggcgcggccggcctgtccgcagcgttgggaatgctccgtagcgagcggatgcgccagatgcgggcggacggcatcgaaccgaacgtcctggtgatatccaaactgcagccgctgcgttcgcacaccggctccgcggaaggcggcattgcggccagccttggcaacgtggagaaagacgattggcattggcattactatgacacagtcaaaggcggcgactggcttgtcgaccaggatgcggcgaagctgcttgccgaacaggctcctgccactgtgatcgcgctggagcatgccggcgtcgcgttctcgcgtaccgatgacggccatatcgcgcagcgccgtttcggaggccataccaaggatttcggcaaggaaccggtccgccgcgccgcttatgcggccgaccgcatcgggcatcagattctgttctcgctatggcagcagtgcgtggccgagggcgttgagttcgccgaggaatggtatgtgaccgatctggtggtttccgaagaccacggcaaggtcgagggcgtggtggcgttcgacacgcacaagggcgagacgcatgccatccacgcacgcaatgtgctgatggccactggcggtgccggccgtctgttccataccacgtcgaattcgtgggatctgaccggtgacggcatggcgttgacattgtccgccggccttcagcttgaggatagcgagttcgtgcagttccatccgaccggtctcgcccataccggcattctgctgtctgaggcggcacgtgcggaaggcggcgtgctgcgcgactccgatggcgaggcgttcatggaacattacgcgccggggcatgccgatcttgccgcgcgtgatgtggtgagccgttccatcatggctgaaatcgacgccggacgaggaatcgccgatccgaagaatccggatgggccgaaggattgtgtctggctggatatgaccggcatcgatgcggatcatatgcatgaggtgctgccgcaggtggtggagaccatcgaacagtatgccgatctcgatccgacccgcgactatgtgccggtcaaacccaccgcgcattacaccatgggcggcatccccatcaccaccgacggcgaagtctaccgttgggtcgatggcgaacgcgccgtcgtggacggtctgttcgccgctggcgaatgctcctgcgtgtcggtgcatggcgcgaatcgtctgggcggcaactcgctgttggacgcctgcctcttcggcacccgttcgggcaaggcgatggctgaacgtgtcgtcgataatccagtgaacgatccgatggccgagcctgccgacgaagcatctatcgacgcggtgtcgcaggctgccgacaagcgttccgcgcaggtcaaggaactgttgacgcggccgtccgatgacgacgatgcgtcgtcggacaatccgtaccagctgatggccgatttgggatccgtcatggagcaggcggtcgcggtgcgttgcgaccggaacagcatcgaacaggcgttggctacgctggacgatacgctcacgccgcgtgccgaggcgctgcatgcgcattccgactcccccacgttcaatcaggaaatcaccgccatctgggaggtgcgccatctgttggagctcggcaaggccgtgctcgccgcctccgatgcgcgtcacgaatcccgtggatcgttgaagcgtcttgatttcccggagcgtgacgacgagcatttcctggcccattccatgacggatgtttcctgccaggtctcctggcagccggtgcacatcgtggacatgccgccaaaggcccgtgaatactgacaccctgggcacggcgtatggcagactggttgacggttttttatcgaaaggcaggtatatgagcggcatggagaacggcatggaaacggtgacgttgcgggtgaacaggttcacgccgcgtcccgaacgcggccgtgaacgaggcggctcgccgttcgctaggaagagctctcccttcggcgattccggatccacgcgcaggcgtccgcgaggcaagcagtgggtgcaggattacgcggtgccggcgcgtccggaggacaccgtgcttgactgcctgctcaaagtcaagcgcaccatcgatccgacgcttgccttccgttattcgtgcggtcatggcatgtgcggttccgatgccgtgtccatcaacggcacgcctacgcttctgtgcaccgccacggtgaaggcttgggcaaagcagccgtccgacgcacaggtggatgaggacggcttccgtcatacgggcgaagacgttcaacccgcgcaaacgcaggatgccgacgatttgggtgtcatcgagctcgcaccgctgcccggtttccccgtgcagcgtgatctgatcgccgatatcgaccagatgcttgaccaaatcaggaaactcaagccgtatctgcaggccagtggcgaactcgccaccaccgcggacggcaagatcaacgcattcgaatatctgcagaatccccagcagctcgccaagtatgagctgctgagcaactgcatagcctgcggcacctgtgagggaagctgtccggtatatgcaggcggcgaggcgttcatcggccctgcggctcttatcgccgcctcccgtttcatcaatgattcacgcgacagtcagacggatgcacgtatggatgccatcgattccgccgatggcatcgccgcgtgtcagtcggtgcgcgcctgcacgcgtgaatgcccgcgtggcatcgatgtcggtgaggagatctggcagctgatcgcccaaatcaaggagcgctgaaatggataggacgtcatataccaatctcgcgaaatcgtgggagtacgtcgaggatcatgcgttctcacgccagtctgccgaactcaatgcgatcaggaccgcggccgaggaagccggcattccccaaggatccgcggcgcaggccgaattgctgcgcatgctggtgcgaatgttggacgcctcgtcggtgatcgccatcggcaccggttccgtggtggagacgatgcagctgatcaacggtcttgacaatgcaggccagcttacggccgtcgattcgtccacgcagggcatcgcgctgattcgcaaactgttcaatcgtctgtccgatgacaccgaaaccacattgcgtgccgtgaacgcgtccgcaggtgtgtttctgccccgtctgaacgccgagaattacgatttaatcgtcgtggccggcgatccggagaattatgcggcggctttcgcgcaggctccacgcctgctgaaaccgcatgccgcgattgtcttcaccgatgtacttgcctttgattcggccacatcggccggcggcgtgctgaatcccgccaatcgtgatgccaaatccatcgcgatgcgcgaattgctggaaacagtggagtcggatgaacggttcgtcactgcgttgacgccgaccggcactggtctgctggttgccgtcaagaaatagaccaatcagattaatcagccgtgccgcaatggcacgatatgttgaaagggccacgcatgggaatgcgtggccctttcaacatatggaaatcccttttactgttcctggtgggtgccgattatctggctgaccaccacggtaccgtcttccagcaccgtctcaacttcgttcatggcatcttcgtcgccggtatggtgcttatgcttcgtaccgtcctccagttcgaatcgtttggattgatggctcagcagaatacctgagatcacggctgcgaccatggaccccaccaggacgccgaaacgggcttcagccgatagttcggcatcctgatatgccagcgacgcgatgagaaacgacaccgtgaaaccaatgccgcaggcgcaggcggcggggaacatgtcgcgcacgcgcagtcccttggccatcttcagaccgcccacgtgcgtggacagccatgcggtggtcatgatgcccagaggtttgccgaccacgagcgccaccatcacggcaacgaccaccggcgagacgaacagcgccaaggtcaacgactcgaagtgcacaccagtggcgaacagtgcgaagatcggcaacgccagcagtgcggagaacggctgcagcttgtcggcgtaacgttccgcacgcggcatcttctcaccgaaacgctcatgggccggcgtgagcagtcccacgagcacgccggccaaagtggggtgcacgccggcttcgaacatcatgacccatgccagcacgcccacgatggccacggccaaccacggtaccttgcgcatgcggaccagaaagtaccagacgaccgcgcatacggctatgccaaggaaccagtaccatgcgttcaccgatgagaagaacaccgcgatcaggatgatggccagcaggtcgtccactgtggccaatgtcatcagaaaagcgcggatggatcccggcaacgctttggcgaacagggccaatacggccaatgagaacgcgatatccgtggctgtgggcaccgcccagccattggacatctgtgcgaaggagaacgacgttcctgaagcgatgacgagttgccctgatcctgccgccgcaaacaatgagatcacgccgatgaacagtaccggcggagcaagcataccgccaaccgcgcacagcatcggcacggccgcggctttgggattggacagtgatcccgtggtgagttcctgcttcaattccagccctacggtcaggaagaacaccgtcagcaggccatcctgcacccaatggcccaatcccatgtcgatattggtgtgtggaatggctatatggaagttctcaagctgttcgaacgcatgcgcggtgaacggcagattggcgagcaataggccggcaagagcgaaaccgagcataatcagaccggatatgcggtcggacgcggctatgcgtcggattgttgcccaggttcccctcttcgatgtggccatcatgctccttgtcttgcggtccccgttcgaccgcagtatccgtaaaacgtagtatcaagtgtatcggagggtcttggcgttcgtccatgccgcatattgcgctccgctgtgcgcgcaatcaattgcaggcttcacaaaaatccatggaaaataaagaaagcctcctccgcattcgcgaaggaggttcatgtgcgcgagacaggattcgaacctgcgacctgctgatccgtagtcagctgctctaatccgctgggctactcgcgcaacgttgtcttgttttcggcaactcgaataagatacacccaaatgaactccaggcaaaatctcggcgtgtcgcaggagttttcggccttacgcctcacgtagacgaggaattttctgcgtcgacaccttgagtagtttcggagtgcccgatccggtgactgcggcttcgtctacgaccacctcttcgacgccttccatgctgggaagacggaacatggtgtcctccagcgtcttctcaataatcgaacgcaatccacgtgcgcccgtaccccgccgaatcgacgtcgccgcaatctgccgtatcgccccttcggtaaaggtcaatgtcaccccatcgacggcgaatagcttctggtactgcttgaccagcgcgttttccggttcgacgaggattcgggccaaatcgtcttcggtaagttcctcaagcacgctgactaccggcagacgtccgatgaactccggcaataatccgaaatcagccagatcatcggcggagacctgcgcaagcagctcacgcttgggaacctcatggtcatgccagaccgcaccgaaaccgctttccctggcgcccaaccgttgcgccacgatgtcggcgagtcccacgaacgcgccaccgcagatgaacagtatgtcgcgggtgtcgatctgcacggtttccatttcacgatgcttgcgggtcccttccaccggcacggaggcgacggtgccttcaaggatcttgagcagcgcctgctgcacgccctcgccggacacgtcacgcgtgatggaggtgttttcgccgcttttacgggcgatcttgtcgatttcgtcgatatatacgatgccctgctgcgcacgcgccacatccccgtcagcagcctggatgaggcgctgcagcacggtttcgacgtcatcgcccacatatcctgcctcggtgagcgtggtggcgtccgctatgacgaacggcacgttcatcacatgggccagcgtctgcgcgagatatgttttgcccacgccggtcggcccgagtagcaggatgttcgatttcgccacttgcacgccctcgaacgaatcgtcatgtccatgcatccgttccttgccgattcgcgacgactcgcgcatttccatgttgacgcgcttgtaatggttgtacaccgccactgaaagtgtctttttggcggactcctggcctatgacgtgactgtcgaggtaggcgctgatctgtgccggcttgggcagttgcaggatattgagctgggcgtccttgtcccgttcctcggaaatgatgtccacgcacaattcgatgcattcgtcgcagatggccgcgcccgaaccggtgaccagtttacgcacctggttctcggacttgccgcagaacgtgcatctcggcaccgcatcgttgtagctgaccacgcgtcccattcgcaacctcttcgtttcacatatctgccgtttagaaaacacaatacccctgccgcgacccggcaggggtattgcatttgtgaagatatcattccaccgcaggctcagctgcgatgttccagcacctcgtcaacgatgccgtattccttggcctcctgggccgtcaggaacgtgtccacttcgatgtccttgcggatcttctcgatgtcacgaccggtatgcttggccagcgtgttctccagccattcacgcatacgcagcatctccttggcctggatttcaatctccgtggccttgccgaagccctggtcgatggccggctggtggatgagcacgcgggcgttcggcagcatcagacgtttgcctttggcgccggcggccagcaggatggccgcggccgaggcggcctggccgaggcatacggtctgcacgtccggcttgatgtactgcatggtgtcgtagatggcggtcatggccgtcatggaaccgcccggcgaattgatgtacatcatcacgtcacggttcggatcctggctttccaaaaccagcagctgggccatgatgtcatcggcggaggtgtcgtccacctgcacgcccatgaagatgatgcgatcctcgaacaggcgggtgtacggatcctgcctcttgtatccgtacggggtcttttcctcgaactgcggcagaacgtaacggttctgcggtgcgaacgcggcctcacgcgccgcagccctctggaagccgaccacaccggtcggtccggccagacgttcggcgcgggctacaaactgtgcttcttcgcttgccatggtcactctcccttggtggcgctcatcgtgtcgtgggtggaaacgagcttgtccacgaagccgtactccaacgcttcttgggcggtgaaccagtggtcgtactcgttgtcgcggtagatttcctcgacggtgtgtccggtctgctcggcggtcaactcgctcatggtctttttcatgtccatgatcagctcggcgttgatgcgaacatcggtggcggtgccgccgatgccgccggacggctggtgcatcagcacacgcgcatgcgaggtcaggaagcgcttgcccttggtgccggagctcagcaggaactggcccatggatgcgcacatgcccaagcccacggtggccacgtccggctcgatgagctgcatggtatcgtagatggccatgcccgcggtgatggagccgcccggggaattgatgtacagccagatatcctttttcggatcctcggcggccagcatcagcatctgcgcgcaaatgcggttggccatctcgtccttgacttcctcacccatccagatgatgcggtccttgagcaggcggttgaaaatcggatcggtgggtcctgccggcatgtcttcgccagccatgacgggcaggggtgcactaaggttgctcaccttgtctccttttccagtgttctctatagtttcacagcctaccgcttcgaagcgacggggaacaaaattgcgcccacagtggagaagccgacggcgaaaacacggttatttgcgtttcgcgccgatgcggaaggcggtaatcaggcagcagattgcaacggcgacaatcacgatcatgacggtgaacgtccaactgccgccaaccgccgtggcatggctgaatgcctcggttccttccttgcctgcgccggcctgggccacggacagcaccgtggagaacagcgcggttccggctgcgccaccgaactgcaggcaggtgttgaacacggcgttgccatccggcatgaattgcggcgcaatgctgcgcaacgcattggtcatgatgttggagaagccaagcgcatagccaagtccgaagatgaagtagaaaccggcaagcgtggccggcgtcagccgcatggagaagaccagcagcaggatcgggccgcagatcgccaggaagaacgcgcccagaatcgggcggacagggccgaaacggtcgtacagcgtgccgccgatcggtgcgaagaaagcgccgatcaacgcgcccggcagcaccagcgcgcctgccaggaacgcgttcgttcccaaggaaagctgggcaagattggtgatcacatagccgaagccgatgccgacgattggcagcagcatgtaggcgatcagatgcagcagcaccatcggatcacgcagccatcccaagcgaatcagcggcgagaaggaacgacgggacgaccatccgaagaagaaaagcgatcccaagccgacgatcaggctgatcactgcgaaaatcgccggcgctgtagccgcaccacccgaaacggcggcggcaacagccacgcccgcctggttcaggaacatcactagaccgcacaacgccagcacaatcgccgcgaactgcagcggattcagatgcgcctcttccgtcggacggtgctgttcgatgcatttgaggccgacaggcagcgaaatcagcagaatcacgggaatgacgatgacgaaaatcgcacgccatggcagaatgctcgacaccgcgccacccacggtcgggccgatggcgggcgccacggtgatgacgagcgaaccgacgcccatcagtcgtccgaccttgctgcgtggggactgttcgagaatgatgttcatcatcagcggtgtggccacgccagagccgatgccctggatgatgcgggctactagaatcaccgggaacgcatggccgaagatcatggtcagcgagccaagcaccgcaagcgccaccgcggcgaggaacaggacgcgatgcttgaatttgcggttaagatacgacgacagcggcatggtggctgcgaccgtcagcaggtagatggtggtgatccactgcacagtagcagtgttcacgttgaattcccgcatgagctgtgggaacagcaccgtcatcacggtttcggtgaggatgccgatgaaggcgagcgagccgaccgccacgatggcgccgatgagtttgccgggaatgcgttcgtccggcgtttccttgatgttttcgctattgttcctattgttatggtcggtggtttcgagcgttgtattccgttctttcataatcactttccgcgcactttttcctgcggccatgtgcgacgccgcgattgacgcatgggccttgcaaagcaagcaggcgtcaaccccagcgaagaattctagcggaacccctgacccaatgcctgcaggaaacgaacatcaggcgttgcgctggccggaacggccgtcaccgttatcgtcctcttcgtgcagaatcttccgaatccgctccaatctcggcttgacctcatgctcgtaaccgcggtcgttcggatggtaatactcgcgcccctgcaattcgtcaggcatgtactgctgcggcgccaccgcgcccggccaatcgtgcgcgtaccggtagccttcgtggttgccccagcttttcatcagcgcggtcggcgcattgcgcagatgcagcggcacttggccgataagccccgcgtccacgtcggcgagcgccgcgttgatggcgttgtagctggcgttggatttgggcgcggtggcgacggcgagcgccgcttcggcaagaatgatgcgcgcttcgggcatgccgatcatggccactgcctgcgccgcggctacggtgacttgcaggacctgcggggcggccatgccgacttcctcggatgcggcgatcatgatgcgtcgtgcgatgaagcgcgggtcttcccccgcgcgcagcatgcgggccagataatgcatggtggcgtccggatcggagcctcgcatggatttgatgaacgctgagatgacgtcgtagtggtcgtctccgtccttgtcgtaacgcacggtggccacgtccatgaccttcgacaccacatcaggcgtgatgatgggccgtttcgcgcctttttttcgttctttgtcaccagtgagcgcgccggccgcggcttcgaggatggtcagtgtcttacgtgcgtcgccgccggccatgcggatgatctcatccacagcctcgtcggtgattctgatttcgttgtcaaggccgtgtttgcttgcgatggcgcgattgatcagcgttttcagatcgtccggttccagcgattcgagtttgacgaccacggatcggctgagcagcggcttgatgacggagaagcttgggttttccgtggtggccgcgatgaaggtgacgtcgcggttttccacactgggcagcaacgcatcctgctgtgatttggagaagcggtgcacctcgtcgatgaacaacaccgtttccttgccttcggagacgagacgttcgtgcgcgcgtttgagcacgtcacgcacgtccttgacgccggaggtgaccgcggacagttcctcgaagacacggccggactgtttggcgacgatataggcgagggtggttttgccgactccgggaggtccgaacaggatgatggagctcggtgcggtgagcgagcctttcgaagcggggttggcgagtctgcgcaatggcgacccctcccccaatacccgtgattgccccaccacatcgtcgatgctcgctgggcgcatgcgtacggcaagcgggcgcgtcacatcatccggcgcgtccatcgcggcaaacaaatcgtcagtcatgctttccactgtaccgcaacacacccaacaattcgaacacacgttcgatgcatgcgttcgccccaaccggtagactggcaagcatggcagacgatacgaattatggctcgctgggcgcgttggcgccgaattgggacgagggcgagcgcaacatcgacacggatgagatctatgagcgtttcttcacctgggtggaggacgtcaaaggcgtggaaccgtggccgcatcaggaggaggccatcatggatctgctggccggcgaccatgtcattttgaacactccgaccggttcgggcaagtcgctggtggcgctcggcatgcatttcgccgcgttgtgcacgggccgccgttcctattacacggctccgatcaaggctctggtgtctgagaagttcttcgacttggttgaagttttcggccgcgagaacgtcggcatgatcaccggcgacacgcatatcaacgcggatgcgccgatcatctgctgcaccgcggagatcctcgccaatcaggcgttgcgcgagggccgccacgccgatgtcggctgcgtggcgatggacgagttccactattacggcgatcccgagcgcggctgggcttggcaggtgccgctgcttacgctgccggatacgcagttcctgttgatgagcgcgacgctgggcaatgtcgatgcgatcgccgacaagcttgaggacatgacggacaccgacgtggatatcatcgccgatgcgccacgtcccgtgccgttgacgtacgaatacacactcgacccgttggagaagacggtggaattggcgttcggcaagggcgagacgccgatttacgtggtgcatttctctcaggatgccgcgttggagaccgccaacgcgctggccagcacgggcgtgtccagcaaggagcagcgcgccgcgatcgcggaagccatcaagggcacgaagttcaccaccgcgttcggcaagatcctgcagcgtctgttgcgtaccggcatcggcatccaccatgccggcatgctcccccgctatcgtcgtctggtggagcagctcgcccagcagggactgctgccagtgatctgcggcaccgacacgcttggtgtcggtatcaatgtgccgattcattccgtggtattgaccgcgttgaccaagttcgacggcacgaagatgcgcaagctgcgcgcccgcgagttccatcagatcgcaggacgcgccggacgcatgggcttcgacacggagggtctggtcatagccgaagcccccgaattcgaaatcgagaacgccaaggctctggccaaggcaggcaacgatccgaagaaactgaagaaggtcaagcgcaagaaggctcctgaaggtttcgtaacgtggaacgagaacacgttcgacaagcttatcgacgcggctccggaaacactggtgccgcatatgaagatcacccattccatggtgttgaacgaggtggagcagggcggcgacgcccgctaccgcatcgaccggcttatcgacgattcggcgcagactccggagcagaaggagcgcctgcacgcccgcgcggacgagatcttccagaccttgttcgacacgaacgtcatcgagaccgaagaccgtgacgatggcggcaaggattatttcatgaccgtggacatgccggacgatttcgccctcgatcagccgctaagcccgttcctgctggccgcgttggaactgctcgacccggagtcggacacgtatgcgttggatgtgatatccatggttgaggccacgttggaggacccgaagcaggtgctgcgcgcgcaggaacgtcaggcgcgcgacgaggcgatgatccgcatgaaagaggatggcctcgactatgacgagcgtatggacaggcttcaggagatcacctatccgaagccgttggaggatatgctgcaggccgcgttcgatgaataccgccatgatgttccgtgggcgaacgactattggctgagcccgaaatccgtggtgcgcgacatggtggagaccgcttccgatttcaccggctacatcgcccgctacaacatcgcccgttccgaaggcacgttgctgcgttacctgtccgacgcctaccgtgcgctggcgcgtaccgttccgcaggagaagcgcgacgaacagctcgacgacatcatctcctggctgcgtgtggtggtccgttccatcgattcctcgctggtggacgagtgggagaacgcgggaacggacaccgacgcgtccgaggcggccgccaacctcgccgcgcccggcgcgaagcaggccgtggtggaggaccgtcgcggactcaccgtattggtacgcaacgccatgttccgccgcgtgcagctcatggacctcgacaagccggacgagctcggcgcgctcgacaaggactggggttacggcgtgcacgaatgggaagacacgctcgacgattactacgacgagcacgaatacgtcaacatcgacgcgaaggcacgcagcggcgagctgttcatcctcgacgaaagcaaggagaacagcgagcattcctggaaggtgcggcagatcatcgacgattccgatggcgaccacgattgggccatcaccggaaccgtcgacctggacaccacacaatccagcggcgaggttgtcttcttcgactacagcgtgtccaactgacggcgcatctcgtcggcgtcgacttcgagcggcggccagatcatgttcatgttcttgagcgtgttgcgcagcagctcggagacgacggccctcgaataccaacgattgtcggcaggcaccagataccacggcgcctgctcggtgctggtgcgcaggaacacatcctgccatgcagccatgtagtcgtcccagcgggcgcgcgcctcaaggtcgctcggatcgaacttccagcatttggtcggatcatcgagacggctcaggaagtggcgtttctgctcgtctttgctgaccacgaggaagattttgatgatggcgcatccgtcggccgtcaattgcgattcgaatcggttgatttcgtcgtaccgtgcctgccacacttcttccggctgcgttttgtagatgcgcggcatgacgatgtcctcgtaatgggaccggtcgaagatggagatccatccgttgttcggcagctcgcgtttgatgcgccacagatagtcatggtccagttcttcgcctttcggcgcgccgaaaccgtgatagtgcatgcccatcgggtcgccttggctgaacacatgtcgtacgatgccgcctttgcctgacgcgtccatgccttgcagcacgatcagcaatcgccgatgcgagcctttcacgccattggcgtacataagccgctggtaacgggcgatctccgacgagctgatggatatgaatcgttcggcatcatccttgttgccgtcaaaaccaggagtggaatcgccatctatgtccgataccttcgtgtcgtgatggaatcgcaatagctgggtcggcggcaacgtccataccgagctcagtagttcgctcgcttttgcggcgttcgccaatccttcggcgacggaatcgcaattctcgcttttttccagccgatcttccactttgttcagcgttttcgcgatcgaagacattctggcgtcgtcttttttcgcatccttggttttatccgccatgtcaagcctccctgcttggtacggaccacatgcgtgcagtccatcgtagacacgaaaggggccgcttccccgtatttcgcgggaaaacgacccctacgcgtgttatgcgataccggtgctattcgtcggcttcggacttgttcttgtccttgccatcgcccttcgtcttgaacggattgtccttgatcggatgtccattcttgtcgaatttgacctggctttccggatgcgtctcatcgaagccttgggcgtacctggtctgacgccactggtggatggacgcgttggtgccgcgatggtgcacatggtagacacgctgcgcgccacccagcggcacgccttccttggccacggcgatctggttcacgttcgacggatccatgatggcgatcggcgcgaccggttccggttcggccggtgcagccgtatgctgctgcatgcgcgacggcagccattcggccagcctgctcaacagccagcagacgatgaaatagacgaccgcggccaccaccagcgtctgcagaatgttgaagtacatcgatccaagtcgacgtgattcctgcagcaggtcggtgtacatgatgatcgagccgagcgcggtgtccttcaacacgacgaccagctgggtcacggccgccggcagcatggcgtagatggcctgcggcacttcgatctgcaacagagactgcgtacgggtcaatcccaaggcgagcgaggcctcacgctggccgttcggcaggttgcccacgccggaacgcaccagctcggctaccacggatccgttgtagatcacgagcgcgagcaccaccgcccaatacgcggggctgggcagacctgcgaaggcgaaccagcgccagaagaagatcatgagcagcagaacggggacggctcgtgcgaattccacgatcgcgccggaaatggtacggatcagcaggctcggcagcagtcggcccacaccaaagaccaggccgaacaccacggctccgaccacggccagtacggacgcgcggatcgtggcccacagtcccggcagatagaagtcggtccatgcttcggcgtcaagcgccggcttccatagtttccagctcagctggttctcgccgtccggcggattgtgcagacgcatgaggatcagcacgaccaccaccgcgaagatgatgcctgcgatccaattgacgatacggatggttttgcggcccttcggaccaggctggtcgaacagcaccgcgctttcattgcttgccatgtcgcgtcacctcctcaccgcgagcttgttggatagatacgtggtcagcatgccgattggaatgatcagaaccacatagccgaaggcgaagatcaggaagatcggtacgatttggtcggcgtggtattcgatcatttcgctcatcatcgtcgaggtttcggtggccacggatgccgccgccgcgacggtggagttcttcagcaacgcgatcagcgtgttgcccaacggcgccacggaaccgcggaacgcctgcggcaggatgatctgagtggcggcctgcatgaagttcaggcccaacgcgcgggcggcctcggcttgaccaagcggcacggtgttgatgccggagcgcagcgattcacatacgaaagccgcggtgtacaggctcaggcccgtcacggccagccagaagaagttggtggcgaacgtgtcggagaagctgaacttcagctgcgcgtacgcacccagcaccatgaacaccatgatgatggtcagtggcaggttcttgaacagttcgacgtaggcaccggaaacggtacggagcgaggcgatcggagaaatgcgcatcatcacgaggacgacgcccagaatcgtggagaacaacgccgaccacagggtcagctcgatgttcaccagaaacgcgccgggaatgttgtattggctgaacaacgcgaggaatccgtccatcacttattcccctttccattcggcaccggcggattgtacttggcgttcggcgtgtaggccactcccctggtgttgtcggaaatagccctttgccaagaaccgtcctgaatcatatcggtgatggcgttgttgattttgttcttcagctcggtgttgcccttcttgacaccgatgccataatattcctgggtgaacggcttgcccaccacgcgcaggcgtccacgtgaggcggatgcgaggccagcgagaatgatgtcgtcggtggtggcggcgtccacaatgccggaaagcaacgcggtggcgcattccgccatgccgggctgttccatcaactgggtctgcttggcgaacttctccttgacgttgacggcggatgtggtgccggtcatggagcacagccgcttgccgttcagatccttaggtccgtcaatgccggtttcgtccttgcgtaccagcagatcctgtccggccacgaaatacgggccggcgaaatcgacgaccttcttgcgttcgtcggtgatggaataggatgcgacgatgtagtcgacatcgccgttctgcagcatagcctcacgctgcttggacggcgattccttccatacgatctcgtcttcggaatagccgagtttcttggccacgtacttggccacgtccacgtcgaagccgacgtaggtgccgttcttcttgaagcccaggccaggctggtcgaatttgatgccgatgcggatcttgccggtttcgtccgcgccgcatgcggataccgcgaacacgcacgcgcacgcgcagaatgccgcgacggctctgcgcaacatgcgtttcgtcgtgatcgaaagtggtttcatatcaggttccttcttctgtcgttatgttccgtcacttcagtgggtgaggatcttcgacaggaagtccttggcgcgatcggtcttcggatgttcgaagaagtcgtccggcgtgctctgttcgagaatctgtccgtcggccatgaacacgaccttgtcggccaccttgcgcgcgaaacccatctcgtgggtcacgcacagcatggtcatgccttcgtgggcgagttcgaccatgacgtcaagcacttcgttgaccatttccgggtcgagagcggacgtcggctcgtcgaacagcatgaccttcggctgcatggcgagggcgcgggcgatggcgacacgctgctgctggccgccggacagctgcgacggcattttggaggcctgcgaggccacgccgacgcggcccagcagatccatggccaggtcctcggcttccttcttgtccatgtggcgcaccttgatcggtgccaatgtcacgttttccaaaatggttttgttggcgaacaggttgaacgattggaacaccatgcccacttccgcgcgcagactggcgagttccttgccttcctgcggcaacggcttgccgtcgatgcggatatcgccggaatcgatggtttccagacggttgatggtgcggcacatcgtggatttgccggagccggacggtccgacgatgacgagcacctcgcctttgcgtacggtgaggttgatgtccttgagcacatgcagatcgccataatgcttctcgacatgggtcagttcgacgagcggcctgttatccgctcccgcgtccggcatgatgggacgcttcgcttcggtttctttcatttcagacataaagggcagtataagaaagcaatgcgaaattcatgtttcctatactgcccgttcacatcatttcgtccggaatatgagacatttcataccgtttgacgaacatattcatcaaacggatcgccgccggagcaatgtcacagcaccttggagaggaaggtcttcaatcgttcgctcttcggatggttgaagatctcgtcaggggttccctcttcctcgatcacgccggcatcggtgaagatgaccctcgtggccacttcgcgtgcgaagcccatctcatgggtcaccagcaccatggtcatgcctttggcggcaaggtcgcgaatcacttcgagcacatcgcccaccatttccgggtcgagcgcggatgtcgcctcgtcgaacagcatcaccttcggattcatcgccagcgagcgcgcgatcgccacacgctgcttctgcccgccggacagcgatttcggcatggcgtcggctttttcggccaatcctacggttttcagcagttccatggcgtgcgcgcgggcctgctcatccgtttcatgatgcaccagtttcggtgcgagggtgatgttgtcgatcacgctcatgttgttgaacaggttgaaatgctggaacaccatgcccacctgctcgcgcacctggtcgatgttcacatggctgtccgtcaaatcgtgtccgttgaccacgatcttgccgccggtggcctgttcgagtccgttcaggcaacgcaatatggtggatttgccggcgccggacggtccgatgatgcaaatcacctcgcctttgcgcacggtcatgtcgacgcctttgatgacctcggtctgcccgtagcttttgtgcagatccttgacgtcgatgatcacgtcgttctcgttcatcggttcaccttcctgtccacgatgttggccagccacgtcaggatggtgatggccacgaagtacatgacgccgacgatcagcagcgtttcggttacgcggaagttcgccgcgtacagctgctgcgcctggtacagcagctcaccgaagccgatggcgagcagcagcgaggagtccttgatcatgatgaccagctggttgatgatcgaaggcatggcgattttgctggcctgcggcagaatcactcggcgcatggcctgcctgtggttgagtcccagcgaacgtgcgccctccatctgtccggaatcgaccgattggactgcgccacgcacgatttccgccaggtacgcgccggagttgagcgacaaggtcaatgcgccggcgacccagatgttcacgctatgtccgatgagctggggcacgccgaagtagaagaagaacgcccacaccaggatcggggtgccgcggaacaccgcgatgtacacattggccaatcctgcggcgattttgctttccgaaaccttcatcaggccgaacgcgacgccgagcaccaatgcgatcgcgaaggaaagcagcgtgatcagcagcgtgttcctcaagcccgtcagcaatgccggcatcgactgtttgaccagtccgaggaaaccgaccttctgttgttcggcgctgtcgtcgccattgtcggtgatcatgccggaaatcgatttggcctgctctttcgcgccttgcttgccaagatattgtgcgacgattcgctcgtattctcccgaagcgatcatcttgttcaatccatcgttgatggcggccagcaaatctgcgttcatgcctttgttcacggccatgccgtattcgccgtgcggcaccttcggagtcacgattttcagaccgttgttctgcgatacgccatatgccagtaccggataatcgtcgaacaccgcgacggcattgccggatttgaccatctcgtacatggttgaggattggtcgacggaagtcaccttgtaaccgtacttgtcggcatgctgtttggcgtacgattcgccctccgagccggttttcgccacaaccgtccggcctttgaggtccttatagccggtgacgtcgtcgttgttggccgcgacggccatctggatgccggattggaaatacggattcgagaaatcataggaggctttacgctcgtcagtgatggacatgccggctatgacgacgtccacctggttggagcttagggcctgcaacgcggcgttgaatcccagcgactgtatctcgaccttaaagccctcttccttggcgatgcctcggattagctccatgtcgatgccggtcatcttgccgttctcacggtattcgaacggtgcgaacgtggtgtcggtgccgattttatatgtcttgcccttgaccgaggccggattgccagtttcggaggcgagcgcatgcggaacggtcgtcatgaatgccgcaaagaccacggcgagcacggcgaacagcgcgcatatgcgcatgccgaccgcgttcagtcgcttcttgtcctgtgttttcgatttcataccgcgcttcaaccctttctggttgccggataatcaaacacgctccactgtaatgacagcgacggaaaatagacaacgcgaataataaaaaatgtccgagcatcattgatgttcggacatttttcattcatctatgggcgaaaccgtatcagtcctcgtcctcatccggatcgtaatcgacaccggtctcggcgcgctgctcagcggagatcggagccggggcgccggtcagcggatcgcggccgccgccagccttcgggaaggcgatgacgtcgcggatggagtcggcgccagccagaattgcggcggtacgatcccagccgagagcgatgccggcgtgaggcggagcgccgtacttgaatgcctcaagcaggaagccgaacttgtctgcggcctcttccggcgtgatgccgagcacgtcaagcacacggtcctgaatgtcgtcgcggtggatacgcacggagccgccacccatttcgttgccgttgcacacgatgtcgtaggaatcggacatggcgtgttccggatccttgtcgaacttgtcgatccaatccttggacggcatggtgaacgggtggtgcatggaggtccacttggagtggccgactgccacatcgtcgtcgtccgggtcatcggtcggcttgaacagcgggaagtccacaacccaagtgaaggcgaaatcgtcgggcttgagcaggcccgcgcggcgggcaagctcgacacgcacggcgcccagcagttcctgggaggaggtgcggcgaccggctgcgaagaacacggcgtcgccgtcttcggcgccgacggcttccttcagaccgttgcgttcctcttcggacaggttcttggcgacggggcccttgagttcgccgttctcggcgaacaccacataggcgaggcccttggcgccacgctgcttggcccaatcctgccatgcgtcgaactgacggcgaggcgtggccgcgccacccttgaagagcaccgcgccgacgtatggggcctggaacacgcggaacggcgtgttcttgaagtaatcggtcagttcgatcagcggattgccgaaacgcagatccggcttgtcggaaccgtacttgtccatggcgtcctgccaggtgatgcgctggatcggcagcttgatgtcgtagccggcggacttccagatggcggcgatgaccttttcggccatggccatcacgtcctcctggtccacgaaggccatctccatgtcgagctgggtgaattccggctggcggtcggcgcggaagtcctcgtcacgatagcagcgggccagctggtagtaacgctcgacgccggagaccatgagcagctgcttgagcagctgcggggactgcggcagagcgtaccaggaacccggcaccagacgggccggcacgacgaagtcacgggcgccttccggcgtggacttgatcatggtcggggtttcgatctcctcgaagcccatttcctccagcgcatggcgggcggccttcgacatctgggctcgcagcttcagattgcgctgcatggacggacgacgcaggtcgaggtaacggtacttcaaacgcacgtcctcgcccggcagcttgttctcggactcgttctcaagagcggtggagacctggaacggcagagcatcggacttggccagcacttcgatgctttcggccacgacttcgatcttgccggtggccagatgctcgttctcgttgccgtccggacgcagacgaacctcgccgacgacctggatcacgaattcggagcgcagcggacgggccatctcctcgtcatagatgacgacctgcaccagaccggtgttgtcacgaagatcaatgaaggccacgccaccgtggtcgcggcgacgatcgacccaaccggcgagcgtcaccttctgaccgacgagctgttcggtcacttcggttgcatgatgtgttctgtaagccgtctggctcatgcttcccctattccttatcctcttgtatgttgcgaagtcttgcgatttcaggcttcaacggtaacggtttgctgggcatacacagtatccggctcccacgactgtgcgtcagccggccgctggtctcctgtgatgatgttcttgacttcgtcctgggcgccctcttcggaagcgtcagccgggaaccagacgtacgggatgccgagcttgtctgcatatttgatctgcttgccgagcttggccgcggtcggcgccacgtccgccgcgatgccacgggagcgcagctggttggcgatcaggttggacgcggagcggtcggcttcattccataccgccacgagcacggatgccggagacacacggttggcgtgcgcgcccgcggtgtgcagcatgtaggagaccaggcgggacaggccgatggacaggcccacgcccgggtacttcttgttgccctgcgatgcgaggttgtcgtaacggccgccggagcagatggagcccaaagcggcggcgccgtcgaggaacgtctcatacacggaaccggtgtagtaatcaagaccacgggcgattttcagatcggcgatcacggagcccggacggatgcgcgcggcctcgtcgacgatcatcgccagcgtgtcgagtccctggcgtgccaacacgtaggcgtcggaatcagacgcgatgtcatgcttggcgcacaatgcgtcgaacttgtcggacagttccttgccgtcggcagcggtcagctcggccagttcgaggcaggcacgggcctgggcttcgtcggcgccgcagccttcgacgagcagcttggccacctcatcggcgccgatcttgtcgagcttgtcgatctcacgcagcacgccttcgatatccgtaagacccaaaccacggtagaagccttcggagagtttgcggttgttcgcatgcacggtggccttcggcagaccgaactcgcgcagacgttccaatgcggacaccatgaccaacggcaattcgacctcgtaatggtcgggcagatcgccattgccgatcacgtcgatgtcggcctgcacgaactcgcggaaacgtccttcctgcgggcgttcgccacgccagaccttctgaatctgccaacgtttgaacgggaacgccagatcgccggaatgttcgacgacataacggctcagcggaacggtcagatcgaagtgcagaccaagacgatcctcaatcggagtgtcggactcgtgtccgacttcctgaagacggctcagcaggtaaatctccttgctggtctcgcctttcttgagcaggctggaaccctgctcaacagcacgggtttcaatgcctatgaagccattgagctcgaatacattacggagcgtgtcgatgacacgctgctccacaacacgttcagaggggagccactctggaaatcctgaaatagatgcacctttagccacggttctctataataaatgaggttacggaaaatgccgcgcgtttttcaaggtgtggaagcgcacgtcacggaccgtcacctctgcactacatgaagcttacgtaaggagctggccatggccgacgagaatgtcaccgcgtccgagaacaccactgaaaccaacgagcaggcagcgacgcccgcaacccaggccagcaaaccggccgtcccgagcccagcggccatgaagccgcatgcgccgagccccgcggccttcgccaagaaggctccgcagcgtcctgcaacctccaccggattctccgaagccgatatcaaggccaccgaagcgttcggccgtgtcgccgatgacggcaccgtgttcgtgaaggaaggcgagggagaacgcgaggtcggacagtttccggacgcttccaaggaagaggccctggcactgtatgcccgtcgctatctcgatctgaaggcaaagctcgacctgttcgccaacaggctcaagtccagcaatgtgaagaaccgtgagatcgacgagtccatcaagacgctttccgccgaaatcgagcagccggccgtcgtcggagatattgaggcgctcaagtcccagttcgaagcactgaaggaggccggagcggccaagaaggccgagctgagcgaggcccacaaggccgccgtcgccaaggcgctggccgaacgtaccgcgattgtggagaaggccgaggctctggccaattccctgggcgacaacaccaactggcgttccaccgcggacaagttccgttcgctgttccagcagtggcaggatcaccagcacaatagcgtccgtctcgacaaggccgacgccgacgccctgtggtcccgtttctcctccgcccgcactacgttcaacagcgcccgccgcaagtgggcccagggccgcgatgaggagcgcagcaacgccaaggccgcgaaggaggccatcatcgccgaagccgaggagatcaaggattccaccgcttgggtggaaacctcccgcaagttcaacgagctgatggatcgttggaagaaggccggtcgtgcgggccgtcgtgatgatgacgcgctgtgggcacgtttccgtgctgcggcagacacgttcttcaacgcccgtcaggccgatcgcgagcagattagctcgtccgaaaaggaaaatctcgccaagaaggaagaactgctgaccaaggctgaggctttggtgccggtcaaggatgagaaggccgccaagcaggctcgccaggcattggccgccattcaggaggaatgggaccagatcggctacgttccgcgcgatgacatgcaccgcatcgaaagccgtcttgatgctgtcgacaagcagatcaaggctgttgaggatgccgcctggaagcagtccgatccggaagccgacgcccgtaagtcctccttcgaggagcagctcaacgcacagctcgccgaacttgacgcccagatcgccgctgagtccgatccgaagaagaaggccaagcttgaggcggagaaggccaccaaggaacagtggctgaacgccatcaagtaatgacgctcccatagagcgatacggttgtggttccgcttggaagcgggcggaaccacaaccgtccagctgaacgaatagctggacgaataggcatatgtaaaaaagaccggtgggtttcatgacattccatcatgaaacccaccggtctttttgcatacgcgttgccggggttcttaccccggcaacgttggaaatcagttctgcgactgcgcggaatcagccggttccgtcgatgccgtcggttcagtggcggcatcggtttcagcggccgtttcggtcgcctccgccggattatccttctggttcggctcttcgaaggcctcgccggtgaacgtgaactcacccagaatgccttcgccttcggcgtccaccttcacgcgctggccatcttcgaggtcgcccatcaggatcttctccgaaatggcgtcctcgatgtcgcgctgaatcacgcgacgcagcggacgggcgcccagcagcgggtcgaagcccttctgtgcgagcagatccttggccgcgtcggtcagttcgagcgacatgtgacggtcgaacagacggtcgttgagctgcttgacatccaagtcgacgatctgacgcacctgcggttcggtgagctgcttgaacacgatgatgtcatccagacggttcaggaactccggacggaactgctgcttgagttcggcggagacctgttccttcatgcgctggtagctcgattcggtgttcgtgcccaggttgaaaccggtgttggcggccttggcgatgtcacgagtgccgaggttggtggtcaggatgatgatggtgttcttgaagtccaccttgcgtccctggccatcggtcagatggccatcgtccagcacctgcaacagcgtgttgaaaatgtccggatgggctttttcgatttcgtcgaacaacaccacggagaacggcttgcgacgcaccttttcggtaagttcgccgccttcttcgtagccgacgtatcccggaggcgcaccgaacaggcgcgacgcggcgtacttttcggagaattccgacatgtccacgcggatcagcgcatcctcatcgtcgaacaggaattcggcgagagccttggccagctcggtcttaccaacgccggtcgggccagcgaagatgaacgaaccagccggacgcttcggatccttcaatccgacgcgtgcgcgacggatggaacggctcaatgcggacacagcctcatcctgaccgatgatgcgcttgtgcagttcactctccatgcccatgagcttcttggactcggcctgggtgagcttgaacaccggaatgccggtggtctgggaaatcacctcagcgatgacgtcctcatccaccaccatcttcacatcggactcgccctcacgccaagcggattccttctccttgcgctcggactcgatcttctcctgcttgtcacgcagctcggcggccttctcaaagtcctggtccttgatggcctggtccttctcctcggccagcttggcagccttggcgtccaattccttgagctccggcggagcggtgagcctgcggatacgcagtcgggcgccggcctcatcgatcagatcgatggccttgtcgggcaggtggcggtcctgaatgtagcggctggaaagttccgccgcggcctgcagcgcgccatcggtgatcgtcacatgatggtggttctcgtaacgctcacgcaagcccttcagaatctcaatggtctcggcgatggtcggctcgtgcacctggatcggctggaaacgacgttccagcgcggcatccttctcgatgtacttgcggtactcgtcggtggtggtcgcgccgatggtctgcagttcgccacgggccagcatcggcttcaacatatcggaagcgcccaaggcgccatccgcggagcctgcgcccacgatggtgtgaatctcatcgatgaacagcacgatgtcgccgcgggtcttgatctccttcaaaaccttcttcaggcgttcctcgaaatcgccacggtagcgggaaccagcaaccatggaaccgaggtccaaggagtagacctgcttgcctttcagcgtttccggcacatcaccggcgttgatcttctgcgcgagtccttcgaccaccgcggtcttgcctacgccaggctcgccgatcagcaccgggttgttcttggtgcggcggctcaacaccaccatcacacgctcgatctcgttggatcgtccgattaccggatcgagcttcccagcggcagcctcagccgtaaggttgcggccgaactggtcgagaatcgcggaaccggtctgattgcgacggtcctgcacgccaccggcattggcgagttcgcccttgccatcgttcttgccgtcgctggaattgcctcggatcagatcgatggtggcgctacgcagttcgccaaggttgacatccatcttgatcagcacctgtgtgccgacgccttcgccctcatgaatcagaccgagcaggatatgctcggtgccgatatagctgtgccccagctgcaacgcctcacgtagcgacagctccaacacctgcctggcatgcggggtgaagggaatgtggccgttcggcgacgcatttcccttgccgatcatctcttcgacctgcttgcgggtgtcgtccaaggtcacgcccttcgaggccaatgccttggcggcaacgccttcaccctcacgaatcaggcccagcagcagatgctcggtgccgatgtagttgtgctggagggtccgagcttcttcctgcgccaacacaatcacgcgtcgcgcacggtcggtaaaccgttcgaacatgcttgtccttccactcttgttagtccttcaacactctaccgattcgcggtgacgtttattccgccggcgcgtaaattgcgctatggacgcaaaggaacggatatgcttgacttatggcaacgaccaaggaggtcaccaaatgagcgacaccatcctgcaatcgaatgatgtgatggattcccgccgaggcgacatcgtcgtcggcgtcgacgggtccgatgaatccttcgcagccctgcgttgggctcttggcgaagcatcgctgaccggacagcaggtgaatgcggtctacgcatggacccattcatgggatatgggatcccagccggaagatgaggagcaatgggcgcagatgcgtcatgatatcgcccgtcggctgcgcgaatgggtggcccaggcctcgcaaggcatgacgattgacgagaaccgcgtcaaactcacctccgtcaaagccaccggaacggcagcgcttctggaaatcggcaaggacgcccaacagatcgtcgtcggacgtcgttcgcttggacgcgtggcacgatggtttctgggatcgctttccgcttctcttgcagaggaggcgaaggtgcccgtcaccgtggtgcgtatcctcgatgatgaagaggcatccgtgcaggacgccatcgccaatgcacttacgccgaccgaggaaacggtctcctacacgatgccgggttctcccctgcctcggaaccagcgtccggtggttgtaggcgttgatggttcggagacctccaaacacgctttgcgtttcgccatcgatttcgcggccctgcatcacgctcccctgcaggtcatgttctgctggcagctgaaagatttgggcgtggtcaaagggtatgagaacgccgtcgctcccatctccgtcggccaggcgcaggcggaacgcatgcttgatgaattgctcgattcggttcaggtttcatcagcgaacattcccgacgatttccaaatcgaatcgcacgctttccatattcccgcctcgaaggggcttatcgcggcttcccgctacgcacgtcatctagtggtcggttcgcgcggcttgtccggtctggacgcgcatttccttggatcggtttccaagcaaatcatcaacttcgcagactgcaccgtcaccgtcgtgcactgaccgcataaaaaagaaaacaagatatgagagggccacgtacacattcaggtacgtggccctctcatatacgatgacgattattcgtcggattcggcttgagccgacgaatcagcttccgtcatttcgctttccgttgtttcagccgccgccggttcggtttccgccgattcggcttctgttgactcggtttccaccgattcgtcttccatcgatttgttttccgtttgcccggtggtttcagcagtcggctcaactaccgtctcatccatctgttcaaccggctcgaccgacccggcggaattgacggaatcggcggaatcaacctgttcagcctgttcgactggctcgtccgattcagtcggctcagccgtatcagccgattcggtatcgtccgacgtttccggcttattctcgtcgaccacggtgacggtggtctctacttcaggcgcatcgtcggaggccacatgctcaagcacatcctcttggctggcgtcgtcgtcgatggtgttggcttcgatgtccgcgtccgaaccttcctcatcctcattcggattatggtcgtcatcggacgaaagctgttcgatcagctccacggagccccgctcgtcacgcggcgcctgggcgatgatatcgatatgcatgtcgtcgaacgccggcttcgactgcacccacagatgcgacggctccggtggatcgatttcggaatgctctccgcagccatgatcgatggacacgaccctgccgtcatccgggctccacttgttggcgcacacgccgaacagcaggttcaactcacccttcagcggaatgaagaatccgcatgtggagcaaggattgccgtcggccgtcttggtggatagcgattttggcccatgtgggccttcgtaccaacgttttgcggtctgcgaccggccaagcggagtcaacacgtgcctgcgggacaggtcgaattcctcgaccgcctcttcgacatcctcttcggacgtcacaggctgttcggaatcctccgaaacgtccgtcttctcagactcatccgaagcgtttccatccatcgccggttcctgtacggtttcatccgcgactgacggtttgtcgtccgtatcgtccgatgtctcggcatcctgcgtcttgcggaagccctcttccatgcgggggtcatcgggatcggtgccgattgaatcagtcaccgccaaatcgcccggctcgagacggtccttccaaggaatccattttggcggacgcagggccttgtcggtcgggaccagggatgattcgttgaccgtccaatggtccagttcgacatcatggtataacgtgaccgaccattgccagccttcgtagccgcgtactcgggattcgaagcggaaatcggtgacgttgtctcccaggtcgatggcttccacgaagtcgccgacctgaccgtcctcgtcggacactgtgacagcgaccgcttgggcgattgccttgggatccattgtggtatcggacatgaaactctattcctgtacgtcgaaattgtcggcgaccgcgcgcagaagcgtggcgagcttcttgctttcagccggtgaaggatagcgatgtcgacgaagctgattgcccgcggagtcaagcagcttgatcagatcctccacgatggcggccatatcgtccggcttcggacgggtggctttaaccagcgacggggccgaggcaaccagcgtcactcccatcgcctgcggcccacgacgaccatcaatgacggaatactcgaccttggcgcccttacgcagcgtcttcacgccctcgggaagggcggcagcgggcaggaacacatcatccgtgctctcacccgtctgaatgaaaccatagcctttgttcgcatcaaaccaacgaacacgtccgctcggcattgtcacctcacattttgctgatcagataccttcacgcgaataggtaaaaccattcgcccattttcaaaccaaagatacagtttagcgcaagaggtgggccgcacccatccttccgcgccgatagcgtctgctttcccgacggaaaagagcgttatttctttgatttgcgattctttttttcgttttttcgattctcgctcaccgtaatcggctgcggcttgggttcgaccggggcgatcggcagcaccaccgtcagggtcagtcccgttccttcgctgccggatgcgcagatgaatccatgatgcgccttgaccacggattgcgcgattgccatgccgagtcccgtaccgcccttctgacgcgcacgcgacgggtcggcggtgtagaaacgttcgaagatcttcgaccgtgcctccggcggcacgccgggaccgtggtcgctgaatcgcacaatcgcgtagttcatacccacttgcatggactgccccacttcgatggcttcgaccagatggcgaagcgactgctcgttggacggcatacgggatagggattcgggactgatcgacgcggggagcacacccatggagatctccacaggcgagtccgccggcgtataccggtggatattgcccacgatgttggtaaccacttgacgcagtctcgaagcatcacccttcaactcaatctggggcatctggccattttggaaggcgaattgggcgggatggtccatatcggtacctggttggagcacgacctgtccgcaggaaatgccgcggtcggggtcaagcgcatgcaggtcatcggctgcgtcgcgcaccacggaggtcagcttcacctgctgcgtgatgtcgatgccacgtccttcgtccaaacgagccaaagacagcaggtcctccaccagaaccgtcatacgcgcgctggatgcctcgatatgttcgatggattcatcagccctctccaaagccccaggcatgtcgcgctgcattttgtacagctcggcgtacccgtgaatggcggcgagcggcgtacgcaattcgtgactggcgtccgagacgaaccgcttcattttttcggtggtctcttcctgcgcgtggaagctctcctcgatgcgtgtcagcatggtgttcagcgacatggacagagagccgacctccgtgctttccggcaggtctggcacacgttggctgagatctcccgcggcgattttcgcggcggttttttcaatccgcttcaaaggcgcgagcgtgctttgcaccagaatggtgccgagtatcgcgccgatcagcaccaccgcgatgcccaccatcgcgcagaatcgcgtcaatgtgttggccgtgtcgatctgatcgctcagcgacaggccgatgaacacgacgccactgtccttgacttgcccggtccgtgtcttctcgttccaaggcaacgcgacaacacgccatggcgactgcgcggcctgcatgatggaatgatccggggtgcggcttgtggtgatgtgcaccaccgcacgtgtcgtgaatggctgtccaagagtgacgccgtcgatgctgccgtcggccggcaggcttggttccgaaaccactccgtcacggagcatgggcaccgatccggcacccgtgcttttgtattcgctgtcgcgcacctccacgtaatacgtgttcatgaggctgcgcccgtcatcgccggtgtcgctgctgagcgagtccatgctgttgaaaatcagctgggcttggttgatcagctgcgtatcggtcttctgcagcagataattgcccaccaacgtacgtatggaaaaggagatgccgatggtgccgatggtcagtagcacgatgatgcaggtgaccagtttcgtgctcagcggaatcgcttgaatcctgcgggtgaaacggctccataccttgttctgcttcggcagcgaccggggaggctgcatgggggccggaatggccgaaggattggaggcgtggcccgtggacggcgaactgggattcttgctcatgactgaatctagttcttgggagcgcgaatcatatagccaatgccgcgcttggtttcgatcagcggcgttaccttgtgcttgtcgccgttctcatcctcgatgacgatgccatcgaccttcttgcgaagataggagatgtacgattcgacgatggccgcgtccccgccccaatcgtattgccacacgtgatcgagaatctgcgccttggacagcacgcggccttcattgtccatgaggtagcgaagaagcttgtattcggtggggctcaggtcgattggctgtccggctcgggacacgtcgtgcgagtcctcgttgatttcgagatcgcccacacggatgatcggatcgtcctccacctgctgctgggtgcgacgcaggatggcgcggattcgggccacgacctcttcgaggctgaacggcttggtcacatagtcgtcgcctcccacggtaagccccatgaccttgtcttgggtgtcatcgcgagcggtcaggtacagcaccggcgtggtgatgccttcctgcctgatgcgtcgggtcaccgtgaacccatcgatgtccggaagcatcacatcaagcacgatcagatccggctgcagcctttcgatgacctcgatggcttcggatcccgaagcggccgtgttcacttcgaaaccggcgaaatgcagggatgccaccagcagctctcggatggacggctcgtcatcgacaacgacaatggatgcttcaataggcttgctcatggcttaagcatcgctcccttcactggatgtttcctgaacagattctgaatcttgcgttgaagcggtatccggattgacataatcctcgttttccgattcggcgccccactctttgaccggttggatacgttcggcgaccgcaccatgacggccgctatggcggcccttacgccgatgcccgatcacgtccttcttgcgcaggatatggaacaccaccagaatcaccaccagaagcagcagcgcgccggcgaatcctcccacgccaatccatatggtccgcgacgaagtcgaggtctttttctgcaccgaaatctgattcatcatgtcggtcgcggacttcgcccagtccggatcgctttccatcaacggtttttgcgcggcatcggacagcgcgtcgacggtcgacttcttcttcagccattcctccgagttcgaagacacggccaccaccagattgccgtcattcgaggcaaccgccaacatcacggtattcggtttcgggttcaacgattccagcagcgcgctcacccatttatccggcttgcccttggcgttgaaactgtccagatacaccaaacggacggtgacgccggtctcctttttcgtctggttgatggcgtccgtgatctccgagacattcgaaccgagcagattctgcgtgtcggtgatgtcgtccgtggctgtaatgcccaatccggcaccgtcatccgcatggaccggcggagttatccacagcatcaaacacaaacccagcacgctcgccagcaacatgcaaatcgcgatattccaaccttttgccgttctgccgccgtttcgcgacacgccgacggaacccaaatgcatatgttctccgaccacagctccgtttttttcgttgcacacgctcactgatgacatagcatccactgtaccgtccggttgcgccaaccgcgatcgcatggagaaacacaccaatcatcattgaaaggaccggcacatgccacagtatcaagtcgacagcgagcagattcagtcctcgagcgccgccgtcaacgcctccatccaatccatccgacaggccgtgcagggcatgtacggcaatctcaacaatctgcagagcgtttggcgcggcggggctgcgacgcagttcacagcggtcgccgaacagtggcgtgccgcgcagcagcagatggagcagtcgcttgaatcaatccagcgcgcattgatgcaggcctccacgttgtattcggagaccgaaatgcaggcgtcgcgtttgttcgcgcagtagaaagcgcgcgtaaggcgccttccagataagcaaaggcccgctccccatcgggaagcgggcctcatatcagctatttgagcctatggaagcttccggtctttcgatcagtagcccatgtcggcgccagctgccggagcggctgccggcggttccggcttgttggccaccacggcttcggtggtcaggaacagtccagcgatggaagctgcgttctgcagagcggaacgagtcaccttgaccgggtcggtgacgcctgcggccagcaggtcctcgtactcgttggtggccgcgttcaggccctggccgtcaggcagggagcggaccttgtcgatcaccacgtcgccggacaggccagcgttttcggcgatctgcttgatcggggcttcgacggcacggaacacgatcgcggcaccggtggcctcgtcgccttcgagcttgacgtcgtccttggccttggcggcagcctggatcagggcgacaccgccgcccggcagcagaccttcctcgatagcggccttggcgttgcgcacggcatcctcgatgcggtgcttgcgttccttggcctcgacttcggtggcagcgccgaccttgatgacggcgacaccgccggccagcttggccaggcgctcctgcagcttctcgcgatcgtaatcggaatcggtgttggcgatctcgccacgaatctgagcgacgcgagcggccacgtcctccttggagccgccaccggacacgatggtggtctcatccttggagacgatgaccttcttggcggtgccaagcacggacatgtcgacggagtcgagcttcaggcccagctcatcggacaccacctgggcaccggtcaggatggccatatcctgcagcatggccttacggcggtcgccgaagcccggagccttgacggcgcaggacttgaaggtgccgcggatgttgttcagaatcagggtcggcagagcctcgccgtcaacgtcctcagcgatgatcagcagcggcttgccggtcttcatgaccaactcggcgatgtggacgacatcctgctgggagctcagcttgccggaggtcaggaggatgtacggatcctcgagaacggcggtctggtcctcggcgttggtcacgaagtacggagcgatgtagcccttgtcgaagcgcatgccctcggtgaagtcaaggtccaggccgaagcggttgttgtcctcgacggtcacgacgccatcctggccgaccttgtccagagcttcggcgatcttctcgccgacttccggatcagcggcggagatcgttgcggtggcagcgatctggtccttggtctcaacgtccttggccgctgcgacgagttccttgacgatggcgtcggcggccttctcgatgccacgacgcagcgcgatcgggttggaaccggcggtgacgttcttcagaccctcgtgcaccagggactgggccagcacggttgcggtggtggtgccgtcgcctgcgacgtcatcggtcttcttggcgacttccttgaccagttcggcgccgatacgctcatacggatcgtccagatcgatttcctttgcgatggaaacgccatcgttggtgatggtcggagcgccgtaggtcttgtcaagcaccacattgcggcccttcggaccaagggttaccttgacggtgtcagcgagcttgtcgagacccgcgagcattccctgacgagcttcgtcgtcatatgcaatcatctttgccattgttcctccacatatggctacacggtattatttccaccttcggagcgacaatcagaaccagccgtcagccgccagttatcactctcactcgtcgagtgctaattcgcagattagcactctcacgtcgagagtgccaaacccgatgacgttctttgcgctgtgagcaagatgtcagtcgcatcgaatcaacttgaaaaacgccggatttccaagaaaataaaagaacctcgcctatgttcgggcgaggttccaaaccggttcggacggcgttttttcagttcaacagcaccacaacgatcggcgtgaccaatccgctgctctgctggacattggagattcccagcgtctgcgcgacattctccgccgtcgccttgtcggcctcattctgataccagacaaccgtctggctgggaacgttgccggtcggattgctgggcgtcacgctggtgtatccggcctgggtcagggcatcggccttgctcttggcgtaaccggtgatgctggtggcgttcaccacgcggatctcggtggccagattcacgctctgctcagaagccgcatcctggccattgttctgatcgttattctgttccgcgttctggttggcgtccgaagcgtccttcgactggccatccgaagtactggtcttcttgccgtcctcggacttcttgttctccgtcttggcgtctttggacgtgtcgtccgtcttcttatccgccttatccgccgtggaaacggacgatgaagagtcctccttggccgaccaaggcattctcaggttgctgatctcaccagaatagactccccagaacagcaggccggcgagcagagccacaatcacgacaatcacatacggcagagccctggacgccatggaacgtgcgccacggtgcacgcccatcggtcccgccggaggattgtcgaacatatccttggcgtaggattcgtaggtctccttgtcctgcttagccattttctgcaacctcatttctcacacttaccgccccagtgtaccggcccgtgcagtcagcccacaatcagcatcgtcgattttgcgcgtattcgacacgtttccgcatggaatcggcatggacatccacagggcacgtcgtacagtgggaaagtatgactcatatcaaaccattgaaggatcttgtggagcccggatgggcccaggccctcgccgatgtcgaaccccagatacatctcatgggagactttctgaggtcggaaatcgcggcgggacgtaagtaccttccggccagcaggaacattctgcgcgcgtttaccattccattcgacgacatcaaagtgcttatcgtcggccaggatccctaccccacgccgggccatccggtgggactgagcttctgcgtggcaccggacgtcaagcccattccgcgcagtctggcgaacatctacaccgagctgaccgacgatctgggcgtgcccatgccggccaacggcgacctgacaccctggaccaagcagggcgtcatgctgctcaacagatgtctgaccgtcgaaccgggaaagccgggaagtcatcaggggcgaggctgggaagtggtcaccgacgcggccatcagcgcattgaacaatcgccgtcggcctgacggcagcgtcaagcctctggtcgcgattctgtggggacgaaaggcgcagacgttggagcccctgctcaccaacgctttcatcatcaaatccccccatccaagtccgatgtccgcccgctacggatttttcggctcgaaaccgttctcccgcgccaatcaggcgctaatcgaagcaggagaacagccggtggattggaccctcccgtcagcttgacccgttagagtagcaaccatggctttattccctccaaagaatccggcgccagcaccggcacccatccccatgcccgcagccgcaagaccaaccacgctgtcggccgaagacatcgcacgcgccaggaacatcggttcgcagattcgcggacgtttcgcgcagaccctggtcggacaggacaatcttcgtgaatcgctgatcaccactttggtggccggcggtcatatcctcatcgaatccgtcccgggtctggcaaaaaccactgccgcgcagaccttggccacttcggtgtccggctcgttcaaacgtgtgcaatgcactcccgatctgatgccttcggacctggtcggcactcaggtcttcgatttcgccacgcagaaattctccacgcagatcggcccgatccacgccaatttcgtgctgctcgacgaaatcaatcgttccaacgcgaagacccagtccgccatgcttgaagccatggcggagggcgcgaccaccatcggaggccaacgcatcgcgctgccgaaaccattcatggtcatcgcaacgcagaatccaatcgaggaagagggcaccttcaatcttcccgaggcgcagatggaccgtttcatgatgaaggccatactgacctatccgacagcgcaggaagagcaacgcatgctcgccatgctgacccgccgcggctccgataccgtagaccagcacgcgctcaccggtgacaccgtttccatcagcgacgtcgaattcctgcgttccgcggcacgtcgtgtgcacgtgtccgatgcgatcatgcagtatgcggtcgatatcgcggccacctcccgtggcgctggaaccaagcccgtccaaggactttcctcgctcgtcaggctgggcgcctcgccgcgcgcgtccatcgcgctggtgcgcataggacaggccaacgcgctcctgcagggacgagattacgtcattcctgaggatgtgaaggcgttcgcccacgaagtgttgcgtcatcgtattctgatgacgttcgaagcacttgccgatggcgtcaccagcgaccaggtggtggattcgatcgtgcaggcggtccccgttccatgatcgaccagatccgttccgacgatccgatccgcagaaaaatcgagacgcttggaaccacgctgagtctgccgacggtacgcaaggctctcggcatactcgaaggcgcgcacgaatcgaacaaacgcttcggctccgacgatgtcgtggatatccacgcctatgagccgggagacgaggcgaaacgcatcgattggaagaccagtgcccgagcgggacgtccaatggtggtgcagcgtgagcgtccctccacttcgaaggcatggttgctgcttgacgtcggacaggagatgaccgccacatgcccttcctcggaacaggcgtatcaggtggcggcaaatgccttatgcatgttcgccgcgctcagcctgcgccgaggcgacgaagtgtccatggtgttcggcgacagcgcttccatcacccgggtgccgttcaacggtggcctggcgcagttcgaacgaaccttggatacggcattgcagcgcgagtggaccaggccccgcaatatcgacgcgttgctggaatacgcgcgccgcattcgggacaaagaggcgctggtcgtcatcgccaccgaggagcatgcattggaggaacggcatttgagcgccatccgcacgattgcaaggacacatccgatggtgctcatcgatgtggccaccatcaatccgtttgatgtcagccatgcgcgcgtggtgcttgacggggctggaaaacgacgcgtgcctgcgttcctgcgtaggggaaacacagctgggcaagtgcgaacgcatcgcgaatacctggctgcgtccattcgccatgagctgaatcgctgtggctcgacggtaatccgatccgattccagcgaacgcatgttccatgagttcgtgcgcatggtttccacggctttggcccagtccacacgtaaccaattgagagccccgtccgtattgtcgttgggagacaaggcatgatgctcttccttgccgaggatgacctcgtcatcaaggaccagattcatcttgagaacggtttggccgtcgtcatcgcggtctgtctgttgcttgccgtcgttttggtggctcttgtggtctggcttgcccggccgagccggaagcccgcaaaaatagtcaatcgcggccgacatgacgcgcttgccggcaaaaccgtctggcatcagcgtatcgatgatgttgtgtcccgccatgcccggggggagctggagcgcgaggaggctttcgcacagctggccgcaatcgccagggattttgcttccactgccaccggaacggacgtgcgcaaccagacgctcaccgacatcgaagagacgcctcggaccacggggaaccagcagggtctcaccttgctcaggcaaaccatcgaggcattgtatccgccggaattcgcggatgccgagcgcaatcacatcgccaggcaggccacggtcgagcaggctggcgaatgggtggccaatcttgtggaaaggtggcgatagatgcaactgtcatggcattggccttgggtctttctggcaggcgtcatcgtggtgctggccgttgccggcgtcacgttgctggtggccgcgcgccacaaaaccgatgacatcgagagtgcccgcaccttcagcctggatgatgacctcaacacggaatccgcatcgagattattccgccagtggagggttctttcacgtttggcggtgattcttctagtggtcgcgttggcactcgccacggctctggtggcacgtcccagcaccgtggatgaaggcgaggagaaggccagcagccgagacatcgtgctgtgcttggatgtttccggctcggcgctcccctacgaccgcgaggtcatcgacacctaccgtcaactcgtcgacagcttcaagggcgagagaatcggcctgagcatcttcaattcgacgtcacgtaccgtttttccgttgaccgacgactacgaactggtgtccaaacagcttgacaaagccagcagcatcctcgcaggcgtcgagtcccaagccgatatcgacaagatgaaggacagcgattatcaggcgatttccgactggctggaaggcacgcagaaccgtaaggagtccacttcgctgattggcgatggcgtggtgagctgcgcggccatgcttcccggattcgcctatgggaacgcaagcgccgacaatgccgagcgtcagcgcgccgcatccatcgtgcttgccacggacaacgtcgtttccggaaaaccaacctatacgcttgacgaggcgctgaacctgaccaagcaggcccaaatcaccgtggatggattgttttccggaccgaagcagagcgaggccgacgagaccacccaggaattcaaatccgccatcgaagctcatcatggggtgtttctcacccaatcgaatggagcatccgtctcttcgctggtcaaggaaatcgaatctcggcggaaccatgaaaacgagtcgagcaacaaggccgccatggtggatgctcccggatggtggacactggccttggccatcgttttgatggtctggctggcattggcttggaggttgaggagatgaaccatctgacactttcccctgctttgggttggcctgtcggcggagccgtcgccgtggttctgctggcctgcgccattgcgcagatcgtattgcatgttcgtcgccgcgctgacagcgacgaaaccgtttgggcatgcgttcggcgcgtattgctttgtctgacggtgtcggtcatggcattgacgcccagtatcgtggcgccgaccaatagccgtgcggtgaacgccaccgacgtggtggtggccgctgacgtgaccggttccatggccgtcaaagacgcgcaatatggttcagccgaacagtcaagccgtctcgacgtggcaaaacaagccgtgaaggacgtcaccgcgctatatcccaattccagtttcgccgctttgcgattcggagcttccggcacgttggacgtgccgttgaccccggattcgaacgcgatcgacaattgggcggatacactcgcgcccgaggcgacttccgtttcggccggttcgacgttggatgcccctatcgaccagctgctgctgacctgcaagtccattcatgatcagcatcccgatgatgcgatcgtgctgtacctgttttccgatggagaacagacctcatcaaaggcacggcgcacgttctcatcattgcgacgatacctatccgatgccttcaccgtagccatcggcagcgagcagggaggcaacattcccgtaatcgccgacggcgtcgatggaaatgcggaccagtgggtcaccgaccctgataccggcaaacccggagtgtcacgcatgaacaaggatgagatggcgtccatcgccgacgagttgagcggtaccgcgctggtgttgaacgcctccaacaccatgcgtgacggcgtgtccaaggaaacgtccgataagtggcgagtcacccaaaccaccaagaagcgcaccaggacgatgcccgtcgtatggccactggccatcgtcacgctgctgctgctcgcatgcgaattgggggcttggataattcagtcgaggagtttgctatgaccagaacaaccatgaaaccgcgtgcctcgctgacggttcgcatcgttttggccgtcatggcggcgttgctggtcatggccgccctatgggccatagtgaatctcgcagccgtcaatagctacaaccaggccacgcaaagcctgcaggagaacatctcgaccagcagaaaagacgatgccgattgggacaagctgcacaccaggcaacagcagacggacgcccaattcaacgaggcatcagccatgaagccgctgctgctgccccaagtgcgcgaatcaatcgagcataacagtcatgtttccagccagcttacggatcacgcgtccaagaagatcaaagccgagcagagcgatcagtccgcttccacggattcaaacaccgccgacgctcaggaatcgggtaaatcaagtcacaagaacgacgaaaacctatccgacgaacaacgtcggaaaatagaggagctattggctcagaacgcccaatccacgcaatcggatcccaatgacgattcaggttcggctgcgaaaaagaacccaagcacttcatcctcgcagaccaaaccctggtagggggctttttcgaatatagttatccacatgccgtcgacgtggttttcgttgtttttccaataacgacacgccgacggtttttcatagactcgttctttgaccacaagctctgttttccgattggcgtcaacaccgaatgtggtcaaatggctgccatgaacgtttcaaatgcttttcttggtgccgccccaggcgtcgcagccttcaattcgttggcatctctgtcgggaatgtcctgtcgttgccgaattggcgtgcggaccacccaaacattgatcaatgcgaaacttgttgccgcgtcacggcttctcgatgaacttgatgcggcaatagcctccaacagactggccgactggaccggcaccgcggccgaggaataccgcacccgtctcaatcgcatcgcacggcaatccgctctgctacgtgacgatatgatcgccacgtcacgtcttctctggtcggcaggtgcggcatgaaccaacgagtgacggcccgcatcgttggcggaaagagattcaccaccgccgaataccgggaatacttcaatgcttcaagaatcctcagagatcaagcgaatcgtcttggcacttcccgtagatccttcattgccgcaggctatgaactcaaaatccaccctcgcgccacaccgctcctgtccgctttgaccggggcaagtccacggtgtacggcgcaggaccatatcgaattgccgtaccggcagctgctcggacgttgcgaagcacatgccgaggccctgcaatccatggcatcccagcttaatgagctatcctcattgatcgcacaagcccaatccttatacgcccaagctgaggaagccagcaggaaagggctgaatatcatgttgcgagggcttttcatgtcatcacgggaatccgcgattctcgccttgaccgccagcgcactgatgggggtaagacgcagttacgccaaagaggggaaattcaacaaattctatcttgtggaatccaccgcatggatgcaggaaagcttcgtgagcgtcctcggagagcatgcgagccgattgaacatacaggaacgcccttcaaaagacacgtccatcctggaatacatcacgaaaaccttattcatggtcaccaaaccgggagcggttatagcagaggggctttccggcaaaggctcggtcaatcgcggtcttaagaaaatcgacagactgctcataccgtacttcgacaaagaccatggagacaatctctccgtaacccgtgtgtatccgaaaaccaaagtggtcagaggcggtacaagcacgaaggacgccatcgccgaccaacggcggctgtccgaaggacctctcaacggcgaacgtgaaagcggtctggaatacggaaccatcgcatgctgcaagtaccgcaaagccgatggcacatatgcttggaggatcatcattcccgggaccgacggcaatcacgattcgcctatggactggtacaccaatttcgagctgatgagtgccgatgagcggcagcgcggaaccgcggaaagcctacgtttcctggatgagaccatgaaacaggccggcatccagccggatgatcccgtggaaatcgtcggccattcgcagggcggcatcatcgcggcagcggcggcgacggatttccaagacaaatacgacatacaacatatcgccacgcttggctccccgatagcgaatttcgagattcccgagaaaacacgggtcaccgccatcgagatggataatgaaggcatcgcggcacttgacggggaggctaacccccatacggagaactggctcaccatacgatgctccgtccatgaggaagatgcgccgaagagggcttttccaggagccgaagtcagtgattcgtccggggagaagaactccacgcactacccgaaataccatgaggcgggataccggtacgcctacgacaccggaagcaaatccgtgctggaccatgaccgtcatttccaagaggtcgtggaaggcgagctggaggaggtccagtattatgaaggacgcatcagcaaatgacgggaccaatggttcacggctgaacgtatgctgttgtctatgaagcttactgacatctcccccgcaatcgcactgacccctcttgacggccgctaccacaagcagaccgctccccttgtcgaatacatgagcgaaccggcgttgaaccgcgagcgcatgcgcgtcgaagtcgagtggatgattctgcttgccaacggtttcgagggcaacggcaatcagaccatcgttccgggtgtcaagccgctcaccgatgatgagcaggcgtatctgcgttccattccggagaatttcggagccgaaggcattgcccagcatgccgcttatgaggctaagacccaccatgatgtgaaggccgtggagtattacatcgacgaccagctggagaaggccgccgatgtgttgggtcatgacacccagctgaccggattgaagactctcgtgcattttgcctgcacgtccgaggatatcaacaacctgtccatcgcccgttgcgtgaagaacggtgtggagcaggtgtggctgcccgcagcccaggccattgtcgaccatctggcacagaaggccgacgcctaccgcgacaaggccatgctgtcgctgacccatggacagcctgccacgccgaccacgctgggcaaggaactggctgtttatgtgtatcgtctgaaccgtcagctcaacaaggtcaaggcccaggaatatctcggtaagatcaatggcgcgaccggcacgttcggtgcgcatctggccgcctgccctgatgttgactgggtggccgtctcccgcgagttcgtcaccaaccgtatgggtctgacgtggaatccgttgaccacgcagatcgaatcgcatgattggcaggctgaactgtacggtaccatcagccacaccaaccgtatcctgcacaacctgtgtgtggacgtgtggatgtacatctcccgtggcgtgttcgcgcaggtaccggtcaagggcgcgaccggttcctccaccatgccgcacaaggtcaatccgattcgtttcgagaacgccgaagccaatctggagatctcctgctcgctattggacactttgtcggcgacgctggtcgaatcgcgttggcagcgcgatctgaccgactccaccacgcagcgcaacatcggctccgcgctgggctattcgctgctggcgttgaacaatctgatgggtggtctgaactccatccatccgaacgatgttgccgtccaggccgagctcgattccaattgggaggtgctcggcgagccgatccagaccgccatgcgcgcctgcgagcttgcaggactgccgggtatggataagccgtacgagaaggtcaaggagctcatgcgcggtcacgagatctccaaggatgacgtcgaacggttcatcgaccagcaggccttcgacgaagccactgcggcgcgtctcaaggcgttgactccggcgacatacaccggagttgccagcaagctggttgacttcgaccgctgataacgcatcgccacactcatcttgcggatgatacgccttggggcggctgtgttttcacacagccgccccaaggcgtatcatcggagacgataataggtgcatgtcacccggacgtattcacccacgtacctataaagcaggtcaatagtgtctcacgacttcccaaccagcaaacacgaaacgcgcattgaggatgttccgccgaaacggaaccgcgatttcgcggatctgctccatgcgctgttcgccgtgcttgtcggcgcggccgtcatcctgttctccatctacttgcatggcaccacctccggagtggagtccgacgtgcgttccgcgggccacgtggtcagttggctcatggatgtgccgacatcgctgttgcagcagatcgccatagttttcattaccgtcagcgtgcttatccagctgctcatcgccaaggaatggctgcaaagtgtggtttccgccatcgcccttattctcggtttcgctgcgatatggggcatatccgctcttatcagcggctcgggcaatgacaccctcatcatgtccatgatgtccaacggcacttccgtgggaaccggactgcttcccgatttttatgcggcgatggcctcattccttaccgtcgccggaccgcgtcgcacccgttccggcaccaaatggggctggaacatcctctacacggtcgccgtgctgttcgtggtgctgtcatggaattcgctttccggcgtgctggtctcctttgccgcgggacgtgccttgggcatgctgatccgtttcatgctcggcacacagaccaacggagcttggggcaaccaggtggcgcaggcgctccgttccatcggcatcgacgtggcgtcgctctcccgcaggctcgcgacctacaccgattccggcatgctgaagaccacattggacgatgatctgaccgagaactcacgcatctacgacgccatcgacgtcgacggccaccaatacacggtatccgttctcgataaccaagtgcatatggcaggctatctcaaccagctatggcaatgggtcaggctgaccggggtctccatgcgccgtgaccgttcctccttcgacgccatccaccaccattacgcgatgattctcggcctgcagaacgccggattgacggtgccgggagtctacggagtcgcagacagcagcgaatcgtccattctggtgtttcaccgcgaccacatgcccttggaatgcaatccgaacaccatgtccgaccatgacatggaattgttcatgacctatctgtccgaagcgcaccggcacggcttcacccatcgtcgaatcactcccgaaacgttgtcgcgcatggaaaacggacagccggtgatcgcaggatggcagaatggcgactatggcagcgcgccgccaaactatgcgctggacaaagtacagctgctggttctgctcggcgcgctgaacggcatcgaccgtgcgatcgcatgcgcccgcaggacgtggggcgacgagcaactgatcgacctggcgccattcatccagaaggcggcggttccggcggcgatacgcgccctgcccgcctgcgacaagcacatgctcaacacgctgcgttcccgtatcgcggctttggctccgcaggaggtcgcggattccatggaaacggttacgctgtcgcggttcagtttccgttccttcatcgcgatcgcgctgctggtcgtcgccgtgtatgtggtgttcacccagattcaaccagccgaaatgatcaaggcggtcaaagaggccaacatcgccatggctctggtatgcgtgctgttcggactgctggcttggttcggatcggccatgacccttggctgtttcatggatgccgataaacgcaatccgatcggcttgtactgttcccaaatggcttcgggcttcaccgcggtctccatgcccgccggcgtcggcccggcctttgtcaacctgcagttcctgcgcaagagcggctaccgcaataccgcggccaccgccatcatgagcgccgtatgggcggtgcagggcggcaccaccatcattctgctgctgctgatcggcatcttcaccggacgcaacacactgtccggcatgattcccaccaacacgctgattttggtgatcaccatcgtcgcattggtgatttccgcggccatggccattcccccggtgcggcacatcgtcacggagaagtacctgcccatcgtcaagtcctacgcacgcagtctcgtcaacgtgttgtcccacccgaaggagctggccttcggcatcctcggcgcattggtgctcaacatctcgaccggattgggattctggattgcattgatggctttcggatgccacaccaatccggtggagaccacattcatcttcctgctggcgaatacgctcggttccgcagtgccgacaccaggcggccttggcgcggtcgaagccgcgttgtccgtggccttcaccgccgtgggcatcccctccaccatcgccgtctccgctactctcgtctaccgaatcgccttctattggctgagaattccaatgggagccgtggctatgaaatggctggacaggcataatttgatctagcccaaccccccgttagggttttttctccccctatgctgaatcaaaagggccaaaacccttggaaaatggcatttttggcacatgcgtgcgctattattgcaatgaacgtggatgttcataagcggaatatcccctgactcaagaaggatgctttatggcatacaacaagtctgatctcgtctcgaagatcgcccagaagtccaacctgaccaaggctcaggctgaggctgcggtgaacgctttccaggacgtgttcgtcgaggcaatgcagtccggcgaaggcctgaagctgaccggcctgttctccgccgagcgcgtcaagcgcgcagcccgcaccggccgcaacccgcgcaccggcgaaaccatcgagattccggcaacctacggcgttcgcatctctgccggctccctgctgaagaaggccgtcaccaagtaagtcgaccacgcagacctatatgagaggtttcaaccacggatggttggaacctctcttttttctttttataacaggcaaaggcaatgtcatcccacactatgcgctatgatactagacaatatgactagataaagggggatgtcatggtcgaccaacgcagacagatcatcgacgaaatccacaaactcaacatcctgctcatccacaccaagctcaaaacgacacgtgcccggaccgtggctcgcgccaccacacacgtgcggaacgtcgacgcggcaagacggggaacggttccacggcccaagccgtccaaacccatcgaagccgacgttcatatgctcgactgcctgaacgacgaggaactttccactctcggcgaactgctgcagcgtatcatcgacaacaccgataccaaacttctggatgaggagatttccgaacgccgcaaggcgatccacgaattcctcatgctgaaccatacggatgaggaggtgcgggaatgagcgtcgggcaggaacatgattccggtgcggacgatccggatctcatccgtctcaacaagcgttcgctattcacccccagcgcgtcagtggctgtggagcagcattcagccgtgccgcacgtgtcgcgaagcacctacggtacggcgaaggtcgaaggcagactcacctcccccaacgccagggttccggaaatcatcacgcagcgttgcggcggcatcaccgtcaaaggtcatacgctcaaatcgttcgcctataccaccgatgcggtcattatccgcaacacgaacgcgaacgccatcctcgcggtgtaccctttcaccggcgaaccggtgatcacgcaggcgctgctcaccgtggcgcagatgccgctgttcgtcggcgtgggtggaggcaccaccaccggtccgcgtgtggcagagctggccatggtggcggagatgcagggcgcggccggcgtggtcatcaacgcgccggcaccggcggaaaccatcgaaacgaccatgtcgatggtggacatccccgtcatcgccacggtcacggaggatgatgaaatcaccgaatgcaagattcttgccggtgcggccatcatcaatgtggcagccggtgcaagaaccgcgcaagtcgtggcaagcatccgcgcgcatcatccggaaatcccgattctggcttcgggcggaggtcgtgaagaccgtattctcgccaccattgatgcgggcgccgacgcgatcacgtggacgccgccaagcgcgcaacaactccagtcgcagatgatggccaaataccgtggagaagtctgagcggcagttacaatccgaccaaccaatatcaaaagcctgcggtggagacgagtcttccatcgcaggcttttggctactgcaaagcctctagtatcgtgaggaaccggtcggacggttgtgcgtcgaacggatcaagcaacgtcacgtccatcctgttcggcgaggtcagcgatagtcgcgtccaatcacaggaatattgcgcgttgtgcgatcgtgccgactggatgaaccgtccacgcagtgcggcgcgggtatcgtggggaggaacatcgatggcctcatgtgcttgtgactcgttgaccaacgtgcgcatggctccgcgacggcacagcgaggcgtacagcgcgccgttggccacgtcatggtagtccatgtccaactgttccaacttgctgacggagagtcggctccccgcacggttgcggagcatgtcgaacagccgtcgtttggcaagccaatcgaccttgtcggcgaacgtttcgctagcccccgagcggaacgcctctatgacacgcctccattggcgaatcacctcatgcacgtccgtgcgcggcaacgaggagcacacttcgggatgttgtccaacgaatcgttcgacgatttcaagataacgttcctgaatcgctacggcaccgccttccatgacagtgccgtctgccatgtcgaaggacgcttcgacgcccgtcaggtcacggcttaccttatggttggccgcactggcgtcagcgaaggagaatcgggcgaacccggaatccttgccttcgcgcccggcctgttcgatgacgcacaacaccagatgcgtggtggcgagcttcatcatcgtggcccactgggaccggttcgaatcgccgatgatcacatgcagccgtctgaacgcgtcaggatcggcatgcggttcgtcgcgcgtgttgaccatcggacgcgagcgcgtggtggccgatgagaccgcctcatcgaggaaatcggcacgctgcgtgatctggaagccctgctcccccatacgtcctgcgccggtgaacagctgccgggtgatcaggaacggcagcagctcctgttcgatcgtcttcaacggcacgaaccgtcgcaccaggtaattctcatggcagccgaaggaatgcccggcggaatccacattgtttttgaacacatggaccgtggagccggctccctggatggagcgcagacgacgttgggcgtccagggcaagatccctcatcaccaattcgccggccgcatccaatgccagcgcgtccatcggatcccgggcttccgccgtggcgtactcggggtgcgagccgacatcaaggtagagtcttgaaccgttttcaatatatgtgttggtggatctcgcttcggccacaatcggctggaacatcatcatcgccgtctgtccggcgtcgcatgggcggtccgaaccggtcacgctcacaccgtattcggtttcgatgccgaaaatacgggcgaaggattggatttcgtccttggtatgggcgtcaagcggcgctgtggaatggttgccgctgtcacgcagctgcggcatcactcgccgcctttttggacgaagctgcccacatattcctcggcgttggattcgaggaccgattcgatgtcgtccagcaccgcgtcaagcgcatcgaccgtgtcatcgatctgggtgccagcctgcgcaatggtctcatcctcgtcatgtttttgttcggcggattgcatctgctcaaatttctggggcatggtccttcctttctccgaaagcgtctttgcgggttctcctgcgaatagcatactgccccacaccttaacccaagtgtggggcagtcaatcagtcttatgccaaatactggcgcagatcatcggtaatcagaccgttggtggcgagtacgtcgttttcctgacgccagtggacaagatcgccgttccaccggctcagatgcccctgcgcttcccagaccacgacggctccggcggaaaccgcgggaacgtcccacttgtgcagatgcgcttcgaaatacgcgtcatatgtaccgtccgccaccttgcacaaatccaaggaggaggggccgacgcgcttgatgtcggccggacggccggagatacgcgacaccacttcaagcgcgcgcttggattcctccggcacatgggacatgccgaagctcaccaccgcatagtcaagggacggggtggtggacggcatgatcttctcgcgtttgtctccaagcggcgtcttgcggatgcggatggctccggatccgcgcaccgccaggtaggtcaggccaagcgccggagcatgcaccaccgaaaggatcggctgcgcggagcattggtcgttgaactcgaacagtgagacggtgatggtccattccggcatgctgcgcacgaaattgatcgcgccgtcgatgccgccaacgcaccaataccgttcccccggatggcattcttccggacggaactgccagaaaccatcgaacacatccacatacgtgatgcggttgctgatgaattgcgccaaccgcttatcgatgtcggaggtgaagctcagatgattgtccgttatttcaaaacttttcagatcacgcggattcatttgatcgttcaacgcgtgcttgcctgcatcctgcaggatacgggccacttcgagggccacttgcctcaattccatgtagtatgccttttcgtttcctcataaccggcttggacgcaccctctccctcaagcgtcctgccgtgtggttcatcgactatgggtatggcctctgccatcacctacggcaatggtacccgcacaacatgagattcaacgcagggattccacgattccgctcgcagtgtggacatgctcgaacgcttcggaacacaaggattccgtgaatttcaacggattggacatgtccaacgagaccatcgaattctccacgttttcatcaccggacgactcgccgcgcaccgtaaggtgggaccacgacgccgcaacgacctgttcggggaaacgtcgtatgatctccgcgcgcagccatgcgcgtgtgtcggccggcgcttggccgaccgcctcggcaagctgcttatccgtcaccagtcgttcggtctgtccggcaagccgggtgaaaatcgaatcggccggatcgagcgcggcccatttcagatcgaccgcggccaggcgccgatcggtccaatccgaaccggtcttgcggcgtagtttctccagcaactgccatttgagcagccattcgagacgtgacgcctgttcccgcatcgtcagtcgtccgtcatcgtcggcatggcgtacggtggcgacgtcggcgagagcctgcccccacatcgccatgatgttgcgggtggagcggtcgggccatgccggctctccggatgtgtcggtgccgtataccgttgccgcggccgcatataccagtccacgcaaagtgacctgcatctgccatgcggtggtggttccacctgtttccaatggtagtggggcggccagggtcaggtcgtgcgataccgtgtgcatggcttccaccgggtcggcgagcgtaagcggttccagcgcctcgttcaagtcgatttcggccatgtctgcgtgttcgagcagccacagcagcatgctggtggtgccgagtttcaaggcctgtggcacgtccatgcggttggcgtcgccgacgatcacgtgcagtctgcggtattcgtcggtgctgtgcgattcgtctctggtgttgatgatcggccggtcgaatgtggtctgcaaaccgactttcatatggaagtagtcggcacgttggcttagctggtagccggcgttttcgctatgttcgccgatgccgacgcggccggagccgatgaagatctgtcgggagacgaagtgcgtggtcatgaggcgtgtcaccaggtcgaacggtaccgaccgcagcatcatgtagttttcgtgcgtgccccagctggctcctttgccgtcgacgttgttgcggtgcagcacgattttccgtcccgtcgtctcgcttgccttggctgcggcggcgcgcatgatgagatcgccggcacggtcgtatcgcaccgcttcgaaggggtcggttgtttccggcgcggagtattcgggatgcgcgtggtcgacgtagatacgacccccgttaggggcgatcacgttggtgatgttgagctgtggggcgtcggtgagcaggtccgggtgggccgccgcacgttccagtctggtgccgcgcgcgtcgttgacggggtcttcctgccggtagtcccagcggatatggctgcgtgacgcatccgaggcggcgccaaccacgtcgaatgagagctgcaccggattgtagcggccttgtcctggcgcggagaccgcgtattccgtttccgtgcccatgaccctgcgaacgctcatcgcgccgttcctttccgtatttagatcgcgttccataccataccgtccagcattcatacgccggccggcattcatgccaccggtctgatgccggtcacccgtccgggttcaagcccgttgatgcggctccactgttccggatccgcatccagcagcgcgtcccgggtctcaccgtattcttcgtccacggctttggccagcagattgatgccgatcgccgcagcctgtccggtggtgatggacagtttcaccgcataggttttggcacggtccacgatgttcttgagcaccgcgccggacaccacgtcggcgaggtacaccggacgccactggccatggtcgtcgcagatgtcgcaaaggtgccgatgctcgtcctgcgcgtagatgtcgttgaccagcacgccgatcaacgccttcgcatccacgttcggagacaacggcagcttgtctgtcagatagtggcggacgatctgggtcgcctgctggatgcccggacggtccacgcggatcttcacgtcgaggcgtccggggcgcaacaccgccggatcgatcatgtcgatgcggttggaggctccgatcaccatgacgttgtccagcgattccacaccgtccagctcggtcaggaactgcggcacgatggtggtctccacgtcggacgaaacgcccgtgccgcgggtgcgcagcagcgaatccatctcgtcgatgaacacgatgaccggtttgccgtcggccgctcgttcgcgggcgcgtttgaagatcatgcggatcagacgttccgattcgcccacgaatttgttaagcagctccggtcctttgaccgacaggaacacgccacttcccgcgtcggtgccttcggcgagcgcgttcgccacggctttggcgatcagtgtcttgccgttgcctggaggaccgtacagcagcacgcctttcggcggtttcaggtcgtagcgttcgaacagttcgcgatgctggaacggcatctgcacggcgtcgcggatacgttctatctgctcgtccagtccgccgatgtcggcgaaggtgacgtccggcacttcttccagaaccaaatcgtcgtcgttttcggggggaaccaacgaaagcgcgaaccgcagagatgcgtcgacgttcacgcgatcgcccgcgctgatggcctgtttggcaagcgttcccgagcatcggaccaacgtcacgttgccgccgccatccgcgaccagcaggcggccgtcatcgcacacctgccgtaccgagcgcaccgcgcccagcgtgtcggtgtcgagctgtgagaccaccaccatgttctcgttgagcagcacggtacgtcccggttcgagcctggaagcttgcagattcgccgcgatcggcacgatcatgcgtctcgcgccggcagccacttcggcgctggcatgctgcacgccctgctcgtccgttttggctgaatgcacgcggaccatggtggcgaaagtcatgggaggccccgccagctggttcaattgggccttggttttcgtcatttcctgcgtggcgcggctcaacgccttgaccagcgcatggttcttggccatgagctggtcgttggcctgctgcagcgacgcgagcgtctcttcgtcatgatcgttcatgtcgacctcgctttccaacacgttcaaccctcaagaatacccattgtcctaatgatttccgacaatcggaaccatgcttgaacaagaaacgccgaacatcgcatccatggcatccctgcccacgctgtccgctcccggactgctggtgatggatgtggattccacgttgatcgacgaagaggtcatcgacgagctcggcgtggccgcgggagtcggcgagcagatagcgtccgtcaccgctcgagccatgaacggcgagcttgatttccgcgaggcgctgcgcgcacgcgtggcgttattgaagggtctgccgaccacgattttcgatgaggtctaccatcgcgtgcatttcacgcatggcgcgcttgaactgattgacacgcttcacgcgcatgattggaaggtcggcgtggtctccggtggttttcacgaggttgtggaccgtctcgcggccgatgcgcatctcgattattggattgcgaaccgtttggaggctgccgatggcaggctgacgggacacgtgctgggcgatatcgtcacgaaggatacgaagctggaatcgttgcgcgcgtgggccgcgcggatgggcatcgatatggcgcagaccgttgcggttggcgacggcgcgaacgatctgccgatgattcatgcggccggtcttggcgtggcgttctgcgccaaaccgaaagtgcaggaggatgctccgcaccggctcaatgaacgtgatctggcgaaaatcctcgattatctcaaataacttttccgcacctacgagcgaccggtgggcggcatgcgttgtaagaccgtaaagacttggcctgagcggcccggagcgtgtcgtcaatgcatgccgcccgccggtcgcggacgccgcagctactcacatacttacagtagaaacaaaaatcttactcgcagaaggcgttatcgaggtgggcgccacgggcccagtcggcggcgcgcatggctttcttgccttgcgctttaacttccagcagctcgagcggctcggtggaggtgccgacccacacgttcttcttgccggccacgatatggccgggttcaagcgatgccggtgcgttcggattggacatgtcggccggctgcgcgcgcaatacgtgcagggtcgccggttcggcgtccgcatgggcatgcagttcgcaccaggctcccggattcggcgtgcatgcgcgaatctggcggtcggcggcgaataccggcacgtcgaagcggatatgcgcgtcttcaacggtgatcttctgagccacctcatatgcgccggcaggctgttccaccggtgcgatctgatcgttggccatggcctgcaacgatgccgcaagcaggcgtgatccatcttcagcaagacggctcagaagctcgccggcggtttcgtgcgcgccgatttccacggtggattgcgccagaatcggaccggcatccatggcgcgcacaatgcggaaaaccgtggcaccagtcaccttttcgccggcccagatggaacgttgcaccggagcggcgccacgccattggggcagcagggagaaatgcaggttgtaccagcccatcggcagcgcgtcgagcacgtcctgtttcaggatcttgccgtacgccaccacagcggcggcctgtgcgccggtggccgcaagctcggacacgaacgtttcctcgctcggatcggattcgatgaccggcagaccgagttcgagcgcggcctgcttgactggattcgccaccagtttgcgacctcgtccggttggcgcgtccggcctggtgagcacggccaccacttcgaaatgctcggtatcctgggccaatagtttcaacgacggcaccgccacatccggcgtacctgcgaacagcactttcaacatgagacgaatctcctcaccttcatatccatcaatgcatgcgaccgtatgcgtcgatcccgcatagcgaccgcaagcacaaccgtctgtctaatctgcgtatgtcgttatttttcatgtaccgcgggaatcgccacgcccgcgtcgatcagcagggtgcgcaacgcgcgggcatccttgaaccgtacgccgcgaatgccggcttcgttcgcgccgacgatgttcatcgccttgtcatccacgaacagcgcgccggaagcgtcgatgccgaactgttttagagcgtaatcgtaaatatcgcggtgcggtttgcgcagtcccacgtaaccggacaccacgcggtcctcaagactgcacagaatgtcgtaatggtcgagcgccaccgggaacaggtccttctgccagttgctcaagccccatacgtggacgccggctgctttcagatcgttgatgagcacgcgcgcgcctggcaccacgccggtcagcgaatcgacgaaattgtccagatagtaccgcatcatatcggcccactggtctccgtggcgttcacgcatcagagccacgccatcgtcattggacatgccggcgtccagttcgttgttgatgtcgtagaagccggaaacgtcattgtcgaggaactgttccaccagtccgtccgagtaccgtggggtcatcaccgccgccggatcccaatagataagcacgttgccgaaatcgaagatcacgtcggtgatctgccggccggcgttcgcagcggcgttgccgtcggccataagcacgtcatattccatttgcggctctcccggccagcctttcatgcgtttctccattcctaacgtcaacgtcatcagtcgttccagtgtttcacgttgaggggacgtgcgtcagatgcgttccttcggatccatctggaatcgcagttccccaggttcgcgtgaagccacgtggcgggcgcttgccgaacgcagccgcaacgccaattcggcacgtctgccctgtgggacgcgcacgactgctttgaccctgtccgcggtgccttccaattcacgtgaatcgatggtgcgtggctgcggaatcggcaccggccccaagacggacggcatcgtaccggcaatcgtgtcgatggtggccatgtcgccgccggccaacgcgccgattcgtttcaacatcgtcccaaccgcatctcgtcggccccacacgcaggccgcggcgaataccggcggcagcgcggtctgggcgcggtcctccacttcgacttgggcaagcatcggcgaattccacagcatcaacgatcgtgcgagcacgggatctgtttccccgatcagcagcgcctgtcctccacgggtccgcggcgcgcacagcgacaccgcgcgcatccatccggtcaacgtgtccacatcggcgtcgatgccggacgcatacaaactggtccacgcgtcgaggatggccacggcacggtattcgcattgtgccggactctccccgcgcacacgcggctccgcgccgggcgtggcgatgaccagttgcggagcgaatccgatatcggacacgacgcctcttggctggcttggcgtggacagcaccatcggcacgccacggaacagtctggccagttccatcgcggttccggcggcgccgaccctgaccacgcgcatgcgctcgttatggcatgtcgggcatgaccattgcacggtggcggcgccgcaccagcggcatcgaatcgttccgtccgccaaccgttccaatggtcccgtgcaacgcgcgcatcgcacttggcggtggcatttcgagcagcttaacgcttcggtgatgccgtcctgcggtatggacagcagcaccggaccggtttccaaagctttggacagtatccggaccgcggtgtgtggcacgcgtgcgccgatggtcggatcggcgagtcgtgccagctcgtcgcgattgagccagcgaatccatggagacgcttccttggtcacggccggcaacgcgtgtatgggcgtgctgaagccgctcacctgcgtgtctccgacgtgcgccgcgtcggtttcccattggctttgcgcgctgcgcgcattggccatcgcgacgaacacgccgttatgcgatttcgcgcggagccgaagcacaccgcgcgcgttggcgtacggcatcatgccgtcggcgtcctggtagcacacgtcatcaaggatgaggaacagcgcgttgccttccaccggcgcgtacatggcggcgcgcgtgcccagcacgcaacgcacttgtccgcagctgatcgcgagatatgcccggtaacggtcggctggcgccatctgcgcgttgagcaccgcgaaatcgccgtcatagacgccgttcgcggccccggtcggagcgaatggtttcaagccgaccgaccgtagggtctcagtcatgtcggcgatctcccgcatggtcggcagcaccagcaccgccggcttgttctgagcgagcgccgcggccaccatccatgccgcgcagcgccgccaatggtcggcaccgggtagcaggtcgaagacgaacgattggaaacgtctgccttgcagcgcgtcatgcagcagattgatgttgccgtattgacgttgcaactggccgtatatctcctggtcgacggcggcgagccgttgtttgcccgccgcggttcctgcggcatcgcgattgccgacgcgcagctggctttcgacttttgccacgcgcggcggcactgccaggcggaggatattggcgcgcgtgccgccgaacgcgtccgcgatgcgcgtcatatcgtcgcgcatggattcgggaacgagcacacggtcggtgaccacacgttcgatgtaacgtatcgatgattcgggtgtggcgctggtatcggcgcgtttccatatgatgccgttgacccgctgcccgccgaagcggacgcgcaccatcacgccgggttgggcggccgcagagtatttttcctcgacgaaatagtcgaaggtctgtcccagatgcgtggcctggatgtccagcaccacttgggctatgggatgttcggcggctggcgttttgacggcgggcgcgcgtttgcgccgcttgcgcggggcaagcccgtcaagcgccagctgctcggcatcctcattggtcataatgcaagggtaacgcatgcgccgacgcctgtttcatcgtaggacgtcggccgcgttttcaagccttgatggcctccttgagttcgtcgaccatgttggtggcttcccaagtgaagtcggcatcctcgcgaccgaaatggccgtaggccgcggtcttggagtagatcggacgcttcaggtcaagctcgtcgatgatggcggcgggacgcaggtcgaacaccttgcgcaccgcctgctggatctgctcgcgggtcacaccgatctcggtgccgtaggtctccacgttgatggacaccggatcggccacgccgatggcgtaggcgacctgcacctcgaccttgtgggcaaggccggcggccacgatgttcttggccacccagcgtgccgcataggccgcggaacgatccaccttgctcggatccttgccggagaacgcgccgccgccatggtgggcagcgccgccgtaggtgtcgacgatgatcttgcggccggtcagaccggcgtcggctgccggaccgccgaggatgaacgagccggtcggattcaccagcacgcggtattcgtcgtgggccacacggtcggcgagcacgtcatccagcaccggacggatcacatgttcggtgagctgttccttaagccatgtctggtccacttccgggtcgtgctgggtggagaccagcacggtgtcgagacgcacgggatggtcatcgtcgtcgtattcgatggtcacctgcgtcttgccatccggacgaagatgcggcacctcgccgctcttgcgcacttcggcgagacgatacgccagacggtgcgccagatgaatcggcaacggcataagcacgtcggtctcgtcgcacgcatagccgaacatcacgccttggtcgcccgcgccttgcgcctcataccgctgttcacgggacgccttcgactcctcctcgccactcaaccgggcaacgccctggttgatttccggactttgctcggtaagcgacaccgtcacaccgcaggaatcggcgtcaagtcccacgcgggagctggtgtagccgatattgcgcaccacggagcgcacgatgttctggatgtcggaatagccttcgctggtcacctcaccgaacacgaagaactgtccgaccgtggcgcaggtctccacggcgacatgggaatgcggatcctgcgcgagcatatcgtcgagaatcgcatcagaaatctggtcgcagaccttatccggatggccctccgtcaccgactcggcggaaatcaacttcaattcagccatacggctgctcctttcgcgaacacccaaccgttcgcatcctgtgatcgcccacgaaaaacgccccgtccttcacagacgcaatcaatagttaattgttgactattcaaagcgcaccgctcaggtatcggggcgaatggaaaatgatgccagtccctctatgggaaccgtgtagatcagttgccttcggtcagatcgtcctcaccaagggtttcctcaagcagaccactgttgatctcgcggaacgcgatggacagcggcttctcctgattctggtattccaccagcgggccgacgttctgcagcagaccctcattgagctgggtgaaataggaattgatctggcgggcacgcttggccgcgaaaatggccagagcgtacttggagtccgcatgctccatcaaatcgtcgatcggcggatccgcaagaccggtcggggttggctcagtgccgaatgccatagtgattatctccaaatcatcagataagccaaaagcttcttttccaaaatcattagtataggcaatccactggacctcaaccttgcctctcccacaggccttctccaccagcgtagttatccaacctgtaagggaatcacacggttttccgaaaatttccacatagtgactcttgacaaaacacgtgtcccgtttagccagcacaataggaggcatggaaatgcgatctgcaaaactaatgaatggacgagtattcgcgggcgctcgcgccctctaccgcgccgccggtgtggatggcaaggatttcggcaagccgatcatcgccatcgccaattccttcgacgagttcctgccgggacatgtgcacctgaacaaagtgggccgtctgatttccgatgccatcaaggaagccggcggcattccgcgcgagttcaacacgatggccgttgatgacggcatcgccatgggccacaccggcatgctgtactccctgccgagccgcgacatcatcgccgataccgtggaatatcaggtgaacgcgcactgcgccgacgcgctgatctgcatcccgaactgcgacaaggtcgtgccgggcatgctgatggccgcgctgcgactcaacattccgaccgtgttcgtttccggcggtccgatggaggccggcaccaccgtgctgcccgacggcaccgtgaagaagaacaccgatctgatcgacgtgatgtacgcctccgccgatgacaatctgaacgaagaggatctgctcgcctacgagaagaccgtctgcccgacctgcggttcctgcgccggcatgttcaccgccaactccatgaactgcctgaccgaggccatcggtctggctctgccgggcaacggcaccattctggcctcccattcctaccgcaaggacctgttcaagcgcgccgccgagcaggtggtgaagatcgccaagcagtattacgacgatgacgacgattccgtgctgccgcgttccatcgccaccaagaaggctttcgagaacgccatgaccatggatgtggccatgggcggttccaccaacaccgtgctgcatatcctcgccatggcgcagtccgccgacgtggacttcacactggatgacatcgagcgtatctcccacaccgtgccgtgcatctgcaaggcgtcgccgtccggcgaatgggagatttccgatgtgcaccgcgccggcggcatcaccggcatcctcggcgagcttgaccgtgccggcaagctgcaccgcgacgtgcattccattgattacaagtcgttggaagacaagcttaacgactgggacatcatgcgcgacacctgcaccgaggaagccaagcagatgtatctggccgctccgggccacatcgtctcccccgaaccgtggacgcacaccacgctgttcgattcgctcgatcgtgaccgtgtcaacggcgccatccacgatatcgaccatccggcggtcaccgaaggcggtctggccgtgctgcgcggcaacctcgcgcctgacggctgcgtggtgaagaccgcaggcgtgccgaaggagatctggacgttccgcggaccggcgctggtcgtcgaatcccaggagcaggccatcgaggtcatcctcaacgacacgttgaagccgggcatggctctggtcatccgttacgaaggcccgaagggcggtccgggcatgcaggagatgctgtacccgacctccttcgtgaagggcaagggcatcggcaagcaggtggccatgctcaccgacggccgctattccggaggttcttccggtctggcgatcggacacatcgcgcctgaggccgcgaacaagggcccgatcgctctgatcaagaacggcgacatcatcaacatcgacattccgaaccgtacggtgaacgtcgagctttccgacgaggagctgactcagcgccgcgccgagctggaggccggcgatggctatgtcgcccatcgtgatcgcaaggtttctcaggcgctgaaggcttatgccgccttcgcccgctccgctgacaagggagcgacccgtgatccggagctgatcgacaagctgtccggtctcgcctgattcaaacatacggaaagggcctgcgcgaaatcgtgcaggcccttttcgtatgccggtttttattggctggatagtcggattgacggattacaggccgaactcttcggcgatgatatgccaaagctcgtctgcggcctcgtcgaccacgttattgacgatgcgtttgtcgaattccggcgcagcggccaactcgaccttggcggtctcaagccttttggcctgctgctgaggggtttcggtgccacggccgatcagacgacgtttcagttcttcgaaggacggcggctcaatgaacacggtaagcacttcgaggccgagttccttcgcgcgccgtttgaccgtccgggctccctgtaggtcgatttccaagaccacggggatattgcgttccagatgttccacgactggtttcacgggtgtgccgtagtgggcgaggccgaacacgtcggcggtttcgagaaactcccccgccttttctttggccaggaattcaggttcggtcatgaagaaatagttcacgccgtccacttcgcccggacgaggctggcgtgtcgtggcggacaccgacagccagatttcggggtgctgttcgcgtacgcgccccagaacagtgcctttgcccactccggcgggtccgcagagcacaatcaaacgtccatgttgagaatcagccattccatccccactcttggttatgtcttgttttccaaaaaggaagctattcagaaaaagaatttattcggcgtctccgtcagccgcatcatcggcgctttcgttttgagcctcggtcaatgcctgccgaatatccccggcgaccgacgcggtggcttcggtcaattttgcgatgtcgggaccgtgcgtggcgatggaacgagataccgtaaccagcacattgcccttggtgcctttgaacacggtcttcagatcgcgtgtctccgctccctgccatccgtagcctggggaaagaatcggtccggtgaacttggccgggtcgacgcccgaatcgttgatccactgcccgatggtggcgccgatgataaggccgacggaacccattccatcattgcccttattgaatttctgagcagtgctggcgatgccgtacgccactgttttgcccttgtattcgcctgcctgacgaatcgccgtctgcaggctggcgccttcctggttggacgtcaacgatgcgatgaacacgcccctgccgttgttgagcgcgtcattgatgacgcctcccaatgaccgtgcgccgtaatacggcagcagggtgatggcgtctgccagcaatggcgcgcccggcttgaaataggcgtccgcgaacgcggaaatcgtggtcggcaggccgccatgcaggcagtcgacgatggtgatgacacccatctgccgtgccgcatagagcacgcgttcaagcgcggcgatgcctttggaaccgtaccgttcgaacatggagaactggaatttgacagctgcggcacggccattggccgcctgcagcatacgcatggaatacagttccgcacccaacgcgtcgacgttatagccccagtcagtgaggagctgccgatgcgggtcgatgccgacgcacaacgggccgtatttggccattgaattgctcagtcgcagaccgaaatccgaacgctgggcattcacttcctcactgctggggctactcatcattagtcacggctttccaattcgaacagctgcgtggaatgatcctgaatactcatgatctgataatcattattgcgcaccgcctcgatagccatcaacacggcggagaattccgtcatggtggtgaactgcggcaggtcggctgcgatagccgccgaacggatggcgtagccgtcggaacgggaaccgcgggagttcggcgtgttgagaatcaggtcgatcgcgccttcctcgatcagctggacgacgttcttgccgacgctgccctccgcatggtaggtggtgatcgggtcgtctggatcggagtccatacgcacgctgatcttgtcgacgatcttggaatcgatgccgtagcggcgcagcacggatgccgtgccttcggtggcccagatgttgaagccgagctcgaccagtcgcgcggcgaacagcggcagctggcgcttgtcggtgtcgttcacggagatgaacacgttgccgctggtcggcaggccgccttcgtatgcggcgagctggctcttggcgaacgcgtgcgggaagtcgcggtcgaagcccatgacctcgccggtggaacgcatttccggtccgagcagcacgtcgacggtcttgccgagcggagtgcggaatcgcttgaacggaagcacggattccttgacggccacctgctggccacgatggatgtcgccaccgtcgccgtggggcaggagcaggccgttgtcacgctgctgctggatggtttcgccgaccatgatgcgggcggcggccttggccagtgccacaccggtggccttggaagcgaacggcacggtacgggaggcacgcggattggcctcgatgacgtacagagtgttggccatgaaggcatactgcacgttgatcaggccctgcacgccacagcccttggcaatggcgtaggtgccttcacgcagacgacggatctggtcatcggacagcgtgctcggaggcagggtgcaggcggcgtcaccggaatggacgccagcttcctcgacgtgctccatgatgccgccgatatacagctcctcgccgtcgaacagcgcgtcgacgtcgatttccacggcatcctgcaggaacttgtcgatgagcagcggcgaaggcagacggccggacacgacggtgtcggcctgggcttccttcaatgcgcgatcgacgtacttgcgcaattgggcgtcgtcgtagacaatttccatgccacggccgccgagcacgtagctcggacggaccagcaccgggtatccgatggcgtgcgcggcctcgcgggcctcgtccaggctcagcgcggtgccgtagcgcggcgcgttcatgtcggccttcttcagcacctcgccgaagagctcacggttttcggccagatcaatggattcaggcgtggtgccgagaatcggaacgcctgcggccttcagtcgggcggccagggacagcggggtctggccgccgagctggacgatgacgcccttgatcggacccatcttcttttcggcctcgtagatctcgagcacgtcttcgaaggtgagcggctcgaaatacaggcggtcggacatgtcgtaatcggtcgacacggtctccgggttgcagttaaccatgatcgtgtcatagttcttgcccagttcctgcacggcgtgcacacaggtgtagtcgaactcaatgccttggccgatgcggttcggaccggagccgaggatgatcacggcctcgcggtcgcgaggacgcagctcggtctcatccgcgtagcaggagtagtagtacggggttgccgcgtcgaattcggcggcgcaagtgtcgacggtcttgaacaccgggcggaggtcgtacgaccaacgcagctcacggatggtgttctcgccctcgtctcccagacggcgcaggtgcgcgatctgcaggtcggacaggccggcgagcttcgccttcttcagcagcttcctggtgagcttctccgcgttcttgacttccagcgcagtctcgttgatgagcgcgaactggcggatgaaccacgggtcgatcttggtggccgcgaagatctgctcttcggtggcgcctccccacagggcacgctgaatctgcagataacggtgctcggtcggcaccttgatggcgtcgagcagctgggaaacctcgtcctcggacggcttgtcaccatcccagttgaagcccatgtgacgcttgtcgatggagcgcatagccttaccaagcgactcctggaagttgcccgcgagagccatggcctcgccgacggacttcatggaggtggtcagcgtcggatcggcgcccgggaacttctcgaacgcgaaacgcggcaccttggtgaccacgtagtcgatggtcggctcgaagctggccggcgtggactgggtgatgtcgttctggatctcgtccagcgtgtagccgagggccagcttggtggcgatcttggcgatcgggaagcctgtggccttggaagccaacgcggaggaacgggacacgcgcgggttcatctcgatgacgatgatacggccggtgtccgggttgacggcgaactggatgttgcagccgccggtgtcgacgcccacgccacggatgatggcgatgccgatgtcacgcagcttctggtattcgcggtcggtcagggtgaagaccggtgccacggtgatggagtcgccggtgtgcacgccgaccgggtcgacgttttcgatcgggcagacgaccacgacattgtccttcttgtcgcgcatcagctcgagttcgtattccttccagccttcgatgccttcctcgatcagcacctcgtcggtcggggaatagtggatgccggcgccggcgatgcggtgcagctcgtcttcgtcgtgcgcgatgccggagccgagaccacccatggtgaagctcggacggaccaccagcgggtagccgaacttctcggcgatcttgtcgacttcctcaagggaatgcgcgatgtcggagcgggcggattcggcgccggcctcctccacgaccttcttgaagagttcgcggtcctcgccacgatcgatggcgtcaagggacgcgccgatcagctcgacgttgtacttcttgagcacgcccgcctcgcccagcgccatggccgcgttcagcgcggtctgtccgcccagcgtcggcagcaacgcgtcaggacgttccttggcgatgatctgctcgaggatcggggtggagatcggctcgatgtaggtggcgtcggccatttccggatcggtcatgatggtggccgggttggaattgaccagaatgaccctaatgccctcttcgcgcagcacgcggcaggcctgggtgcccgaataatcgaattccgcggcctggccgatcacgatcggaccggagccgatgaccatcacggacttgatgtctgtgcgcttaggcattgcgggttccctccttgacggaacgcatgagatcaacgaaacgatcgaacaggtatgcggcatcgtgcgggccggcggcggcttccgggtgatattgcacggagaacgccgggatatcgacgcactgcaggccttcgaccacgttatcgttcaaatcgatatggctgacgaacaccttgccgtatttgccgttctcgaatggcgcgtcgacggtttcgccgattggcgcatccacggcgaagccatggttgtgcgcggtgatttcgattttgccggtggtcatatccttgaccggctggttgatgccgcggtggccgaatttgagcttgtacgtgccgaagccgagcgcgcggcccagcagctggttgccgaagcagatgccgaagaacggatatccggcgtcgagcacctgacgcagcagattcacttcaggatcggcctgttccgggtcgcccggaccgttggagaaaaagacgccgtcgggattaagggactggagctcgtcgaaggtgatggtggacggcaccacatgcacgcggcagccgcgttcggccatgcgatgcggggtcatggacttgatgcccagatcgacggccgccacggtgaacagcggttccttgccttcgaattcgccgcagggttcgatggtataggcttccttggtgctgacctcgtcgtagaggctcatgcccttcatctgcggagtggccttgacctcgtcgagcatggagtcgatggtgcgcagtttgccgtgaccgtcgagcagcgcgtcgcctgagaagatggccgcacgcatcacaccggcggaacgcaggtggcgtaccagcttgcgcgtgtcgatatggctgatgccgacgatgtggttggattcgagatcgtcgtcaaggctgccggtggcgcgccagttgctcacattcgggctgggatcgcgcaccacatagcctgcgacccagattctggaggattccggatcctccccgttgattcccgtgtccccgatgtgcgggaacgtctgtaccacgatctgacggtcgtagctgggatcggtaagcgtttcctggtagccggtcatgccggtcgcgaaaacgatctccccgctggtcgtgccgatcgcgccgtatggctcgcccacatacacctgtccgtcttcgagaacaagaacggcatcctgagggtcaaacatcacggcttcggaatcatactggttcaccaaaacccccttatagtcaaggtattcgtaccaaggatagcggccggttaggactcgcgacccggccgaatcgcttaactttcggctttattcagccgaaggttcggtcggttgttcggccacttcagtggcttccgcatcggcgctcaccgcgctgagcagaccatggatgaacgccggcgaatcgtcgtcgcacagcgttttggcaaggctcaacgcctcatcgatggccaccatgttgggaacatcatcgttgaacatgatctcccatgcggcgatgcgcaggatattgcggtcgacgacgcccatgcgcttgaccttccaaccggtggaatgttcgtcaagcatggcgtcgatggcggcgatatgctccgccacgccacggacgatttcgatggcgtagtcgggcagcggggtctgagcgccgggctgctcgatgcgctcagcaagaagggacaggatgtcctgtcccttctcatccgcttcatacaacgtgttcagagccctcttgcgagcggtggaacgtgccatgaaacttcgctgtccttactctcagttctcgcggccgaggtaggagccgtcggtggtgttcaccttgaccttctcgccttcgccgatgaacagcggcacctggatctcggcgccggtttcgacggtggccggcttggtgccggcgttggaacggttgccctgcaggcccggctcggtgtgggtgacggtcaggacgacggaagccggcagctcgacggacagcggggtgccgtcgtggaaggacacgacgcagtcggtgccttcgagcaggaacttggcctggtcgccgaccagggtcttcggaatgaagatctggtcgtaggtggtcatgtccatgaagacgaagttgtcgccgtcttcataggagtactggaggttgcggttgtcgacggtttcgaattccatcttcatgcccgcgttgaaggtcttgtcgacgatcttgccggaaagcacgttcttgatggtggtgcgcacgaaggcggggcccttgcccggcttgacgtgctggaacttgatgacggtccacagctggccatcgaggttcagaacagaaccgttcttgatgtcattggtagtctgtgccaaattaactcacctatttcttcatctgacggaaaagcttacaaaaagccttgctcattatgccacggcgtgcatactttggagcgttgcccttccatatataaagaaacctccctcggattctcatccttgggaggtttctttaaaacgctagttcaagcgtgtcttgatgtcgggtagaaactactcgatgatcttggtgacacggcccgagccgacggtgtggccgccttcacgcactgcgaaggtcaggccctcttccatagcgatcggctggatcagctcaacgccgaaggtagcgtgatcgcccggctgcaccatctcaacgccttccggcagggtgatgacgccggtgacgtcggtggtacggaagtagaactgcggacggtagttggagaagaacggcgagtgacggccgccttcgtccttggtcagcacgtagacttcgccctcgaacttggtgtgcggggtcacggagcccggagcagccagaacctggccacgctcgacctggtcacggttgatgccgcggagcagcagaccggtgttgtcgccagcctcgcactcgtccatctgcttgtggaaggtctcgatggaggtgacggtggtggtctgggtcggacggatgccgacgatctcgacgttggagttgaccgggagcttaccacgctcgacacggccggtcaccacggtgccacggccggagatggtgaagacatcttcgatcggcatcaggaacggcttgtccagatcgtggaccggggtcgggatgtagtcatcgacggcgtccatgagcttcttgatctgctcaacccacttctcgtggtccggagcgtcatcgtgcagtgcgccgtaagcggacacgtggatgaccgggcaatcgcgatcgaagccgttttcgtcgaggaggtcacggacctcttcctcaacgagctcgatgagctcgtcgtcgtcgaccatatcgcacttgttcagagcgacgaggatcttcgggacgcccacctgacgagcgagcagcacgtgctcgcgggtctgagccatcgggccgtcggtggcggccacaacgaggatggcgccatccatctgagcggcgccggtgatcatgttcttcacgaagtcagcgtggcccgggcagtcgacgtgagcgtagtgacgcttctcggtctggtactcgatgtgggcgatgttgatggtgataccgcgggcggcctcttccggagcggaatcgatctggttgaagtcgtactccgggttgacatccgggtactcctcgtgcagcaccttggagatggctgcagtcagggtggtcttgccgtgatcgacgtggccgatggtaccaatgttaacgtgcggcttagtacgctcgtacttttcctttgccatgtgtttgtcctcctggacgtctcgtagtaagccttgaactcacttcaaggcactcgctacattttactgggtttgacgggtttgtgccactttggagcccgaacccagtcagcgctacaaaatactagcgctgactggagacagtttccacttcagtggcagcgcgtgtcactcgccgcgctgggccttgatgatctcctcggagacgttcttcggaacctcagcgtaggagtccatctgcatggtgaacattgcgcggccctgggtcttggagcgaagatcgccgatgtagccgaacatctcggacagcgggaccttggcgtcgatgaccttgacaccggtggagtcggtcatggactggatggaaccacgacgtgcgttgatgtcgcccatcacatcgcccatgtactcttccggagtacgcacttccacggccatgatcggctcgaggatgaccggcttggccttcggggcagcttccttgaagcacatggaacctgcgatcttgaaggccatttcggaggaatcgacgtcgtggacctggccgtcggtgacggtagccttgacgccaaccaccgggaagccggcgaggatgccggattccatggcttcctgcacgccagcatcgatggaaggaatgaattccttggtgatgtggccgccggtgacttcgttgacgaactcgtaggtctcgccgttctcggtgtcgagcggctcgaagttcatcaggacctttgcgaactggccggaaccaccggtctgcttcttgtgcgtgtattcctggttcatgacggccttgcggatcgtctcgcggtatgcaacctgcgggttaccgacgttgcactccaccttgaattcacgacgcatacggtcgacgatgatgtcgagctgcagctcgcccatgccggagatcagggtctggccggactcttcgtcggtcttcacctggaaggtcggatcctcgtcggacagcttcgccagagcgatgctcatcttctcctggtcggccttggtcttcggctccacggccacctcgatcacaggatccgggaaggtcatggattcgagggagatcggggacttctcgtcgcacagggtatcaccggtggtgacgttcttcagacccacgaaggtgtagatgttgccggcttcggcggcatccaccgggttctccttgtcggcgtgcatctggaagatcttgccgacgcgttccttcttctccttggtggagtcgaggacggtgtcgcccggcttgacggaaccggagtacacgcgcacgaacacgagcttgccgtagaacgggtgggtggagatcttgaagaccagtgcggagaacggatcatcggtggtcggcttgcggtcgatctcgatggactcgtcctgcgggtcgaagccgacgatggacggaacgtcctccgggctcggcaggtagtcgacgacggcgtccagcatcggctgcacacccttgtccttgaaggcggagccgcagagcaccgggtaggcctcacggttgatggtgagcttgcggatgccggcgcggatctcgtcctcggtcagttcgccggactcgaggtacttctcaagcagctcctcgtcggactcggcgacctggtcgagcagctcggaacgatactgctcagccttgtcctgcaggtcggccgggatgtcggtggtgtcgtagtgggcacccagatcgccggaaacgtcgttccagacgtaggccttcatgcggataaggtcgacgacgccggcgaagtcgttctcagcgccgatcggcagctggacgaccagcggggtcgcgcccagcttggtcttgatggtgtcgacggagtagtagaagtcagcgccgagcttatccatcttgttgatgaagcagatacgcggaacgccgtacttgtcagcctgacgccacacggtctcggactgcggctccacgccttccttgccatcgaacacggcgacagcaccatcgagcacacgcagggagcgctccacctcggccgtgaagtccacgtggccaggggtatcgatgatgttgatctggaacttctgcttctcgtcatgggtctgacggttccagaagcaggtggtagcagcggactgaatggtgatgccgcgctcctgctcctgagccatgaagtccatcgtcgaggcgccatcgtgggtctcgccgatcttgtagttcttaccggtgtagaacagaatacgctcggtggtagtggtcttaccggcatcgatgtgagccatgatgccgatgttacggatctggttgagatcattgagcacgtctagtgccatgattgttccttaactctcgttctcgactaattaccagcggtaatgagcgaaggccttgttggcctctgccatcttatgagtatcctcgcggcgcttgacagaagcaccgaggccgttggaggcatcgaggatttcgttggccagacgctcagccatggtcttctcgcgacgggcgcgggagaagtcggtgagccagcgcagagacagcgtgttggcgcggcccggcttcacttcgaccgggacctggtaggtagcgccaccgacacggcgggagcgaacctcgagggacggacggatgttgtccagagcgcgcttgagaacggcgaccggctcctggtcggtcttctccttgaccatgtcgagagcgctgtagacgatgtcctcggcgattgacttcttgccgtcaagcagaatcttgttgatgagctgtgccacaacggtggaaccgtagatcggatccggcagcagctgatgcttcttggaaggtcctttacgtgacatatctcttacttcgccttctttgctccgtacagggaacgaccctgcttgcgatccttcacaccctgggtatcgagggcgccacgaacgatgtggtaacgaacacccggcagatccttgacacggccgccgcgaacgagcacgatggagtgctcctgcaggttgtggccttcgcccgggatgtatgcggtgacttccacaccggagctcaggcgcacacgggcgaccttacgcagtgccgagttcggcttcttcggggtggtggtgtaaacacgggtgcacacgccacgacgcagcgggcttcccttcagtgccaaagtcttggacttcttcggctttgcctgacgtcccttacggacgagctgttcaatagtaggcaacttgaattctccgattcagtggtttctcttgttttcgtgtgaccgccgcactgcacccacactccacgacactgaatcgtaaagatagccacagtccaccggcccgatggcccgtccctctctcaccgccgcattgctgcgcgtgatgcaatcgagttccgggatatcccaacccgcacgcctgttacataaggcatgccgttggcacacacgaattaccagtatacaggtctgccggacaatgctggataatcgtgtcgcgacagcaacggccgttatacgaagagtggctccgacgccatcctggcatcggagccactctcccacgcgccaccttgcgcgcatcgcttcaaacctctgagtcttttcataaccccatgcggcccggcgccctcgccgtactgcctatgccgccatctcgaatcgctatattcggttgttcttcagttatatcttgaaggcgttgcgcatgggcctcacggccatcggcgcctcattgcgacctgacgaattctcgaccgatctgcaactccggccttcacctttagtataccgcaaacgaacatatgacacggggcaaaacacccctaaatcccaatattttcaatacttaaccgaacttcagcgcaaagcaacacaatctaacatcgccatggaaaaacaggtcaaaacagaacagcctctgaaccgttctgtacggttcagaggctgcctgaccgatgccacgaatcacattcaggcgttgaccgtttcctcggactcatccttgacggcgtccccggcttccgaagccttggccgcggaacccttctcgccattgtcggaatccgggtggatctgatgcttgtcatcgtgctcgcgccaccagctggacagcaccgaaccggagatgttgtgccatacgctgaagaaggtggacggcacggcggcaagcgggttggacgcgaaggagctcagggccagcgtggcgcccaaagcggaatcctgcatgccgacctcgaaggtgatggccttctgctgcgcgtagcggaagcccttcggatacaccttgtacatgagcttggagaagccgaagcccagcgcgtagccgcacaggttgtgcaggatgaccaccgggatggcaagcagcgaggatgccacgaacagcttcgaaccattggctgcgaccacgacgccgatgatgagcaggatggcgacctgggacacgatcggcagcgccaccgtgaccttctcgatcttctccttgaagatggcgtggcagatcacaccgagcgcgatcgggaacagcaccaccttgaccgcgttgaggaacagggactcgaccggcacggtcacatactgggaggcgagccactgcatcagcagaggaatcatgaacggcgcgcacagcgtggacaggatgccgatggacacgtcaagcgccacgtcgccacggctcagatagctcatcacgttggatgaggtgccggacgggcagcagccgaccagaatcacgcccatggcaagcgggccgtcgagacggaagatccagcacagcagcacggccaccaacggcatgatcacgaagtgggccaccgtgccgacgacgaccatcagcggctgggtgaggatacgtttgaaatcgtcgagcgtcagcgtcaggcccatgccgaacagcacgatgcccaggaagtatccggtgtaggacttgccccacaggctggtttgcggcacgaagtagttgaacacggcccatacgatcacgatcacggtgaaccatttggtgagccaatcaccaaacgccttgatcttctgcattatcgtttcctcttttctcaatcacgtttccatggaagtcatttccggggaaaacaaaacgggaccggctttccgccgaccccgtcgtgacatcttccgttggaattgcctacaaattaggcacccacccatcaagtgcgtaacattccgttcacataatgaacatcacttgacggccggaagcgcaacacgccgacgcgcgcacatccaaaaaatcgtgtatagtatccattcgttgcgcttccgcatggaagtgagaacatggtggctatagctcagttggtagagcatctgattgtggttcagaaggtcgcgcgttcgagccgcgttagccaccccggtgaaacctcggaagaaattccgaggttttttgctatccgcggcggccgaacgcgcggaaccagactttcccgatcgcaagcaacccacaacaaaaggaacgaccatgctgtctttcgaaaacgactactcctgcgccgcgacgccggaaatcatcgcccgtctcgccgaaaccgcgaccaaccagtatcccggctacggcaccgacgacgtctgcgaaagcgccaaagccaaaatccgcgaggcctgcgcatgcccggacgccgaaatcttcttcctcgtcggcggcactcagaccaaccaggtcgtcatcgacgccatcaccccaccgtatgcgggcgtggtggcggccaccaccggacatgtgaacgtgcatgaggcgggcgctatcgaattcaccggccacaaagtgctcacgctcccccaccatgacggcaaaatcgacgcggatgaactcgacgaatactgcgccacgttctacgcggacggcaactacacgcatatggtgttccccggctgcgtgtacatttcgcaggccaccgaatacggcacgctgtacacgctggccgagctcgaggcgatccgcaaggtctgcacgaagtacgacatgccgttgttcatcgacggcgcgcgtctcggctacgcgctgaccgcctccggcaacgacgtgacgatcgaggacatcgcgcgtctcgccgacgtgttctatatcggcggcaccaaggtgggcgcgatgttcggagaggccgtggtgttcacgcacggcaacatgccgaagcatttcgtgacgatcgtcaagcagcatggcgcgctgctggccaagggatggctgctgggactgcagttcgacacgttgttcaccgacggcctgtacctgcgcatcgcccgccacgccaacgatgccgcggaccgtatccgcaaggtgctggtggaacgtggctacacgctgactttcgatgcgccgaccaaccagatcttcgtcacgctcgacaacgagacctccgaacgtctgcaacgcgacgtccgtctcggcttcacggaaaaggcggacgacacgcataccgtgatgcgcatctgcaccagctgggccacgaccgacaagcaggtggacgagctggtcgcactgctgtaaaagacagtccgcaaaacaaggaaagccgggaaatcgctcccggcttttcgcttatgtataacgattgtattgcgattgcggcaggcgccattcagcgacggttatcggcgatcgcctcacgttccatcgcgacgaacttacgtacggacgattccaccgaataattggttttcgtatgtttggcgtaggtgccgccccacttggcgagctgcgccggatggtcgatccaccagtcgatacgacgggccagcgcgtccacatcgtccacggggaacaacgattcgtccagcagcgcgaactggccggccgcgctcagcgacgacgaggcaatcaccggcaccagaccggcggccatgccttcgatgacactcaccgattcgagatcggcgatcgacggatgcaccagcagatcgccggaacgcagcaacgccggcatgtcggcattccggtggaatccgatcgaagccggacgagacaacagccgtccggccatacgctgcaacctcttcttaagcggcccggtgccggcgatcaccaattcgatgtcctgcgcgtgacggcagcgggcgatcgcccggatcaacgcgacatggttcttctcattggtcagtcgtcccgacgcgacgatacggaacggcaccggcgacggctcgtccgccttgcgctgccgcttcggcgtgaaccgcgattcgtagccgttggagatgacatgcagcttcgacttgtatccatgcgagcgcagcaggctcgcacccaattcggtcggcacatgcacatggtcgatcttgcggtacagccatatgtcgaacagccagtagatgaacgagtcgatgccgggcacatatttcaaaggccccgcggaatacgtgacgttctccggctgcacgtggtagccggccgtaacggcgatgcccatctgtttggcgaccttgcaggcatgctggccgaaacggaacggcgtgtagatatgcaccacgtccacaccatcgaacgccttgcgaaacagcgtgtcgctcggctcggcgaactgcatctgctgcttcttcgccacccagctgaccaacggcacatgattgacgcgcgcgggatattcgggcgcgccgatgcccaccaaacggacatgatgcccctggcgctccagctcctgcgcccactgcaacgccgaattcgaggtgccattgccccgattccccgacgtgtcgaccaccatggcaatggtcagggggggttgcgtttcattcttctcattctcggacatgcgttccatcctacgccgatggcacaatagaagtcatgactgaagagaatcgtgccctcggcactccgcttggcaagcatccgacccgtgttctgttccttggctccggcgagctgggcaaggaagtcaccatcgaactgatgagactcggcgcatgggtgtgcgcggccgattcctacgccggcgcgccggcacaacaggtggcgcacgaataccgcgtgctcgacatggccaacgcggaccagctgcgcgcgctgttcgacgaaatccagccggacatcatcgtgccggaagtcgaagcgatagccacttccgagcttgcggccgccgcagcacgtggcgcgcaggtggtgccgagcgccgaaatcgcggcgatctgcatggatcgcgaacgcctgcgcgtgctcgcacacgaggaactgggactgccgaccaccccgtaccgtttcgccggctctctggaagaactacgtgagggcgcgcaaatcgtcggctatccatgcgtggtcaagccgatcatgagctcctccggccacggacagtccgtggtacgttccacggaagcgatcgacgcggcttggaccgaagcgcaggaaggccgccgcgcacacgacgaaggcgacgtgtcacgcgtgatcgtggaggcgctcgctccactcgactacgagctgaccgtactgaccgtcagctccagcgccggcatcgtgacctgcgctccaatcggacaacgtcaggaaagcggcgactaccgcgaatcctggcagccggccaccttcacgccggacgtgctcgaacaggcccagcacatcgcacgaaccgccgtggaaggtctggtggcgaaggccaaggcatccggcgaaaaaggctggggcgtgttcggcgtcgaactgttcgtgctgaccgacggaaacgtgctgttcaacgaggtctcccctcgtccgcacgataccggcatggtcaccatggcttcccagcgattgagcgaattcgcattgcacgcgcgcgcgatcctcggcctgccgatcacacaggaacatgtcgccctgtcgattccgcaaggcaccgtcgcggcaagccatgcgatcgtcgtccagggcgatggcgaagcggaattccgcaacgtcgccgccgcgctcgccgaaccgggtaccgacctgcgtatcttcgcgaagccggaagtgcatgggcaccgacgcatggcagtcgcgctggccatcggcggcaacgaggcggatgcgcgcgccaaagccgggaacgtggccgaatcgctcgacatcgcaatcgtttgacggctatcgccggatgctgagacgaggctaccggaacgcgcccaaaagtcgcgcgattgtagcctcccgttggtatcttgttaaccgtcaagttcaccaaactatctacctcccacacaccaggaaaggcgagtaatggagaagttggaaaagctctacgagggcaaagccaagcaactgtacgcaactgacgatccggaggtcctctgggtcgaatacaagaactccgctaccgcaggtgacggcgaaaagaaggaagacttcgccggcaagggcaggctgaacaacctcatcaccacgttgatcttcgatctgctcaagaagcgcggcatcgacagccacctggtggcacgcgtgggcgagacctcccagctggtcaagaaggtcacgatgttcccgctcgagatcgtgctgcgtaacaccgcggccggccacttctgctcccgcctgggcgtcgaagagggcatcgagctcaaggaaccggtgctggagtacttcctgaagaacgatgacctgcacgatccgttcgtgaacgacgacgatctggtggcgctcgatgtgtgcacccgcgaggatctggccgaaatcgcgccgctcgcccgtcgcatcaacgaagccctgatcgaaatcttcgccaagatcgacgtcaagctggtcgatttcaagatcgagatgggccgcacctccgacggcacgctgctgctcgccgatgaaatcacgccggattcctgccgtctgtgggatcagcgcgaccattccggcaaggtggagcacctcgataaggacctgttccgccgcgacctgggcgacatcatcccggcatacgaggagatcgaaagccgcttggccgagctcgccaagtccgagggcatcgaagtcgcagagtaatgcgtttgcaagcccgcatctgaagcgaaagccggatgcgggcttccttgttatatcgcaatccttcattcttttgtcaatccaaatccaataacccctcttttttcaaggagttgaccatggtttttcgcgtgtacgtggaaaagaagccgggctttgacgtcgcggcccagcagctcgccaacgagttgcgcaccattctcggcatcgaagctttgaagaacgtccgtctcgtcaaccgttacgacgtggaagacatcagcgaggagctgttcgcccaggccacgccgaccgtgttcagcgagccgcaggtggacaacgtctacgccgacctgcctgatttcggttccgacaccgtgttcgcggtggagtatctgcccggccagttcgaccagcgtgcggattccgccagcgagtgcatccagctgatctcccaaggcgagcgtccgacggttcgttccgccaaggtgtatgcgttggaaggcgaactttccgaagccgatgtcgaggccatcaagcattacgtgatcaatccggtggaagcccgtgaagcctctctggatgtcaagaccacgctgaagacccaggtgccggtgccaggcaaggtggaagtcatcgacggcttccgttctatgagcgacgccgagcttgagcagttcatcgaggaccgtggtctcgccatggatctggccgacctgcagttctgccgtgagcacttcaccgaggagcagcgcgacccgacgatcaccgagatcaaggtgatcgacacgtattggtccgaccattgccgtcacaccacgttcggcacgcaacttgacgaggtttcgatcgacgatgccaccgtcaaggccgcgttcgacaagtatcttgagatgcgtcacgagctgggccgcgacgccaagccggtatgcctgatggatatgggcacgatcggcgcgaagtggcttaagaagaacggcattctgaagaatctcgacgaatccgaggaaatcaacgcctgcaccgtcaaggtgaaggtggatgtgaacggccatgacgaggattggctgttcctgttcaagaacgagacgcacaaccacccgaccgagatcgaaccgttcggtggcgcggccacctgcatcggcggctgcatccgcgaccccctgtcgggccgttcctacgtgtatcaggcgatgcgtgtgaccggtgccgccgatccgaccgtgccggtttccgaaacgcttgagggcaagctcccccagcgtaagctcgtcaccaccgccgcggccggctactcctcctacggcaaccagatcggtctggccaccggccaggtgaatgagatctatcaccccggttatgtggccaagcgcatggaggtcggcgcggtcgtggccgcgactccggccgatcatgtgcgccgcgagaccccggctccgggagacaaggtcatcctgctcggcggccgcaccggtcgtgacggcatcggcggcgccaccggcgcttccaaggcgcataacgtcgaatcgctggagcttgacggcgccgaagtgcagaagggcaacgcgccggttgagcgcaagctgcagcgtctgttccgccgtggtgacgcgtgccgtctgatcaagcgttgcaacgatttcggcgccggtggcgtgtccgtggcggtcggcgagctggccgacggcctgtacgtggacctcaacaaggtgtccaagaagtacgagggtcttgacggcaccgaactggcgatctccgaatcccaggagcgcatggccgtggacgtggccgccgaagatgtggacgagttcctcggctacgccaaggaagagaacctcgaggccgaggtcattgcgaccgtgaccgaggatccgcgcatgacgatggtgtggaacggcgacacgatcgtggacctttcccgcgaattcctcgcctccaacggcgctccgaagcatcaggtggtgcatgtcgaggcgcagcacggctacacgacgccgtggacttccggcacgctttccgagcgcatgcacaccatgctcaccgacctgaacgtggcttccaacaagggtctttccgagcgtttcgactccaccatcggcgcgggcaccgtgctcatgccgttcggcggtaggaagcagctgaccccgaacatggccatggtcgccaagcttccggtgttcggcgagaccaccaccgcttccgcgatggcctggggattcaacccgtacatcatggagcagaaccagttcacgggcgcgtacctgtccgtggtcgaatcgctttcgaagctggttgccgccggcttcgaacatgagaaggcgtacctaagcttccaggagtatttcgagaagctgcgtgacgagccggaacggtggggcaagccgatggccgccgtgctgggcgccctgatggcccaggtagatctgggcgcgggcgcgatcggcggcaaggactccatgtccggcacgttcgagcagcttgacgttccaccgaccctgatctccttcgccgtggcggtgggcaatatgaagcgcgccacctcccccgagttcaagggcgccggccaccgtgtggtccgcatcgccccgcgctataaggccgatggcctcacgccagacaaggacgcgttgctggaggtgttctccgcggtcgaggagcttaccgatttcggcgatgcgctggccgtgtccacgccgggctacggcgccaccgccgaggcgatcttcaagatgacggtcggcaaccagatcggcatgaagctggacgacggcattgccgtggatgacctgtttgctccggcctatggctccttcatcatcgagcttgccgacaacgcgaaggttccggccgtgtccaacctggtggaagtcagcgaggtcggcgaaaccaccgaggagtattcgttcgtggccgccggcgagacgcttgatctggccgagctgcaggacgcgtgggagggcagcatcgaatccgtgttcccgtaccgttccaagggcgaggagaagggcaagacggttgaaaccatgtccttcgacgctccgaagaagaccgtgtacaccggcaccggcgtggccaagccgcatgtgatcatccccgtgttcccgggcaacaactgcgaatacgattccgccgcagctttcgagcgtgcgggcgccgacgtgagcactctcatcgtgaacaacctcaccccggcggccgtggccgaatccaccaacgcgttggtagaggagatcaagaagagccagatcatcatgatccctggcggcttctccggcggcgacgaaccggacggctccgccaagttcatcaccgcgttcttccgcgctccggccgtgaccgaggccgtgcgcgacctgctgaacaaccgtgatggcctgatgctcggcatctgcaacggtttccaggcgcttatcaagcttggcctggtgccgtacggcgacatcgtgccgatgaccgccgaatgcccgacgctgacgttcaacaccatcggccgccaccagagccgtctggtgcgcacccgcgtggcgtcgaacctctccccgtggctggcgaagaccgccatgggcgacatgcacaccatcgccatctcccacggcgaaggtcgtttcgtggcttccgacgacgtgctcgctcagctcaaggccaacggccagatcgccacgcagtatgtggacgaggctggcgtgccgggcatggacctggatgtgaacccgaacggttcgctgctggccatcgaaggcatcaccagcccggacggccgcgtgttcggcaagatgggccactccgagcgctacagcaacggcacgttcgtgaacgtgcccggcgagaaggaccagccgctgttcgcggccggcgtggagtacttcgccgcctgagcatcgagactcttttcacgctcacataatcaagggtgggttcgaaatctcatgattccgaacccaccctttcatatacagcaatccgcgacattcgtcatagcagccgcttcaggcggaaaggtaaccctcggcgagatcgacgggcctgttggcgcgttccaccgcatcatcgctggattgcgcggtttgtctgatgatgtcgtcgtaaccggtcagggcggcgaaaggcatgaattgggcggcacggttatgcatgctcatatgggcatgcgtctgcgattggtgatgcggcagatcgatgatgtcgtcgtagcgatgggtttccgtaaggctcatgccgcatgacctcctatctgcttgttgcgctgctggcctgtggcgtcatcgaacatatccatggccttgatgatggaatttctgccgaatttgcgtttgatgtccagaagcgtttgctgcatatgcagttcggcgtccccttgcggcgaatccttggaaccaccatcggcggaacgcatagcctcgcattcggccgcatcagcggaagcggaatccaccggcacttccatcgtggcgaacaaatcaggctgcgtatattcggacgcggccgcctgccgccgttcctcaagttgctcgtcggtcagcacatcggcggcgaccacattcacccgacggaccagcaaacgcctgtcgacaatcgaaaggaaaagcttatcgaccgcgtcgcaaatacgcgacgtagccgacgtcggctccggcaatgcgatcgacccggtggccggcttgggtacgcggcggccatacctgtcgatcgaaacagggccgtcgtatgttgccgcggcatgttcggcaatcgccttcaaatcagcggaaacatccttgccaagccgtttcggatcgaggcttgccgtgtcgtagccgaccatcaatcccactctgccggctttcacgcccttcgctaccaaatccaatgacagcgtatccgccatttcacgcacaatcagccgggctgcgtcgaatcccgccggacctgtcagcacttgtccggaactcaagctgtgccccgccggcttgtacactttgatgtccgcgatggtgcacggttcccagccccacgcatggtcgatgagcagttcggcgttcacaccgaacatcttgtacagtagatcttcgttgtagtattcgtcggcacggccaatggaacagcgagcgatatcccccatggtcgccagtccgtgcgcttcgagcttccttgcatacccacgccccacacgccagaaatcggtaagcggccggtgattccacaacaatctccggtacgacatctcgtcaagccgggcgatgcgaatgccgtcctcccccgcctggatgtgtttggccacgatatccatagccactttggccagatacatgttcgtgccgatgcccgcggtggcggtgatgccggtctgggtgtggatatcgcggatgatgtcacgggtcatctcctccaccccttttccataggcgcgcaaatagccggtgacgtccatgaacacctcgtccaccgaatagacgtggatatcctcagccgaaacgtatttcagataaataccgtagattttcgcactcatcgccaagtaatgagacatgcgcggtttggcgatgaacacgtcagcagccagattcggattggccgcgagcgccttcgcatcatacgatttccccgtcagcacaccgcctggagccgcggcgcgacggaccgcgttgatttccttcagtttcgctttgacttcgaataggcgggcgcgtccgggcagaccgtatgccttcaacgacggcgagatcgcaagacagatggttttgtcggtcctctcctggtccgccaccaccaagtgtgtggatagcggagggaatccatgttccacgcattccgaggacgcatagaaggatttgaggtcgattgccacgtatatccgtccggccatgatgctccttccatgcaatggctcatacgggggacttcccgcaccccgacgaccgtgattcgcgttttcaacgtcttccatcataacagctttttcgaacggctgttcgattgcatgtccggttccatataccgtctgagaactggacaaaacccgactcttgtagccgcccattgatactgttggacgatagcgaaccccttgtctccatggttttggaaggagctttggcttgtcagctgaactcgaagacatccacgaggaatgcggtattttcggcgtttggggccactcggacgccgcccgactcacctacttcggtctacacgcgctgcagcatcgcggtcaggagggtgccggcattgtctccaacgataatggtcatctcatcggtcatcgcggaacgggtctgctgacccaagtgttcagcgacgaacgggaaatcgaacgcctgaaaggagacaaagcgatcggccatgtgcgttacgccacagccggttccggcggcaccgacaacatccagccgttcatcttccgcttccatgacggggatatggcgttgtgtcacaacggcaatctcaccaattgcccctccttacgccgcaagctggaggacgagggagcgatcttccattcgaactccgacaccgaagtgctcatgcacctcatccgtcgttccagcaagcccacgttcatggacaagctcaaggaagcgctcaacaccgtgcacggcggcttcgcctatctgatcatgaccgaacatgccatgatcggcgcgctcgatccgaacggattccgtccgctgtcccttggcaggatgacgaacggcgcctatgtgctcgcttccgagacctgcgcgctcgacactgtcggagccgaactggtgcgtgacatccgcccgggcgagatcgtggtcgtggatgacgatggctaccgcatcgaccgttacacggatcagacccagctggccatctgctcgatggaattcatctacttcgcacgccccgattccaacatctacggcgtgaacgtgcattcggcccgcaagcgcatgggcgcgcgcctggctcaggaatcccccgtcgacgccgatatggtcatcgccgtgccgaactcctccctgtcggcggcttccggctattcggaggaggccggcctgccgaacgaaatgggtctgatcaagaaccagtacgtggcacgcaccttcatccagcccacgcaggagctgcgcgagcagggcgtgcgtatgaagctgtccgcagtgcgcggcgtggtcaagggcaagcgcgtggtcgtcatcgatgattccatcgtgcgcggcaccacctcgaagcgcatcgtgcagatgctcaaggaggccggggcggccgaagtgcatatgcgcatcagctccccgccgctgaagtacccgtgcttctacggcatcgacatctccaccaccaaggagctgatcgcggccaagaagtccgtcgacgagatccgcgactacatcggagccgattcactggcgttcctgtcgctcgacggcttggtggaatccatcggccttggcgcagacgcaccgtatggcggcctgtgcgtagcctacttcaacggcgactatccgaccgccttggacgactacgaagccgacttcctgaagtcgctcactccggaggatcgtgtccgtctgcccgaattcgccctgtacaagagcaagtacgaaggcaacgaatacaccaccacttcatcccaagaagaacactgagacccgagaaaggttagatatgccaaaagcatatgaggaagccggcgtaagcgttgaggccggttacgaagtcgtcaagcgtatcaagtcccacgtggcgcgcaccaaccgtccgggcgtggtcggcggcatcggcggcttcggcggattgttcgatctcgcttccctcggttacaaggagccggtgctgatttccggcaccgacggcgtcggcaccaagctggtcgtggccaagatggccaacaagcacgacaccatcggcatcgactgcgtggccatgtgcgtcaacgatatcgccgcccaaggcgccgagccgctgttcttcctggattacatcgcctgcggcaagaacaatccggctctgctcgagcaggtcgtctccggcgtggccgacggctgcgtgcaggccggttccggtctgatcggcggcgagaccgccgagatgccgggcatgtatgacgaagacgagtacgatctggctggcttcgcggtcggcgtggccgaaaagtccgctatcgtcgacggctccaccatcgctgagggcgacgtgcttatcggcctgccgtccaccggcgtgcattccaacggtttctccctggtgcgcaaggccctgttcgagcaggccggctacaccgtggacaccgtactggacgaactgggcggtgagaagcttggcgacgtgctgctcactccgaccaagatttacgtgaaggccctttccccgctgttcaaggcgggcgtggtcaagggcgtcgcgcatatcaccggcggcggtttcatcgagaacattccgcgtatgattccggacggtcttgccgcccatatcaacctcggctcctggccggtgctcccgatcttcgacgtgctcgagaaggccggcagcatcgaccatatggaaatgttcaacatcttcaacatgggtatcggcatggtgctggcggtcagcgccgaagatgccgataagaccatggaactgctgaagtccaatggcgaggccggctatgtgctgggcaatatcgtcaagaagaccggcgaggacgtcgaactgcagtaaacgaacatacgggggtagccgaacaggcacccccgatattatttcttgagattggcactcttccccataagggatacaacaggaggaaatatgaaggttctggtcattggttccggtgcgcgtgaacacgccatcgcccacgcgctcatgcgtggcgacagcgtcagcgaggtcactgtggctccaggcaatccgggcatggaacttgacggcatccgcaccacgcagctcaacccgtccaatcatgcggcgctcatcgatttcgtgaagaacaatggttacgattgggtgttcgtcggaccggaagtgccgcttatcgaaggcatcgtcgacgatttcgcggccgccggcatcaaggcgttcggcccgaacaaggccgccgcgcagatcgagggttccaaggacttcgccaagcagcttatggaacgtcacgacattccgaccgcgaagtaccagacgttcgacgatttggagcgttccaccgcttatgtgcgcgagcatggcgcgccgatcgtcatcaaggccgatggcctggccgcaggcaagggcgtgaccgtggcgatggatgaggagaccgccatcgccgctttggaggacattttcgtggaccaccgcttcggcaacgccggcgcgaaggtggttatcgaggatttccttgagggtcaggaattctctctgatgagctttgtgaacggcaccgatttctggccgatgccgatttcgcaggatcataagcgtgcctacgatggcgacaaggggccgaacaccggcggcatgggcgcttacagcccggttccgcagatcggtcaggatgtgatcgacaccgccatcgaaaccatcgtcaagccgaccgttcaggccatggccgacgagggcacgccgttcaccggcattctgtacgccggcctcatcgccaccgccgacggaccgaaggtcattgaattcaacgcgcgtttcggcgatccagagaccgaagtggtgctgccgaagctcacgtccgatctcggtgccggcatcaacgccattctgaacgatgagaccccggaattcacttgggatgaggacaatgccactctcggcgtggtgctcgcttccgacggctatccgaccaatgtggtcaagggtgccgcgattcctgagatcaaggtcgacgacgattcccacgtctactatgccggcgtgacgcgtggcgagcatggcctggtggcgaattccggccgcgtgcttttcgtggagacctccgcggccgatatcaaaaccgcgcaggacaaggtctacggcatcatcgacaagcttgacacgacgggaatgttctaccgtcacgacatcggtttcaaggcgttgaacgcatgatgtgacgtcatgctgacgccgtgaaacgttttaaggggcttgttccataattggaacaagccccttagcgtattctcagacgcgcgcgaattccacgcggcacgacacgaaggcgtacaaaggtacgtcgagtgtagtgccgtgcggaaggcgcgctgtcctcgttacggcagggtcatgaacgaggtgtttttcagataattcttccccgtggtgatgtcgtattggatgagccggtaatcggccagcagctgtctggtttcggcgtcgaaatcgtcttcggccatgggctcgcccttggagttcagatagatgttctgtccttcggggatgcggtcccagccttggatgttgttcacgaccggcggttccatggcggagatcttggaatgcatttcggtgaggaacgccaggtatggggaaactttggcatccatgtgctcggccgcctgggccacgaagaagttcggcgacgagtattcggcgttgtcgatcttgttgccttgcgtgccggaggctttgttggaccagatgaagtagtccgtctgatgtaacgccagcgagttgccgtcatcagcggaagccgacgagtagatgcccggcagatggtcgccgtagaagaccacggtgaccggcttgtcgagcttgtcgagttcggcaaggaatccggcggtcgccccatccgtcagggacgcgcccttttggtaggtctcgatggattccttctcgtcgtccttcaacggctttcccgtggtggaggaggctttgaagtcgttgtgcttgtaccagtcatggtagggcatgtggttctgcatggtgatgacctgcaggaactggttcgacttggttttcctgacttcctccagcgtgctttggtaggtggcctcgtcggagacgtacggcgaatcgtcgatcttgtcctgatgcgagatgacgtccggcccggtcagcgtgtagaaatgcgagaagccgaacttcttgtagttggtggcgcgcgaatacatggacgactcgtacgggtgcagtccgatggagttcttggacgcgccccacatctggttgatggtcggcgtccaatgctcgctcggcaccagctgctggtatgggctggtcagggaggaatcgaaattcgccatgctcaggccggacagtcccatgtattccagattggcggtgccgccgccgtatccggaggacagcatcaggccggacgtggtattctgcttaatcttgcggatgttcggtatggaatccttgttgactttgagtcccggcacgcgggacgggtcggagaaggattcggacagcacgtagatgacggtgctgtcggtcatgttcgcggaacgtttcgcgttgatcttcttcgcggccttctcatagcgggccgcgacctgcttcatggtctcttcggaatagtcgtccggcttgaccatgactttcgggttgagctgacgggtgaacgccaccagcggcccgttgcgctgggcgtcgtatacggagtcccacatggagggcttgtcccccatgacggtggcgaagcctttggcccacgagccgacggtgctcacctgcatcgaatacagcgtgaagaacaggcctggaagcaggatcagcagcagtcttgcgatcgcgttcacggaacgggatcgcttatcggagccgcgaaacagtttgccgtgacgcgcgtcgaggcggttcaggaagacgaacagcgccacgaacgcggcaaacgccgccaccgcgatcagaatggtccattgcgcgccggacggcatgaaactcatcagattgccggcgtcggccttcagaaagttcaaatcacttggcagaatcgcctcgtatcgtattgaaaccttgaaatgctcaatcacggcgacgatgaacgtgactgccagaaaaaccggcgtggccacccagaaacgattggtgagcatcagcagaatgacatacaggacgccccataggatgaggttcagcaccgccacgaaattggcgctggtgaacatcttgccgacgaatccccaaccggtgagccacatgttgttcgatagttggactcgagtggcggattcgctgacgccgatctgcagggcggcaacgcccaccgcatcgaacagcacgaatagcacgccgtagagccagccggggaactccttgcccgctttcttggccatcgggtccacggtagcgatgtcgagctcctcaatcggctcgtttttcgatgttgctttggtcacgcataaccccacttagttcgtttgcaatgccctattgtcatatatgcgtctgaaaaagacaacgtccaacgttttttctttacgatttttacgattggattgcgccgatggcgatacgattccaacggaaatacggcagacagccgctacttgtccgccttccggcagtcctcgcacaggccgaacacctccagcgtgtgccgttcaatggtgaagccgtacttgtcggagatgcctttcagccagctttcggaaggcgattcaatttccacggttttgccgcagttcgtacagacgaggtgatgatggtgcccgtcatcgccgcacaggcggaacagctgctgcccgtcgagacggaccgtgtcggcgcggccggcttcagccagggcgttgagctgccggtagaccgtggcgagtccgatatgttcgccacggtcttccagcttgcggtgcagctcctgcgcggagatgaattcgtcgcagccgttcagcacgtcgcggatggcgtctttctggcgggtctgccgcacgatatgttcactcattacttatgatgtcaggctttcttcaagtcgtcccagcagccggtggcctcaaggtcggccacggttttggcggtgtcgtcggtcagcacggtgatgtgccccatcttacggtcgtggcgcacttccgccttgcagtagtcgtgcacgttccattcgggatggtcggcgatgagcgcacgggtcggcgccacatgctggccgagcacgttgaccatgacggcgggcttgagcagctgcggctgttcgagcggccagccggcaatgccgcgaatgtgcgcgtcgaactgatcgaacgagcaggcctcgatggtgtagtggccggaattgtgcggacgtggggccagttcgttgacgatgaccttgttgtctttggtgatgaacagttcgatggccagaatgccggcgagttcgaagcctttggccagtcgcaacgccagctcgtgcgcctccttggccacggtttcgtccacttcggccggcgcgatggtcatgtgcaagatgttgttgcgatgctcgttgcgcacgatcgggaaggtcacgtaatccttgccgttgccggcgacgaggatgctcgcttcgaacgcgaaatcgacgaagccttccagaatgcttggcgggaagctgccgtcatggtcggcgcgggcgcgcacctgctccaagtcggcttcggacttgagcacggtctggccgtggccgtcgtaaccgccggaacgggttttgagcacagccggatagtggatctcatcaagtgccgcttcaagttcctcgacgctgttgacggccttccacggcgcggtgggcgtgccatggtcgttgatgaaccgcttctcgttgacacggtcctgcgtgacgcgcagcagatcggtgccttgcggggccgccgcgagggaacgaacttggtcgatggcgtcggcgtccacgttctcaaactcgtaggtgagcacgtcggacttttcagccagttcgcggatggcggcgatgtcgtcgtattcggcggtcacttggaaatccgcgacctgagcggtcggacagtcgggtgtcgggtcgagcacgccgatgcggaagcccatgtagcgcgcggacagcgccatcatgcggccgagctggccgccaccgatgatgccgatggtcgcgccgggcatcagtcgttcgatacggccgttggtttcctcagacaagctgggcattggattcagccaccttttccttcagggagtcacgatagtcctgcagcgccttggccagtcgctcgtcggtggtgctcagaatgctcaccgcgagcaggccggcgttggttgcgccggagttgccgacggcggtggtggccaccggaatgccgcccggcatctgcacgatggacagcagcgaatcccagccggacagcgcgtgggagcgcaccggcacgccgatgaccggcagtgtggtctgcgccgcgaccatgcccggcaggtgggccgcgccgcccgcgccggcgatgatgaccttcagcccgttggcacgggcgttgtgcgcgaactcacccatcagttccggggtgcggtgcgcggaaatcacctgcttcatgtacggcacctcgaactggtcgagcatctcgcatgcgtgcttcatggtctcccaatcgcttgccgatcccatgatcaccgcgacttcaggcttgttgtctgccatcaaaacctccgaaggatttacgtagacttacgtgttccagaacaccgtctactttacttactcggctcgatgtgcagcacgacctttccgaaaacgtcgccgtcgaccactttgcggaacgccgcgggcgcgtcggcaagcgcgtaggtggagtcgatgacggggtgcaggtcggcgtgttccacgaatttgagcagtcgtgcgaaatcgtcacgcgaacccatggtgttgccttgcacgcgaatgtcctggaagaagatgcgggtcagttcggctccaggctggtctcctgtggtggctccgcagatggcgatggtgccgccggggcgtacggatttgacggaatggctccaggtggccgcgccgaccgattcgatgacggcgtcgaccttatgcggcagtcgcgcgccggtttcgaaggcggcgtcggctccgatggcgatcgcgcggtctcgtttctcttcgctgcgtgacgtgacgaacacttccagtcctgccgcatgggcgagttggatggccgctgtggacacgccgccgcccgcgccttggacgagcacggtgtctcccggtttcacgttggccgatgtgaacagcagtgagtaggcggtcagccagctggtgccgagcgcagcagcctcatcgagggtcaggttggcgggtttggcgaacacgttggcgctgggcacctgggtgatctcggccatggtgcccgcgtatttttcggataggatggtgcgccgctcccccggcatgacgccggcgccgtcggtgccgacgaaggtgtagagcaccacttcggctccggctttcagccctttgcgaacaggaatgtcctcgtcgagcacgcctgacgcgtcggtgccgagaatcatcggcgtctgttcggcggagagtcccacgccctgcaggctccagatgtcgtggtggttcacgctggctgcggccacgtggatggtactccagaacggcttggtttcgggcgcgtccagctcccccaccttgagttgcgacagcggattgtcataatcggttcctgctgcgtatacggctttcatggtcagcgctccttcgcggtttttcggtggttcgattcatttcatcgtttccattgtgccgcagttgagaagactttgcaggtatttcacaaccgacaccccggcagaggcatacagtgggataggattttccgcggtaaagaagacaggttcagggaaggacagttgcgcataatgaccgctggcatactgggttcgattcattctccggcggatgtgcatgccctttcttcgcaacagttgcgtgatctgtgtctggagattcgttccacgctgttgaattacggccggaagcatggtggccacatcggttcgaatcttggcgtggtggagcttaccgtggcgttgcaccgcgtgttcggttctccacgtgaccgtttcgttttcgatgtctcccaccagagctacgtgcacaagatgcttaccgggcgcgccgaggcgtatctggacgagtcgcggttcggcgaggtgacgggtttcaccaatccgttggaaagcgagcatgattccttcgtgctgggccataccggcacgtccatctcccttgcctgcggtcttgccaaaacacgtgatatgcaacataccgctgcgggagcaagcgaaatcggcaacgtcatcgccatcatcggcgacggttcgttgagctcggcgatcgctttcgaaggactgaacaacgctgccgaacagggcggtaatctcatcatcgtcgtcaacgacaatgagatgtcgatcgccgaggatttcggtggcatgtacggcaatcttgcccgtctgcgcgcgtcgaacggaaccgcggagctgaatctgttcaaggcgttcggacttgactaccgttatgtggagcagggcaacgatgtggacacgctggtcgcggcgcttgaagacttgaaggatatcgaccatcccgtcgtgctgcatatccacaccaccaagggcttgggtttcagcgatgagaccgaggcgcaggatggttccgacggatgcaaccagaccaatccgcagccgcatgccggccaatgcgaggcgaatcattggcaggatccggacagcgcgctcggcaagccgcttgacgcgcgcaaatactacggtcagatggccatggcttcgttggagtcccgtttcgaaaacgagccgggactggtggtcatctcccccgccacccctggttcgaatggcatcacccgtgatttccgtgaacgtgccggatcgcattatgtggacaccggcattaccgaggagcatgcggccgcgttcgccgcaggcatcgcgaaggctggaggccggccggttctggcgacttccgccacgttcttccagcgtatttacgaccagttgcagcaggagctggcgttaaatcatgttccggcgacgctgctgattttcggagcgggcatttccggcgcggacaatacacattccggcacgttcgatatgacgatgttcgccaacacgcctgatgtgacctgtctggcgccgaccagcggagagcagatgctggacatgcttgcatgggccacggggccgtctgatcatggtgtgacggctatccgcatgcccggcgagcagattcttgccatggagcgttccgccgatatggcgttcgacccggccgaacgtgccgccgcgcacgaaacgacgatcgatattaccggcgattgccctttcacgcggtaccagatcgtgcgtccgggacgtgaagtggcgattctcggcttgggcaatacactgccgttggcggccgaggtggcggcaacgctcgaaaacgacgacgatatcaatgcgacgcttatcgacgcgcagcagtattccgcgatggatggcgagctgctggacgtgcttgccgacggccatcgtgtggtcgtcaccttggaggatggccagctggaaggcggctggggtgagaaggtgaccgcgttctacgcgaattccaccaatccaaaggcggccactgtgcatgcgctcaatttcggcgcatcgaaagaattcaccgatcgtgtgccccttgccgagcttgatgaacgttacgggctgactgtggaagcggtggctgatcgcattcgccgcgtcttggcccgttaatcacgcaactagccggcaccgtcaaaaatcgacagggaacgtcgaacaatcgcgaaatgccggcccacgctgaacagcacatggccgaccataggcattattgtcaatcgcaatcgctattgctcgttcttgatggcgtccaacgcaggaatcttcacagccttattagctggccccaaaccggcgagtatgcccaccagaattgaaaacagcacggccacgacaaacagccaccatggaatcacggagattcggctcacgtcgtcaccgcccataatcgctttgcctacgttttccatactgaatccaccaaacgacagcagattgatgctcagcgaccccaaggcggaaatcagacaggcgataagtccaccgaccagaccgatggcacctgcttcacataggaacatcgtgcgaatatccttcacatagcagccgagcgccttcataatgccgatttcccgagtgcgttccgacacggacataatcatggtgttggcgatgccgatggccgccaccaggaatgacaccgcgccaatgcctcccaatgcgagctggatgccacgactctgcttttcaatctctttgcgggtctgttcgaaggacgtggtttggtagccagacattttgatctgcgcttcgatacccggcacatccttgatattttgagcgtgcaccaccacttggtcgtagtttgttttggtccggctggtggtattggttttgccgtcgattttggcctgcaatgtgtccatatcctccagcgacatgactacaccggagctgaatgcatcgtaattattggttgcagcgtccaacacaccgaccacggtgagaggcatggaaaccacaggattctgcgaactggcaataccatcgccgtcgcctgaatcggtggaactcatcgaagtgctgcctattttgcggtaatcgtcagggctttgataatcggctccggtaatcaaattgagtttcgtggtcagtacgtcgaagaacggcttctccccctcgctctccttgcaaccgttctcatcgcactcataatcaccgggagcgatacgcctggagtcatcatcggaacgatacttatccataaactggtatgccgcgtatttgccgagcaatacttctccggcacgcctcggcatacgcccttgaacgagcttgtatcccgatgcttcaagctgggtcatatccgtacccatcacagaagcatattgagccacgtatcgggatccggctcccgcagtgagatccacggtgctctgcgccgaccgctgtggcatcacggctgcgacgcctgaaatgccacggaacgtctgtaccgcagcatcgtcaagcttggcctgatgatccgatgatgtcatgtccgacgaagacaaactcgacataccgacgccagagctgtcgtacgcgcccgagccgccggcagctgtgacggtaatgtcgttgagattgcccatgctcttgagcatctgctcattctgctcgctgatgccttgtccaatcgaaatcatcaggacgatggagcagcagccgacgatcacgccgagcaccgtcaaaatcgtacgcgatttgcgccgcagcaaattctgcgcgcaagtatgtgcgatatccgaaaatcgcatgcctactccttgacggatggagtggaagatgacgttgcggatacggaggcggccgatgtgccacctgccgtggcgattacctgcgtcggcgcatcggcagccatggcagtagatttaccctgcttatcggctccaagatcggcaggctcccaatcccaatcgtcatcatcggccgcctgctttgccttcttacggcggtgacggaccaccaatacgaccgtcagtacaatcacgacgagtgcaacggccgccgccactatccacacccagaccggcatgctctgatcctggacgtcaacatccgtatcggaatcatccggaacaggagcttcaacggcattgattttcaccggaaattccttggtctgcggctgtccatcggaattctcatacgtcaccgtcagtttcgcttcggtttcgccgggcttgtccgcagtgaatgcgaatccaatggagccggacgcgccggacgccacattgccgacgtactgcttggcctgcgtggcggtgataccgtcgccttcaacgctcgcctcgacattggaaacgtcgcccttgcccttgttcacgtaatccatggtgatagtagtttcctcacccgcgttgacgatattgggcaccactggatcgttcaattcaaaacgatcaggctgcgaaacgggtacggaaattttgatgtcggaagtgttggagctgcgtgcggcaccgtccacatactcgtatttgaagctgatgtcgatgccctgcgcgccgtttttcgcactggccagtgtctgcatcggcacggtctgcgtcaacgcagctcccgcattcagtgcatcgtagtagaacgtgttcgtaccgccggagatggcaaaattctcaccgccgtccacggtgaccaccatgttgctcaccgccactttgcccatgttttggaaggtgaaaccgaggttgaaggtgctgccgaccgccaccgacccgtcgccataggtgaaattggtgataatgatgttcggcaccggcccagcaatctgctcaacactgttgtccgctcccgcacccggagcatcggaagtattggcaccatcttcggcgaacgccgtcggcacaatgcacaccaacgtgatggcgaccaccgccaatagtgagattgccccgttgagcagtgttgcgattcttgtgttgttgcccatggaaggcccttctgttgtcgtcatagttgtcgatatgcgttgtcatgaatgttacgtaagccggtcgccgatgatgcggccgtcaagaagtgtgacgatgcgatcggcgtattgcgccatattgtcgtcatgtgtgacgagcacgatggtctggttgaaatcgcgtgcgaacgagcaaatcatatctatcacttcggttttggttttggaatcgagattgccggtcggctcgtcggcgaataccacttgcggacgtgtcacgaaagcgcgggcgatgccaacgcgctgctgctgaccgccagacatctgggtcggataatggttcatgcgtttgccaaggccgacccgcttgagcatggcacgcgcgatcgtctcgcgtttacgcttcggcacgcctcggaacatcagtggcatggccacattctcgatggcattgagattgggcagcagattgtacgactggaacacgaagccaaggtgcttctgcctgaattcggccagctgccgttcgtcaagcctgctgatgggcacacctgtgatacgtacaccacctttagttggtttttccatgccggcaagctgattgagcagggtggatttaccggatccggactcgccatagatacagcagatctgcccttgcggaatggcgagattgacacgttccagtgctacgacggtctcatcgagcactggatattccttgcgtaggtttttaacctcgataatgggaccgcgaccggttttcccagcgttggatgtgctacctaccggcacattcacctcctcgttttctgggaatatgttgataattgctcctaagtctaaagtgtttcaccgcgcttcgccacccttaagggaacaccctgaagccacggtccgcgcgtgcctgaaactcgaaaaccgttcaagaaaccccgcctgaacgatatggaacatgttgtttcatgccagaaacccttgttttgtgccaaatggcagtgaaccgtgaaacgacgaaaatacaatgaaggcatcgcaacgaatcgaaaacgaagctgaacggttccataccatgagggggacatcatgaaacgtcgtttcacacaagcggaggtctactacctcaacaccctgcccgcggtggagcgggcatcgatggaccgcatcacctattcgagggatttccaggtgcgttgcatggcgcaatatctgcggggcaacggaccgaccagcatcttcgccagcgcgggactcaatccgaagatcgtgggcagcaagcgcatcgaacgcgccatcgcacggtggaaggccgatccgcagatcatgctggaggcgcagtcgttcgccaatgaagccgcggccgatcaacgcgacctgctcgtcatctcccaatccatgaccatcgcatggttggaaaagaaagtcatggatctgcagaaacagatccaatccgtgaagcagcatgaggcggaacgcccgtccatgccggcccacggggcgctcatcggactggaatagcgtccagaagcgttcccatgacaagatgtgcgtcgtggtacggcgacgcacccatacgcgatccctccttccatcgtttccgcattctccgtcacattcacgcggctccccgatggaaggagggattcgtttcgtctttggccgcataccccgcgattggcgcatgcggccaaagacgccattcgatcaatattcgtcagatacgcggcaccgatggggcggccgtatgggacggcttcggcgtgtacgcgctccgttccgcggtttcgttggctgtcaccatcgcctgcgtgatctggctgtacatatcctgatatccgccaggggtggatgcgggcagcacgacggtcttggagttgttggattcgctcaaggagcgcagcacgtcgaggtactggttaaacagcaccacattgttcacatcgccgatgttcatgccgacagcctgcaagctcttgatctggtcgacgataccgttggcgatctcgcgacggtagttggcctggccttcaccctgaagacgggtcttctccgcctcggcggcggcctgggtctcaatctggatgcgctgggcctcggcgcgctgccgggtggcctccttctcacgctgggctgcgttgatggaatccatggcgttcttgacctgcgggctcgggtcaatggcggtgatcagggtcttgaccacggtgaagccgaagcgggacatctcgttgccgacggtcttctgcacgtcgaaggccacgtcgtccttacgggcgaaagcatcatcgaggctcaacgcaggaatggcggaacgcagggcgtcttccatgtaggagcgcagctgcccggccgggtcgcgcagctcgtagtaggcggtggccacgttttccgggttcacacggaactgggtggaggcgacgaccgtgacgaacacattgtcgagggttttggtctccagctgcacattgagctggttgacgcgcatgttggttttcatggcgatacggtccacgaacgggatacggatgtggatgcccgcgaactggaccttgttgaacttgccgaaacgttcgatgatgtatgcctgctgctgcggcacgatgaacaacgtggacaggaacaggaacgcgatgatcagcgcaatgacaaggagcgctacaaggaacggcatggcattactcccttctttggtttctctttaaaggtcttgtcgcatgacctttcgtaggttctgcaaccattgccgaacccgagtaaaaatttaccaaagaatgcaatcgtatgcagacaatgtccgcgagctgggcaagggccgtccacgaaccaaccatcgcctgtccaggagctgacccacatacgcccacgagccggacagaggggcgctttcccctgtccggttcgtgagatagcgtgccagttaatattcaaatccctaccgatagcaaaactttcaggcatatacgtgttgcgcgaaggtgaacagactctcgccggcgtgacgcttgagatagttctcgtacgcgatgtcgaaggcttggccgagatcctcaatgagatcctgcttgtcttcgatgccgactgcgagacgcaccagttcgtcggtgatgccgaccttcagacgctcctcgcgcggcagttcgaaatgcgtcatgcggcacggcagttcggcaagcgattccaccgcgcccagagacaccgccaaacggaagatatacaggttgtcgagcacgtccgcagggtcgacgcccggcaccacttcgaagctcagtacggcaccaccgcccttgagaccgttggaggccagctcgtattcgtgaccgggcagtcccggataatgcacggacttgaccaacgggtgcagcagcagatagctggaaatcgcacgcgcgttctcctgctgacggtccatgcgcaaggcaagcgtctggatgccgcgacgcaccgaatcgcattcgttcggcgcgagcacgccacccaaacggttctgcgcgaagtagacgcgcttgcccagctcatcgtccttgaccaccacgaggccggcgttgacttcggaatggccggccagatacttggtggcggaatggatgacgatgtcggcgccttggtcgagcggctgctgcagatacggggtgacgaatgtgttgtcgacgatggcgatcgcgccatgacggtgggcgatttcggcaatggccgtcacgttgttgacttgcagaagcgggttggtgagcacttcgaagtacacggccttggccggacatccatgcgcattgcccttggcggattcgccggacaccgccgcatcgagcgcctcgtaatcggtggtgtccacttcctctacgatgacgccccaacgttcgaaatactcgtggaacagcgagtaggtgccgccgtagatgttcttgccgacgataatacggtcgcctggtcggaagatcgacagcaccgcgtggatggcggccaggccggaaccgaacgcgaaaccgcgcgtgccatgctccagctgcgcgatctgcttctccaggaactcgcgcgtcggattgccgctgcgcgcgtaatcccagcggggcatggtcccgaccgattcgaaagcataggtggacgagttgtagatcggcgggttcacggctccggtgttgttgtcgttgaccggcagtccgtggacgagctgagtgttgaatctggtcatggtgcgcaccccctcggtgtggtttccttgccgcgtgccgttcacgcgatcgctggttcctacttaaccgtgtcttggaaagcgccacgcgccggagattatcgacgttgcttatacaacgtgcgaatcgccatagcgtttatttatgaggggttatcggatggtacgaaacctccggaaacatacacccgcgtggactgtaaacggtttcgaaggatgtgacataaccggcccggaatcggcatgaaaaagccttccgcggcgtgtgccacggaaggcttggaaacaggattgacggacggcaggccgccgtcaggtcaggtaagaatcaaagctggccgccttcgaccacaatgtcatccgggttgacgtcggagccgtacaccggcttcaaagtctcctcgtaatccttgtggaagaagttctccttgccgagcttcacgatctcgtcgttgatccagttgagcagctccttgttgcccttctgcacggccggcgcgatgatgtcttcgtcaccgagcttggtgatgcccaccttgaagcccttgttggtcttggcccaggccagcacctcggtgttgtcggtggagaaggcgtcgccacggccgtcgagcagcgcgttgtaggcgtcggcgtactggtcgtacttctgcagcttgacgtcgggttcgttcttctcgaaatagctttcggcggtggtgcccttggcgatgatcagcgtcttgcccttgagctggctcacgtcggtgatttcggcgttctccggggagaccacgccgagcgcgaccttcatgtacggcttggcgaagtcgaccttctccttgcgctcgtcggtgacggtgaagttggccagcgtgatgtccaccttgttggacgtgagcacatccacacgggcggccggatcgacggacgtgtacttgaccttcacgcccagatccttggcgagacgctcggcgaagacgatgtcgtagccggcgttcttgccgtccttgtcgatgtagccgaacggggccttgtcggagaagacggccactttgagcacgccggacttcttgatctcgtccagggagcgggcggtcaccttggacgtggtgacgccgccgttggaggcgttgttctcctcgctcggggtggcggcgttgggaccgcaggcagccacggaggcggccatgatcaacgcggccgatgcggccacgatgctcttgattgtcttgttgatgattgatgcggtcatggttactcctctcttgtacggatgactgctatcaaaacttgcgattactcggcggaagttcccgtcggttccgccggcttgcgatgcctgtcgaattcgaacgtgtgcaagaaacgcttggcacgctcggttttcggattggtgaagaacgcttcggcgtcgtcggattgttccacgatgccgccgtcctccagcatgatcacctggtcggcgatggctcgtgcgaattgcatttcgtgcgtcacgatgagcatggtctggccggaatcggcgagttccagcatcacgtcaagcacctcgcgcaccatttccggatcaagcgcggcggtgacctcgtcgaacagcagcacttccggatgcaggatcagcgcacggcagatggccacgcgctggcgttggcctccggacagctcatgcggccaggcatccttgcggtcggcgagtccgacgcgttccagcagagcgatggcttccttctcgacctccgccttgtcgcgcttctgcacgagcgtcggagcgagcgtgatgttgccgagcacggttttgttggggaacaggtcgtagctttggaacaccatgccgacacgcgtgcgcagctcgctgccgcgcttgctgcggccggccgattcggtgcccggcttgccggtttcgataatctcgccgttcagcgcgatggtgccgccctgaatcggctcaagacctgcgatggtgcgcagcaacgtcgacttgcccgatccggacgggccgacgatgacgaacaccttgccgtggggcacgtcgaaggagatgtcgtccagcactggcttgtcggcattggcgtaccgcttgaccagatgcctgatttcaaggcttgtctgcgatttcccgctgttttgcgcggtctgcgtaacctgttcagcctgctcagtcatgcttccacctcttttccaacctgcgggccacgatggacagcggccagcacacgatgaagtacatgaagaaaatcgttccgtaaatccacaaagtgcccgtcggatactggaaacggttcgcgtcgatgatctgctggcccaccttgatgacttccaccacgccgagcagcacggccaatgacgtggtcttcacgatacgcgtggcgaggttcacggaagccggcagcagccggcgcaacgcctgcggcagaatcactttcgtgaacgtctgccagccgctcaatcccaaaacgtacgacgactcgtactgcgccttcggaatcgattcgagcgcaccacgcaccagatcgcccagttcagcgccgccccacaaaacgaagacgaacacgcatgcgccggtcgcatccaaattccaattccacgcctgcgcgaaaccgtagaaggcgatgaacagcagcgccagctgtggcatgatgcggatgaaatccagataaatcctggtcatcacccgcacaacgggatttttcatcgtcatcagccagccgacgatcaggccgactggcacggacaacgccacggacacgccggcgatccacaccgtgacccacaggccctgtagcaggcgcggaatcacgcccggctcgagcagaatctcagcgccgctcatagtcgaacctccgttccagccaagtaccgaacagcgagatcggcagcagaatcaccagatacgccacaatcagcaggaacagcgactcataggtgtcgtagtacatgccgatcaggtccttggccatgtacatcacgtcggcgagcgcgatggcggacaccacggacgattccttgatgaggaagatcacattggccacgacgcctggaatggaggtgctgatggcctgtggaatgaccacgcggcttaatgtctgccatttgctcaagcccagcacgtatgcggattcgcgctgcacttccggaatggtctccaggccgccgcgcatcgcttcggccatataggagccgccgaggaagccgagtccgacgatggcgcacagttccgcggaccagacgagtccgagtttcggcaggccaaaatacaggaagtacagctgcaccagcaacggcgtgttacggctcagctcgatgtagacgcgcacgacctgccgcaggacggggatgcgcgcgatctcgatgccggcgcagaccaagccgaccacgatcgccaggatgatgccgaagacggaaatgaacagcgtcatttcggcaccgctgacgaagaacggcgcgtagtgcgagatgaacgtccagtcgaacacgcgcgcctccttctcttctcaacggatttttcgtatttgttccggcgaacgcggctcatactatcgctttattcgccactacgagccagtttcgttatcggtttttcgtataaggacttatcaggtatcgcaaaacagtcgtcctgcgatccctccaaggttcttctacagtatggcatgttggcggattgcgccgtcggcgcatatcgaaatgtgaagattgggtatgccttgcgagagagtatgcacatgctcattcgacatgcaacgatggaggatctggacgcgatcgaggctgtggaggccgcctgcttcccacctgcggaggccgcaagcaacgaaagccttaccgcacgcgtggccgcttatccggaccatttctggctgttggtcaacaccgatgacgacgataccccgttcccctcgcgtgtagaggatggcacgttggttggtttcgtcgatggcatggccacaaacgagccgaatcttgccgatgccatgtatgacgacgccgatatgcatgacgagcatggcgattggcagatgattttcggcgtggatgtggcacccgtctaccagcatcgcggctgcgccagctatctgctgcgccaggtgattctcgacgcggcacaggccggacgcaagggcctcgtgctcacctgcaaggaacggctggtcgatttttacgcacggctgggattcgtggacgaaggactgtccgagtcgacgcatggcaacgtggtctggcatcagatgaggctcgcgctgacgcacgccgtcggcacgggaaaccctactgcgaacggctccgccaagaccgcggagcgtaccaatgatgcggatacgaccgccatgagcggcgtggaccacgacgcggaaaccttggagtttccgcaggtcgaacccaccgcgtgaagaacggccggcgaacttcacgtgaacatcgcgacacgccgacgatttgcattccgccgagaatccacgtaagttagcactcgcttcgggcggttggcgcagaggtagcgcacttccctgacacggaaggggtcacaagttcgaatcttgtatcgcccacgcggcgatggtactgcactcgagagggtgtgggagagtagcacgccgccgcttcacatgttgggcctcccggtcgagcctttggctcccgggaggccccttttttcatgctctttttccgggcttcccggcgggcgtcgctccaggaacccttttttcgtatcttttcccatgcttaccgaatcccgttgcctattggattccatcggcggcaatatagcatctacagtgtgcgaaataagaagtatccgtagtaaaggcagccgatcgctcatacctgttgcacaaccttgacacgtatgcccaactctgcaaaccagcagtgcgacacgccgatttggctttttgctgctcctgttgtattctagtcaagttgcgtttcacggatagacaccgggaagcgttgaataattggagaattcgcctagtggtctatggcgcacgcttggaaagcgtgttggtgtaacagcctcacgagttcgaatctcgtattctccgcccggattggaaccccgaaaaccgttggaatcattcggtttctggggttccttcttttccactccgttttccggttccttccagattccctccgaatgcttctttcgttggcctcggtttttgaatcgtcccgtatcgcaagtctcgcgtgtacgggccggcatccaggaaagtccctgattgccatgctgcggcttattggtgccagtctgtggtctcaataatgggattgtttgccctcatatgtcgatatttgattgcgattcggtgggggagttgcgtacatcgtcgttttacgcgcacttttgcgctgcgctacgttacgctcgaaatcgtgacgttgagagaaagaagcacgacgatggttgacaagacggctgccggcagccagcagactgaccaacgcgatgctgatactcgtgactctctggcggcgcttgcccgacgccgttcgaattcatcgccaatcgtattgcagagtgatgtgcaggccgctccgcaggaaaagcaggaaaaacaagaaaagcagagcgaagctgggtctgccttgcaaacgggcgaggatgcgaatgatgacgtgaatcgtgcggaagaatcgcaaaccgtgaaagaaaaagacgctgtggatggtcctgataatacgcagcagccgcagatggcatccataagcgccatcacaacgcaggttttgccaccaagctttattccgaccgcaaccggtcgtattcgtcctgtaacgggcgcttttcccgcaattcagtccgcttcgcagacggaacaggcgcagcgcaggcgatccatccgatcgttggccgcggggtcgttgcgtagaaccaacatcggcaatgctgaaaaggccggcgatgcggggagcgcgggtagtaccggacggacggcggggaatggcgatacgccgtcgccgcgaatcgccagcagtgctccccattatgcgaattgaccagtggactgatcggaacggccaacgtaacaaatcagtgggaatactggacatacacgcggttcacgcacggtacgcgcgcttcgcgctgcattgtacgtcgctgtactacgtcattccaattgaatcgcaacaatgcgtatagcagatgaaaagcacatatgaaaaacgcgcatgaaaaaacggtcccgatatattcgagaccgtttttcatgagtcgatgaagcaaacgctgtccggcagcgaaccggctcagtcttcgctggtttcgcgcttatactgcacgaacgtcttcatggcgtaggcaaggccggcaagcagcagaatggctgcgcaggcaagggaaatgccgatgccggtctgcgcaagctgcccatattccgacttggtcagcgcgccggtggacgcggcggtttgatcgccggacgctgcgacgaatccagttgcggcaccattcgtgccagtgtcggcagccgtgcgcacagtgccagtggtgccgttggctccagtagcggtcgtaccggcattcgttccagccgtgatgccatgcgtgccggtagcaacggatgagccgccctgctgacccgtcttggagttcgcgtccttcaacgccgcgatgaacgactgatgccactggtggctgctcgccgcaaacgcgtcatgcctcgtcttgagttcgtcgtgagtctctttcatgtcggcatgcatctggttcagatgggtctgcgtatcctgcatatcctgatgcagagtgtcgtgacgctcctgaccgcgcttgaccgcgccgtcaatcgcattctttatatcctcgcggtcctcctggtagttcttccaggcctgctcgccgtactggcgaagcgcgtcggcgtcctcgtgcgcgttctgatgcagctgctcggcgtgctgcctggcggtatcgatgtccgacttgatctgctggttggttttgcgcacatgctgtacggcatcgcacgttttgtcggtgcacacggccatatcctggtcgatctgcccgctgatggtggtgctgccggccaatccgtccgtagacggtgcgacttcactggccgaagccgcggaaggcaaggcggccatgtcgatggttaatattcccgccgctgcagctgctgcaatacgattcctcatggtggttcctctcctgcgcacgtttgcattcgatctgtgattgtgcgctcgcgttcattccgtatgccatagtaggaggggaatgtgcctaaataaaccggtggaaaaatgacatttgtctagtttctgcgatgctgcagcagtcttcatagtttaagcgggaaaccagaatccaaaccagaagccggaacagcctgctcaagacatggccaagcaggccaagtaacggcttagaccgcccgtacttatcccgcccgtattggtttatctagcggcggcccccaacaaagatcactcgacaatagtgatgaatgggctagccggcagattaaagccgttgtacagcatgctcgcgcacttcggattgccactgaacaggtaacgtacctggctcatggcgttgagatcgttcagtattgaaccatcggctgcggtgagcaacacctgattgcccctgatagtggcattgaccgcctgccattgaccggaataattggcgacctcaaacccctgcaatgccgtagtggtgggagcggcgatattgctgataccgcttaacggggtcgctttcggagcgctcttatagtttggtgcgattgcgctcgcggttttcgaatagttcggctgcatggctttcagcctgcttgcggtgccgttccggaaagacaaggcgattgcgccgttcgcagtgtgccgggcatgttcgataagcggtccgttgggtacggtggtgccgtcttccatggcgagatattgcgcggccatgcgcgccccgagaatatctttgccgagcggatggattagcgcggatgtgcccttgtctgtgtcaagggaaaccgtcatcgccacgtttgacgaatcgtgcaggttggtgttgccaagcgtggtccgctgcgcttcacgtacgttctgtgtgtactgatagttcgtccatcgcgcgagttgcacgtataggaacggcagattcttgcgtccgaatacggtacggtactggttgatcagcgcggtcatctgcgactcatactccgtggcggtcgcaaaattcatcgcatcgtcgcatccttggtaccagagcacacctgccacatgaaaatctttcaacggtgcaatatggttcgcgtagatatctccgccgcgcacatgtctgcgtataggcgtgccgccccacgcggtctggatgatgccgaccggcacgttaggatgcttcgcgcgcagctgaagtgcgaactgctgtgtcaagtagctcaaatgcagtgagttcgtggaatccgcattcagccacgcgccagcgttcaggttgacgttggccagcggaaaatccgtgttcttcacatcatgatctgcgataacgaatttcacgttcttgtcgacgagtggttttggaagatcggtctctttgatgattccgttgccaaaattggcgctgttctccgggtaatactgcgtatagttgagttccatgttcgattggccggccgccacgaacacgtcgcccacatacactttcgccagttccgttacgactttgccgtcgtacttcacctgtaacgaatacgactcgaggcttgctttctgtgcgttcagcgtgcaagtaaacgaaccattttttgcgattttcgcagtggcgctcgcagtcatcttgccttgggcaagtgttgcggatagtttcgatgcgtcaatctgtttgctggcatgcgcgaatttgacggttcctttgaccactaacggctgattgcgctggaagaccatattttccatgtagtaggaaggcaaagtcacggaaacctgcgaatttgaggactgtgcggtttcttcgttttggtgcaatgctgaaccgttgccccatttggggccgcacccgacgatgatggcaacgactattcctacggttacgataacggcaagtgccgttcttgccaatcgtttcgtattcaattctgatttgcctcgttctttgtcaacgcccgctcgaaggttctggcctgtttgtcatatgcggctcgttcggtgttggctttgctggtggttccggacgggtcggctttgcagtcaagcgccttcggcgatttgacttcttcctgatacaaggtgctgagcttttccagatcatatgaggaatccatgctggaaaatgcgtcgacaatctttcccttgagctggaaatccttggaatatgaagcgttcatggcggcaaccgcgtctctgcagtcgttaatggcattcagttcgcgcattttctgcgatgttctcacgcccatgacgccgaagaccacaatgcataccgcaacgacgataacggctacgatgatggaacggcgaatcaagttcttgacatggttatgtacccaagtgtcgccatcttgcacgccttgcgatatggcgatttggaatggatcttcgggagccgttcggtaggaagtccccggtgcttttgttctaagcttttcgtcacgattggtggcattgacggaattgttggatttgctggtcccgacggtcgcggtactgctgaacgttcggggcttgcggacgttacttgcttgactgtcagctttatttggctgcctttcgtgccgtgccatgcttccctccaggagtccgcgataccgttttgatgttgtctattggaggtggtccgacaaggtcctctgttcccaaatgacaatacataaggtatgttacccgttccacttccgaatgccagcacttcatgttgtggcatattcggtaaatgtgaagtttggtctggaatccagctgctttattttaagtggggacatctcagaatacacttaagttttgcgtgtgcaattgcgtcaacgcgtgaaatgcgttttgtgagagaggctgacgatgatatcgccgaaaagcttgatgaagattgcgaccaccgcttccgtggttgcaatgacggtttccgttgccgtggtgccggcttacgccatgcaggatattgcgattgaggatgcgccaagttcttttgccgcaactgtggatgatgcgcagaattcgtcaaacagcatgccggacaatccgaacgcgacgctgccggaaacggtaagcgaaaacatttcggacgattccactgtggtttcggagaaccttgcggttacgccggaaggtgatgtacagaacattgagaccggcgaaaccgtgacggacgctcagctggtcggcacgcaatcgcagcaacctgatccactggccaaaacggatggcgaatcattcattccggtgagtgcctcggatgtgaaagatgctgtggaacaacctgtgaaacagtctgcggagcagtcgtccttgaagggtggctcgactgtccggctcactaaattcgagagcaacgaatacggagcacactggggaacctacaacggaacaaaggcgtttttcgattataggaacaacctgttcgttcaacaggccaagggcgtgattgatgtttcctcatggcagggtgacgtcgattgggccaaggcgaaagccgacggcgtggaaggcgcaatcattcgtttgggctatggctggggcaactatgccgatgccaaagcgcaacgtaacatcaacgaatgcaaacgtcttggtattccttttggcatctactggtattcgtatgcatacgatgcgaactgcgcacgtgcggaaggcaatgatgtggctgccaaactccgccagatgggcgtgagcccgaacgatctgaaataccctgtgtattatgacctggagaagtggacgtgggctggtcataccccgccgaccaatccgaatgtttatagcggtatggccgacgcctggtatggcgcactgcagtccgccggatacaagaatctcggtgtgtattcgtatacgagctacctgcaaggcccgttgaacaattcgaacatctacgcaaagacccgttgggtggcccagtatggtgctcaaatgggatacaacgccttcggtgccaacgaccgcggctggcaatacaccagttccggccatatcaacggtatcagtggttccgtggacatgaatgcttttggcagcaagaattatgcccaggactcgtccgtcattgatgtgcgcaagatgcctgtggtgagtgttcctgatggtaattatttcatcaatgtacgtttcaaggtggcttctagcgtggatatttcaggcgccagcacgtctgattccacgactattcagctctactccggcaatgggtccaaagcgcaacaatttaaattctctaaacaatcagatggcagctatgtgattaccaatgtgaattccgataaagccttggatgttcgaggagcggcagcgggtaataattctgtggtgcaacagtatgcaattaatggaacgaatgcacagcggtggttcattcgtgattccggtgcgggatattatctgcagtcggctttgggtaattgggtgcttgatttgagcggtggcaacacctctaacggtactgcgattcgtctttatgcgccaaacggtactcaggctcaacgattcgttgtttcctctagcgaagttagtgtaccggtaaatgctgcggtgaacatcaaatccgcagggaaatccaatcttgtatttgatgtgccaggagcttctaccgcaaacagcgctagaattcagctgtatgcggctaatggaacgaacgcacagaaattccatttccagcagattggcaatggaacctacaacattgtcaatgtgaattccggcaaggtactggatgtttatggcgcttctgcgtccaatggtgcggttctacagcaatatgacagtaacggtacggttgctcaacaatggactgttcgcaactatggcgatgggaaaatctcattgatgtcagtgaacgcgaataaagctattgatgtaccgggcgcgaattattcgtccaacgtcgcattgcagctgtattcgccaaatgataccgctgcgcagcaatggatcatcgagaagtctaaaaccatgcgcgaccgtttgaatgagcaggcggcaaagcataggcaggatttgcctgatggcacatattctttcggttcaaagctaaagacgaacatgaagatggacgtatatggtgcgtcccgttcggactgcgccaatgtgcaactttggactgggaatggcacgaatgctcaaagatggagagtatcgcacgatgacaacggttatgtgacactaaccagtgcgaattcagacaaagctctggacgtttatggtgcgagcactgccaacggtgccaacgcgcagcaatatgcctcgaacggcacatacgcccagaagtggatcgccatcaaaaactccgatggctcatacacgttccagtcggcgctcgcggaaaacaaagtccttgatgtttcgggtgcttctacctcgaatggtgccaatgtgcagctgtataccgcaaatggcacgaatgcccaaaagtgggtgaaatagcagacagattaaccaataaaatatggctgaggacaagtatctttttgctctcagccatatttggaatctgtgctatttctggcgccgcatcatggcgaattgattggcgtcaataatgaatgctttgcggtcgttcttggccatgacatcgaggatgatgccggtgatgaacaatagcagtccggcaatgacgagcatgaccgcgccgataagcgtggggaatcgcgccaccacgccagtgtgccagaagtccacggtcacgctgccgcacagcacgatgccgatgataccgaggatgacgccaagtccgccgaagaacggcagtggcttgtattcgcgaatcatgcggaagatggtgctcatcaccttgatgccgtcgcccacggtgtcaagcttgctgacggaaccttccggacggtcgcggtactgaatcggcatctcgaacagacgtagattgttgtttaacgagtgaatggtcatctcggtttctacttcgaagccgcgtgacaataccggataggttttgacgaacgtgaacgagaaggcgcggtagccggtcatgatatcggtgacgttcgcgtggaacaagccattgatggaatcacgcacgagacggttgccgaagttgtggaacggacgcttgttctcttggaagtaggtggagctcagtcgatcgccgatcaccatgtcgtagccttcgagaaccttatccaccatggcgggggctgcgtccgcgggataggtgtcgtcaccatccgccatgacgtacacgtcggcgtcaatgtcttcgaacatggcgcgaatcacgttgcctttgccttggcgcggttccttgcggacgattgcgccctcgctggccgcgatttccgccgtgcggtcggtggagttgttgctatacacgtaaatgtcggcgctcggcaatgctgtcttgaaatcacgcactaccttgccgatggtgacttcctcgttatagcaaggcagcagtacggcaacggaggggcttgtattcttctcgagcatgtagaacactatagcctttgctgtggtcggagcgaggcgtcctgcggattcaattatgattgctgtcttcttggcaaaggttatgagagaatggcgtgagacgtgatataagctaggatgataaattgcgcggatacgacaggggcgttctgtgaagaacaagatctttgcgttcgaattcgttggtttgtgtctggtgaatgagtttaataaggagtaagtgtggattgtaaaaggcaagtcagattaaagttttttattccgttagcggtggtttttctccttgaaacttttcttttcaatttcgctttttgggaggctctgacatttcctgagcagcagcagatttcggtatcctctctgaacaatattgtaagagagggaaatgagtatagggttactggttccgacactccgtacattgagtatgctgtagatgggcctacagagatagacaatttggatattgatctggtcgctagtgattccgatgccgtagttggcgggacgtatagtttgagtccatatgtgcttgacgaaggtaatactaacgggtatatatctcttggcacggcacatgtttccgagaacttaactgaatcgcattatatccggattcatcctgcgggaaaagttacgggtcttagactaaagctgaatatgcaagaaggcgacaagattgttattgactctgtttccataaatgctcagagacctttttcgttctcttttttgaggttcctcataatgctgcttgtctcctatttggtgttctgcttttggacatctcgtgacatgtatcagtggaatctagatttgaaagtacggcggcagaaaattcttttatccatctttgtcttcatacaaatcatggttttacttgctgtgacacagcttattcatcccgctcagtattttgattcaactcgtgaattaaacggcggagcttttataggcgatgagaatcagtataattacttagctaatgccatcataaatggccatacttatttggatctccctgttccggaatggatgcagaagatgacaaatccttatgatgcatctgcgagagcgcaattatctttcaaaaccggcgagcctacgtactgggattatgctttttataatggaaaatattattgctattttggagcattgcctgcattgtcgctcttcgtcccctttaaactcataactggacatgatttgaggactgattatgctgtcgctttgatgacagtatttttagtgcttgcggcggtattctttttgtactcattcatgaaaaaatacatcaagccatccttcgggctattcctagtgtccttgctcttgctcgtgactggaagcggtgtcctgacacaagcgttttatccgatgatctattctttaccaatccttttttctttggttttaactttaacaggacttggcttatggattaatgcaagaaaagatactggtgagctgtctaagctacatcttttgattggtgcgatttgtatagcattaaatcttggatgtagacctcaatttgttctggtggtcttcgtcgcttttccgatattctggtctgaaatcagagagaggtttttcttctctgtgagaggtatttggaacacgcttgccgttatagtgccttttcttcttgtgggtggggtaactatggcgtataattatgtccggtttgattctttctttgattttggcgctacgtataatctaactggttttgatatggttcatcgatcctatgccttgtcgaggattccatggggattgtggatgtatctttttcagccaattaacataagcccaaattatccatttatgaaacagttagatgtgccgtctggcttcatggggcaaaccattatggaacctaactttggtggtttttttgcctttgttccggcagccttgtttgcatttttgctttgcacagtaagaaaagaggctaaagcaagtggtatttggggaattaacctctttttcgttggctttgctgctgttcttttggtggttgatactgagattgtcggtatctcgacaagatattacagtgaattcggctggttgttgataattggtgcgatatccacagtgactctttatgcaaagaaatattcgagcgaaaggatttcgaatctctgcctcaacgtatttgtcctactgacgttagtgggtgtattcctgagctatctgaatctcctatcagatgggagatatggatgtttaagcagctccaatgatgctctatatcgtgtgattgaatcttggttcagttttctaagctgatttttaggagagatttttaggagaggtgagcaaccacctctcctaaaaatcattttataaagtatgagagtatcttgtccgtgaggggatggacgaatagagtatctattatttttgcaatgcagctcagaactaagaacgcgatgatgacgatgaagaatgctgagacaattctgagtagcaaactgtcgggcgcatagcaaaatttagacacatattcccacaagatcctgaatccgaagatgttctcatgaagaagatagattccaaacgtcgtggaagaaattcctactatcgttttactgataagttttgggattttgtcgaaattaatgcgtgagatgatgatgaagacgaatgctcctatcgctactgggaatagtactattccgttgtgaatttggtttgtccagccgagtgcactgctaatgggtgatgatgacgatgcgaaataattaaatagcagcattaacagtgtcatgaagacgatgcctgcaagcatgggggctgtgcgcattcgcttcgaaatctctgtattgttctttttgataaaagcgccaatcagataaccgaaaatggcatatgtcaaattgttccagttggaaactcgtccaaagatgaggatctggatgcttaaaaaagaaaaaagaacgagcagacttagattagcgcgcttggaaagtgattgacataaggaattgatgaacggcgcacatagaagcatgagtatgtatgcgctgatgaaccagtagctcccatagaagaatgggaaaaagctagcggctatagttcggaatagctcgctcccttgcattagcggttgtatgactgtcgggtatttatagaataccccaatgattaaaagtgttataaaaaacccgcttgagtaacaaaacatctgaaaccatgttttgaaaatacgtcttcttttaaaagtcttatctactaggaaatagccggagattataaagaagatagatacgccaacttgtccatattgcacaatcaagaacttgagagcgttcgtccatcctggttcctggatgagcattaaatcataatgatgtgtattccagttgaaatgaatgatgaaatggcatgcgacaatcagcagcatggcgattatccgaagaagctcaattgatacatttctcttattggatgatgtgttcactttttatcaggtcctgtgtcttgtgtggtgtatttatcgtagcaagacaagcggatggttgattgtgtgctgaggattttgcgaagaaaacggtaggggcattatcttggggtcgtaagtcgatagacttgtcagtcgtgaatacatttgtgaagaggattcaagagcgctaccactattcgctggtagtgttgaaagagcttgtcaagacggattttaagctccgctatcaggggtcgtttcttggagttgcatggtccgttctgcgtccattgatgcttttttgcgtgatgtacgtagtgtttgcgaagttcttacgcatgtcggacggaacaccgacgtatccagttgttctgctacttggaattagtacgtggcagtttttcggagaagccacagcaactggtttgagagcggttgtggatcgtggtgacttgcttcggaagatacatttcccgaactatatcgtggttgtctctgccactattggtgcattgatcagtttgggtatcaatcttttagtggttgtgatttttgccatcttctccaagattcagttcacttggagagttttgctattgcccttaaatttcattgaattgtatgtgttggcactgggcgcagctctattgatggcaacgatgtatgtctatttccgcgatatcgctcacctatgggaagttctgcagcaggtactgttctattcgattccggttatttatccgctttccatggtgatggataacgattctttgggcaaatggggcttgattattgcgaaaatacagctcctcaatccgattgcgcagacgattcaagatattcggcacaatctgattgccccagaaacgcagcctaccgtgtggacgcttgtagggaatcctttgattgcggtcattcctgttattctcgcgttcctgttgcttgcgctgggcgtgcatgtgttccggaagcataatcgtaaattcgcggaggtcatgtgatgcttgatacacagtctcaatctgcttccatcaaggaagtgaatcgtccggttgtcctttcagttgagcatgttggcaaatacttcaaacttccaacagagcaagcgagcggtttgaagcaggctttcattaactggaccagaggcatcaaaggttacaaagaacagcatgtgcttcgagacatcaattttgaagtccaccaaggtgacttctttggaattgtaggccgtaacggcagcggcaagtcaacgttgttgaaactgatttccggcatatatgttccagattccggaagtattgaggtaaaaggtaagctcgttcctttcatcgagcttggggtcggctttaatcctgagttgaccggtcgagagaatgttttcctcaacggagctttgcttggttttacccgtgaagaaatcgaggacatgtacgacgacatcgtcgagtttgctgagcttgaagaattcatggatcagaagctgaagaactattcatctggtatgcaagttcgtttagcgttttctgtggctatccaagctaagggcgacattctggttctggatgaggttcttgctgtcggtgatgaagcattccagcgtaagtgcgataactatttcgcgaaggtgaaaaaagatccgacaaagaccgttattttagtgacgcatgatatgggcgcagtgaaaaaatactgcaataaggcggttcttattaaagatggcgaagtcatcgttaacggaaacaaagatgatgttgctaaccgctataccttggaaaatatgcgtgctgataaacgtgacacggataatgacaaagcggatgaatatccaacaggtttgaacgccagagtcccaatgttgcggattaatgcgcttagtaagcagattctgacgtgcgatgatacgttccagtttgaagtggaataccagtatgacgagccaaattcgtattatcttgcaattgctatgcacgacataaggcgtggcggagtcacttacgatactggagccaatgtgattaagctgaatcagcatggtcattgtaaggtgaagtttgaagtgccattgaaactatttaataatggggaattcaagcttgtcgtgtcgctacgtacccagaatgcagagaatccaaaccttaccgacatggttgcattcacgaatgatgacaactgctgtatctttgcggttcgtgatgagcgtactcgtgattatgcattactaaatgataatgcgttgcagatcaaacaaattagatgagttgataggggcgtgatcgaatgtatgtttgatcacgcccctatttttattggttctttgaagtagaggcgttcttctcccctttcgagtatgttgcttaacagcatacttctttggaatctgaggcaggcggcttttctgatgtagttacagtaaccggacattatgtgtgagaataaaaaagatggcgttagtggagatgaaagtgggttacgctgttttctatgcgacattttttccaggttgatgagaaggacgctgcgcagatagaaaatcttagcaagcgtatgcaaaggctggtttatggtgcggtggattataattcactgatccaaccggggagaactctgacatataagctgtatatgggcgaaaaatggcagtatccgcgtttaacagatacctctactcttagtgggaacattaccgaacaaatggggcttgttccatttatggtttttaaggctacttctgtcagcagaaatcaaactgatttctctccccactattttgcaggtgatgaccagattcttgatcataatgtccgtcatatcttgttgacgccggatgatgcgacggatagagatgtcgagctaaatcatccagtcaacagtaaggctgtcaaactttataatactttggaatcatccatgcctacagccttcgacgtattccgagatgctaaacgtacgatgcgtgagcatgttggaaaaaagtcaatcccaatgaccatggctcgaaatgcggataatgttaataaagctggaaaagttcaacatccgtgggttgaagttacaccggggagggctccaaaaggaagtcctcgagcggtagttgttgctatgcattggttccaagctggcggggcggaacgttgggctctggagacagtgaagcttgttcgtgatgcaggcttcatcccaattgttatcactgatcgtgatgggcaccagccatggattgctgatccggcatttgatgatgctattttgttgcctatgactatgccggtacaagagcgtccgggggattctccagtattgcgtgctttgttcgaacagtttgatattgctggtattttgatccatcattgccagtggatgtacgacaacgcatggtgggttaagacgcatttccctcagactagaatcgtcgattcattgcatattgtggagtattacttccacggtgggttccccaaagaatccgtagctcatgatgagtggattgacctgcaccatgtcatttccccccaactcgaacattggttaatcaacgatcatcagattgctccagagaaagtcgtagatgctcctttggtcggcctgactgctgatgctaagactccaagttttaaagagcgggataagacaaagccttttactgtggcttacattggtcgcatggttcgtcagaaacgacctgaggcgttcattcttgcggctaaagctgtgaatgcggcttatcctggaaaagttcgtttcatcatgcaaggaaatggagatatggatgctttttccgacatgatgatcaaacgatatgggttggaaaaagtcatagagcgccgagcgctggatgctcctgtcgctcagacatatcgggatgcggatgcgttactcatctcgtcaattaacgaaggcatcaccttaacgagtattgaagccatcagtgctggagtgcccgttctctcagctaatgttggttctcaagaaacattaattcctccaaagggtttgtgccgtcgtatgacttcaaactttgtacatgacgcaaaatccgcactatctcatattttgaataatgaagaagatcgcaggaagctttgggagagtgaacttgctcgtcttcagaagttctctgagcttgaatctgctgaggcatatttcaagaagatgttgaaggagtggcacgactgatgtcaacagacgtgagaaaagtagcggccgttgtcgtaacatataaccgtcttgagaagttgaaaaaagttttggcttcgcttgaatcgcagacgagacttccgcagatgttggtcattgttaacaatgctgcaacggatggaactgcggagtatttgcaggagtatgctcagcgattcgccttgtcggattccatgcagttggatattgtcacgcttgagaaaaatgagggtggtgcaggcggcttttctgctggcatgcgtcgctcctatgagctgggcgctgattacgcttggatttttgatgatgacggttatccggaacctgatgctctagataagttggtgctcgggtacgatagcgcagtagcggagctggggcctgacgtaccttttgcctgttccatggtgaagtttattgacggaactatctcggaaatgaataatccgattccgacatgggattggggaaggttgaaagctaaaggacttgacattgtcatggtttcccgatgctccttcgtttctgtcttaatcccacgttgggtgatggaagcttttggcttgccgtataaggaatacttcatttggttcgatgatgctgagtacacgcttcgtataacgaagtcttgccctggcgtgcaggtacttgacagtgtcgttctccatgatatgggtgttaatcggggagttaacttctccatgattgatgagaaaaacgcttggaagttctcttacggagttcgtaatgaggcttcctaccacttgcatcatgaaggtttttatcagtatttgcgtttttgcgcgctggtctggaacggtatgcgacatggaaatgttgcaaagccgttgagaaaaaagatgtacaaaaagatgattgaagcgtggaagttcaatccgagagttgattatccacaagtagctgcaaagtaaaaacagcgagtggcggtacacgtcgagaaccgactctgatgtaccgccactcactgcttttatttacttgagtgattgaaaattcgttgccaagtatttatgctgcagaaatcgctctctcgataaaggcgagaaagcttgttccactgcttcaagatattggccgctagatgtacgcagcggaaaagctccttgcggtacaacttgctgtctcgcttgaaccaggccgctccgtttccgtcagcagtagttacaagtgccgacgatattttgttaaaagccggccagattgcatccttggacatgatggacacttgagggtgagcgtcttttattccgctcgattgagaaaagaatgcagaaataacggatttgagccctatcttcgtgacggttttgggatccgacggaatgaatgtcggttcatagtctgcaagtgccgctggaaaatcgtcgagattatgcagaacaagactatctgtgaaaccttctcttgctttacgaacttctgctagtttctgcgggaggcatctgacgatatattccggcccctcggtcaaatcgcgaagtgccatatggtttaacttcatggcagaataaagaagctttgttcctagatgagcatcttcataaagcattcggaaagcaaactttttgcttggtacggggaaatgcataagagtgcagagccaacgattcctttgagcgaaatactcctcccaagttctggaaatatccttatcatgccatgcttggtgccatacggcgacaccgggaagacatatagtcggaatgttgttttctttggcacgcaagccgaattccacatcgtcatatttaatgaaaaccggcatggaaagaccaattttcttcaagacttccgtggggatgaggcataaccaccagccgttgaagtcaggattgattctcttatgcagttcaggagtatcccttagcggatttacagcaaaatcatgattgtaatgtgtgccggtggctggtgctggcattgcagagcttgcgtcaaagcgctcgccggaagagtacagtacagtcctattgtccagatgcagcattccaccaccaacgagaactggtctggtagcgtaatcggaaaactgaagagctcttaatatagcttcaggttcggtgattgcgtcatcatcaagaagtaaaacatatgcacttttctgggctttgactgtttcatacatccctcgtgagaaaccgccagatccgcctaaattgtcttgcaggatatatgttagctgttgccctaggagttctctcgtttgctgaaaatcgggttgatcttgtactcgatctgttccttgatcgacgcaataaattgtatctaaatgatctcgtaagtttttttcggcggcaatggtttgaagttgattcaaacagtatgacggtctattgaatgtggtgatcgcaattgaaagagacgagttgtgaggggcgcgcctttcttgggtggggacctgccattgggcgtcagtaacggtcaaagagtcattcgaagcagattccatatcagcccaaatgaatccgccatccatgaagccagataagctaatgtcggcttcgacgaattcatcttcttgtgccacaggaattgtggtaacagtagaggggattcctcgggctgatgatttcgtgacgacgatacgtccgacgccgccaactttcgcaataaaacgtacattggtaactttggtccagcgttgccagtaacttgccggaaatgcgttaaagaaagtgcacaatgagacgtgctgacctgctgccaactcaattgaagttcgagacttaattaaaactgatcccgcgggaagctctgttttacttgcttcttgtgctgaaaagatcccattcctgagggtccccgagagctgtcgtttacttaaacttgagaaagcgactttttccagagattctcgggcatcaaatagagctggatctgggtgcgacggtgtccaattgacaacgtagagaggaagcgtgctttccgcgtctgtagttgggaaaacaattctattaactgcttcccattcttggttttcttctagtgcagacataacattagtatacgttcttgtttttcctccagagcattctggctgccgtttcctttttatggcactcgattaaaccagttttcgctgagatatccttttcctgcggtctggtcatactggaccagacgataatcctccagtagatgttttgcttctgatgatagagtcttcttttttattaactgtccagaagaatccagatagctagttgacccagtaccccaatcggcatcggtcgaggcgaatctgctgactgctggtacagattgatgtacttctgtaagcagagctaggaaaggcgtgactttcgcatccatgtgttctgcggcgctagccataaagaagttcgaagacgagtaatcgctttcttcgggcgatagctttgaaccagcgctcgaagaagaagagttagaccatatgaaataatcgctttcgtgtaaagtgagttgattttctttgtactttgctgctggtgcgtagatgcctggaagatggtctccgtagaaaatgacagtaattggctgttctatcatatttagttgatcgaggaatgtggtcgtggcctgatcggtataactgatgccttttgcataagtatcaatctgaacttcttcgttttcatcgagacctgttgaagtatctgcctctttaaattcattgttggtgtagtagtccccgtatggcaaatggttttgcatggttaccaactgaataaactgggattctccgtcagattgattaagctggtcgatcacattttgatatgccgatgcgtcgctaacatagccagcgtcaatgtgatcctgatatttcaacgccggtttgctgtcgattgtacggaagtatttgaaaccgaattttttataattcgaatctcgaagataaaaattcttcaaatagggatgaaaagcgtatgagcattgcacctggcatgcatcattccaaatttgattgaaggtgtatacgtttttttgactgggcacaagttgttgataaggagaaataagctgatcgttaaaattagcgagattcattccagttagagactggtactcgatgttagctgtgccgccaccatagcctggcgatagcataagtcctgaggtggtgacatctttcaaagctcgaatgttaggcatcggatcgatatcaaaggagatgccaggaacacgcaggggatcagaaaaagactcggataaaatgagaatcacagtgctatctgtgaggatgtttgcccgtgatgtattaattttatttgcttctttagtatagcgagcggctatctcttccatagtttttttactgtacccgctcggcttatccattgccttaactcttacgagactttgaaatgtagtggctgggccgtttgatttggcatcttcataggtattccacgggacaggcttgtatcctaagttggttgccagagtataggaccaagctccaggaatattgagattccatgtgtaggaaaccagaagaacgacgctgagaattgcagcaagtgcgcgagatgatgtcccaattatatttttagcattcgaagaggggtgtttccaagagcagtgaataaagcggcgtcttccatcaagaacgaaaagaagaagacaagcacaggagaaccagattaatacggtgattgctccattaacgagagcttgctggtctttcggtatgaaagaaaggaggtttccgccattgccatttgatacaaagctaagatctgaagggagaataggttcgttacgaagtcccatcttgatgctgttcgctacgccgtaggcagtcatagcggcaccgaaaataacggtcgctatccaaaagcgatttaatacaaaaactaatgcaaggtaaataagccctatgccaatgaaattaaggagaaactgatacttttgttcaagccaaatctggctgacaaatttggtgacttgccctgcgacactgttcaggattttagttgtctgatcaacttcatcgcctttatcgtacgttggttcgctatacactccccactgaaggaagatgacttcggcggaagtcaatagggtgaacacgatggcgtagaacgcgtatgagaacctcatgcgtttcttccacagggcatgcgttctctggaagaacttgatgatgagttgaatagctttgaaattggtgaaagtttgccatgcggtctttaccgctgtggcggcggtatggatggcgtggccggtggttttggcggcttttgcaactgcatgtcctgcggtggagagtgcttttgccgtagtgtgtacggattgtttgcagacctcgatagcctgcatcagaggatgctcgttagcttgcgcgagttgaatttcagcagatgggggggctgaatgggtactgtcgttcgcggcttcgtcaatggactcgtcgttagctgtttttggcagatggggcgcatcgactttgggaatgaaaacgcttgtgttgtcggaggtggcgtgaattgccggcttctgcgtatacagccttgaactgtggtggcctgaaagggtggatggagcacaggcgttgctgtcttcgttgtccgcaagagggcgatatgttccgcccgcaatcggttgcttagtaagttttacgtatgaaggaacgtgagcatgacggtcaggcgagaaaataggcatcgtcgcatccttcaacaagatagccccttataattaggagctctgtacaattaaaccggatatattctagtgttcagctgtggacgaacgggtgtctagtagatgtctgaagggtagctggacggttaactgggtgatgggcagcaagcggcaaacagatctgatgttcaaggtggacaacatatgtgcgcgcaagtgttgggcgtcattcgctggtagtgcaccaaaaagcgctgtctgcatgaagccttctacagcagtcctgccatgtagatcggcagcttgaccacgtcattttccacgaccagcggtttcggatgcagcacgtatttggtgccgaccttcttatcgaattttgccttgaatttgtctaacgagaccgtgcggtaacgtttcgatgacttgacctcgatggggctgaccctgtacttcattgccgcgttctcgtacggttcgacgatgaggaagtcgatctccatgcggttcgacgggtcgtcgcgatcgctgcgcgaatagaagaacagccggtgcccgttggcccggagaagctgtgcgacgacgttctccgcgagcatgccctcgttgatctcgatgcgttctaggaggatgtcccggtacaggttgcttccggtctgttccgagtcggccagggcgagcgtagtgagaagccctgtatcggcggcgtagcatttgaccgtcgaatggtcctcgctaatgcttagccccacgctcggatcagtggaattgaagcagtcgttggtgatgaacgcgtcggaaagccagaagaaggcgtcctcgtaatcgcgggtcttcgcttcctttcccagcgatgtgatgttgaacttcttctctttcttggaaagctggcccaccaggttgtcggagatgcgcgtgatgcgtatccggtcgctgccgccatgcttggagatgtcctgcctgtacagtcggaggatgttccgtttgacgttgtcgactttgctgaaatcatgggtctcgacgtatttcgacacagcttggggcatgcctccgaccagcatgtattcacggaacagccgcatggctttcctgtgcagcgaatcggggagcggcctgcgcttcttgaacgagtccgcgatgagcgtggacagtggcttttctcccaaagcccagaggaattcatcgaaatccatgggattcaggcggatcgactcctcctctgatggaatgaggatgtccttgacgttctcgcggatagagacgagcgagcctgtctcgatgtagtcgtaacgcccgtcagccaccagctgcttgatggcctcgcgggccttcgggtacagctgcacctcgtcgaaaatgatgaggctatccctcctgtgtagttccactccgtagaaggatgacaggtacatgaagaacgcgtcgaggtcgttgcgcaggtcgacgaagtagcccagcacgtcatcgggggcttttgagaagtcgacgagcatatacgatgcatagttccgtcgtccgaattcctccgcgatggtgcttttcccgacgcgccgcgcgccctcgatgagcagggctgtgcttccttgggaagaatccttccaggaagccagtttttcgtacgcttttcgttcgaaagtctccatgtctcaccgccgtaaatacaccgaatcaagggtaataacatgcttaattatacaccaaatcaagggtaatgtaatggcggtttgctgatcggcttgaattagatttctgacaggtggtcttatatatggtagattctggcgtttgtccggacgtatttcgcttatatgtggcagctcgttttttgtgacagaccggttagagggtaattgtgtaccctctaactgcggttttcccggaatggactgccatacataggcgagatgtctccggtcagccttccaaatctgccatatataagctcgatatgttgagaaaaagttttattaggcggaaatcgatggctgaatctcgttggagcctacgatggtttcatctaaagcaacggaccgtcaaacagttcgtcgtgggatcccaggcgaatgaatcggattgttgacgcttccgatcgctccgagtagatcactaacacatccattttcccttcggcaagatggaattctgcatatcccgagtagattcctcgtgggcgatcaagcatgtgaggattatatgattccggaacgcgtccgtactcctcaatggcttcgatcacatattcgagttccgtgacgatttgaggtatccgtcgtgagatgcgtttgaagtcgatctgaaattgttggtcgaatttgatggtaatcatggcgttttgcctgttcagccgtgattgttgtgcagccaggtgatggcgtcttgcgcgctgttgaaggtggccgcgtcgtctgggaggataccgcgttccttggcctcggcttcgagcatggctcgcttggtctgctcgtttggctccgcggcgcgcacggaagtgtcaaaaggcaggcgttgctgatttacgagctggatgcttgccatggttacgtaagtgttgaaattcatgcctatggcgtcgagtgtctggttgactcgagctttcaaatcgtcgttcatacgaatggtaatattgcccacctgaatcacctgccctaattttgcgtgcaattaatgtgtattttatgtcaaatgcacgcatgttgcaattgataatggggataagtgtagtttctgacaaaaatgacaacttgtcggttttcagaaactagtatgttgaggtggggcgaaactgtgtgggagaatcatgagtgctgtttcatttcctcatcggatcggtttagctctagaagaaccgtgatcgcatcggggaaccgtgtgctggtcggtgcggatggtgcggttgtggaagtgacgtcttaccgtgcattttggccgctagctcaacggtcagccttccaaatctgccatatataagccagtttgtggaatcgctttatggctatgcaatcctgccggtactctgaaattgtgagtagtgagattttcaagccgcgcaatatcatcgtgaccggcggctgcgggtttatcggagccaatttcgtgcgctatgtggcacgtaaccatcctgacgtgcgcataaccgtgctcgataaactgacctatgccggaaatccgcagaatatcgccggtcttccgcaatcgcaagtcaaacttgtgcaaggtgatatttgcgatgttgcgttactggaacgtatcgtgcctggtcatgacgcgatcgtgcatttcgcggccgaatcgcacaacgacaattccatcgccaatcctgaacctttcatcacaacaaacgtggaaggcacgttccatttgcttgaagccgcccgtaagcatgacgtgcgattccaccacatcagcaccgacgaagtgtacggcgacctcgcgctcgacgatccatgcaaattcactgaaaactcgccgtaccgcccgtcaagcccgtacagcgcgtcgaaagccgcgtccgaccatctggtgcgcgcgtggacgcgcacatacggcctgcgcgccaccatttccaactgttccaataattacgggccataccagcatgtggaaaaattcattccacgacagatcacatccattctggaaggcgcgcggccgaaactgtacggcaccggcgagaacgtgcgcgactggattcatacggaagaccactcttcggcggtatgggcgattctgacgcgcggtcgcatcggcgaaacgtatctgatcggcgcggacggcgaaatgagcaacattgccgtaatgcgtatgattctgcggcttatggggtgtgcggaggacgcattcgactgggtgcgtgaccgtcctgggcatgatcgacgttacgcgatcgattccaataagctgcgtaccgaactcggctggcggcccgtgcataccgatttcgaagccggtttgcaggcgaccatcgcttggtatgctgccaaccgcgcctggtgggagcccgccaaagccgccaccgaagcccgctaccgcgcccaaggccagtaagaattcggttcgtgtggcgcaagccggacaattgaagttcggtaagcggtgatcgaggagacgcgttgcaggcgagtcaacctcgccggggaatggatgtgtggtttggcgtacattttgttcgctagccttagttgcagatccaggtttggtgaaggatgaaaaacggccgcacctcgaaggtgcggcccctattgcgtctcctggtgcgtggcaactgataacttttgtcaaatggaaggtgttgtcaagcctctaagcgacgcgaggtcgcgcctgcacagcatagatgcgtaattcatgggcatatctcgcttatgtatggcagattttggggtttgtacggaggcatctcgcctatgtatggcagtctgtttttgaaacaagctagttagggggtaattttgtaccctctaactgcggtctttccggaatgacctgccatatataagcgaaatgtctccgggcgacctgtcgaatctgccatatataagcccgatgtggtgcgaaaatgcttgtaatgggggcgaagttgcagacttggatgactttggccccgttaaacgtagggtttggcgctgacgtcggcgctaaccgtcggggcggcttacctgacttactcggcggactcgagtctgagttcttggctggcgaccaccgacttggcggccgcgtcgagttcgttggtgatgttgcgcaggttgtcggcgtatttgcgaatgtcgtccgtcgctttggtgaagtcgctggcattgccgcttgcggggcatgctggcgcgctttccacggctttggccagtgtgatcgcatccttcagggtttcgagcgtggtgccgtccgccacgtcattcacggtgagtttcgctgcttcttcagcttcttgttgcgcttcttcaaagctctcctgatgcgtggcgagcgccttcgcattcaacgcgcaggtgtcgctggcggcttgtgtcatttcgcgcttgttggagactgcgatgatggcgacggctgcgagcgcgatggcagctactgcgatcatggcgatgatggcgatggtcttgcgctgtttcacattgtttttctgcatggttggctgcatggtggttcctctcttctcgtgtggctctcatttcagacaaaacgttgcgagtatacaaaaaacacttccgagaaacgatttaccgctggaaataatgcggattattttgctgtgaaaggaatttgtttgtgattgcgatgctgggcgcgtcaggatcgcatggcatttatgctggagggagaaacgttttaagggggtttgatggcgtatcgtgcgacactgaaggatgtggccgctgccgcgggggtgtctgtgacgacggtttcgctggtgttgaataatcgaccggctcgcgtgtccgaggagaagcgcaaggccattgccgacgcggcaaagaaactgaattacgtgccgaatcagagcgcgcgaagcttggtgaccaagcagtcccagctggttgcgctgatcgtgcctgatattgagaacttgtttttcgcggcgcttgccaagtacgtggaggatgagtgcgccgcgcaggggtattcgctgattgtggccaattccgatgattcgcgtgttaccgagcatgagttgttgcagcgccttccggctcgtggggtggacggtgtgatgctgattccggcgcgcgagtcctgcgctggcgatgctgctgagcggttgcgtgaggatgtggcgcttgtgtcgtgccctgtggtgttgattgatcgtttgacgcagtgcggttggtgcgatgccgttggttttgacaattatcttggtggtcgtttggctgcccgttatctgttggagggtggtcatactcgtattggcattgtgactggcgatactgcggagtcgagtgctgcggagcgtcgtcgtgggtttgtggatgccgtcgagcaggcgggggagtgttttgattcgtcgctatgcgttgagggggattaccgtttcggtagtggctatcatgctgcggatcagattattgatggcggtgcgacggccgtgttctgctgcaatgatgtgatggcgcttggtttccgtcagcgtatggcggaacgtgggttgcgcgttactgaggatatgcaggtgattggttacgacaatattctcaaacgattcggtcttggttggcgtatgaccaccgttgagcagagcgtggctgatttggccgccgcctgttggggtatgttgcgtgagcggattgatgttgcggttcgtgccaagtccggtacggaatcaggggatgctcgcccgtggctttctaatccgcaggttgaagtgcttacgccgaaactggtgcaggccgcctgcgcgtaggattgaggatttttagatacctgcggatcatgatgagacgggtggcgctgataaatcttgattaaagtgtcgtcggagtttcttatacggttaaattgctggaaataaaagcaacacgccgtatggtagtgccgaatttgcgttcctgataaaacgctttatcataaatcttgtcaacacacaacataaatgagaaagtgttcgatacataactgacgacgcacccgtatggtggcggaccgtcgtcaggcccgtcaaagaggaaaggcacacacatgaaaaagatgattcttgatcttgataccggcgttgatgacgcgcttgccatttcgtatgctctgggaagcccggagattgaactgatcggcatcaccggtacctacggcaatgtgctcgtcgagcagggtgtgcgcaacgcactggccgtgaccgacctgctcggccacccggaagtcaaggtgtatcagggtttgccgcactccagcaccaccgaccatttcgaagtactgccaatctccgcgttcatccacggcgacaacggcatcggcgacgtggaaatccctgattccaaccgctccgtcgaaaccgaatccgcggtagacttcatcatcgacgcagtgaagacctatggcaaggatctcgtctacgtgccgaccggcccgatgaccaacatcgaagccgcactgaagaaggctccggaaatcaaagacgaaatcggccagatcgtgctcatgggtggcgcactgaccgtgcccggtaactgcaacgcctgcatggaagccaacatttcgcaggatccggaagccgccgactacctgttccgttccggcgctccgaccactatgatcggcctcgacgtgaccctgcagaccctgctcacctacaaggaaactcagcagtggcgcgatctcggcaccaaggccggcaagttcctggccgacatgaccgacttctacatcaaggcctacgagactacgtccccgcacctgggcggctgcggtctgcatgatccgctcgccgtcggcgtggcggtggacccgaccctcgtcaccacccttgacatcaacatgaaggtcgatgtggacggcccgacccgcggacgcaccatcggcgacgaaacccgcctcaacgacccggtcaagaccatgaaggtcgccgtcggcgtggacgtgccgaggttcctcaacgaattcatgacccgcatctccggcctcgccgcaaaagcgcagtgaacgacggctcgcgcggaaaacgttccacggagcgtttcccgcgcaaccctcaccacggaatcaccatcgaaataatcgcaacacaacatcacaaaaaccaagcgaagaagcgaaagaagaactgacatgtctaccagcaacgcagccgcaacggcagtcaacaccgcaccatcgcaagcccccgtcgacccgttcgacgatccggtgaccagcaacaagatggccgtccgcgcccttattccgctgctgatcaccttcgtgctcggcaccctgtgcctgcagggattcaacctcgtgttccagcaggtcggcgccgacgtcggcgcgccggcgcaggcgtccctcatcaccgcgttccccagcatcgtgctcggcatcgtgtgcttcatctatggatccctcggtgacttcgtctccctgaagaagctcgtcaccttcggcctcgtgaccctgttcatcggctccatcttcggtttcgtggccaactatttcttcgccgcgaacctgtggaccgtgatcatcgctcgagtgctgcagaccgcaggcgagcaggtggcaggctccgccttcctggtggtggccaccaaatacctgcgcaacgacctgaaggtcatcttcttcggcctgttcaccgccgcataccagctgtccgcttccatcggcgtgttcgcggccggcatgctcagctccatcgcatggcagttcctgttcctgatcccgtccgtcaccatcctgttcctgccgatcctgctcaagaccctcccgtccaagagcggcaacggccagaaggtcgacgcgttcggcttcgtgatcttcggcttcgccaccgcgttcctgaccctgttcttctcctacatgtcctggtggatgctcgtggtctccctgctgctgttcgtggcattcgccttctacatcaacaaggcctccaacccgttcatcaccccggcgttcttcaagaacacccgttggctgcgcgccatctgtctgatcctcgtgttctacttcgtgaactacgcactgagcccgatcttcaatgccattggtaccaacatctacggcatgaccaccacccaggtttccctgcacatcgtgtgggccttcgtggtcgccgctgtggtgggcacctgctccggcatgatcatccgcaagatcggcatcaaggccggcatcgtgaccgcaggcaccctcatgttcctgggatggaccggcgcggcattctgcgtgaactccggttttgtggtgctgaccctgtgcgcatgcgtgttctacgcgggctgtggccttatgtactctccagtcgtttccaccgtgctcggcaccattgagaaggacgaatctggtcgtggcgtcggcatgaacgatctggctatgaacgtatctccgtccatcggcattgccatcatcggcagcctgctcggctccaacgccctcgcaggcagttccgtcaccggtgctaccggtgacgccgccaactattccaacctgctgctgatcgccgccggtaccgcactgcttggtctgatcgtgttcttcgtcttcaagaaaaagatctacgaaggcaaccatgcgttggaaaccgaggaatcggctaaataatcgcacataacatcctcaatataaacaatggagatttgcgataattgcgaatactgaaaaacaatattccgcaaatctcctttttatttaattaatgtaaggaagtcaaagatgagtgcgactgaagttctctctgcattggaccgcatccacggcacagtgtccgtaatcggctcgatgaatgcggattacaccgtcaccgcacagcgtctgccagggccgggggagaccatcaccggcggtccgctgcagctgctgccaggcggtaaatccggcaaccaggcggccgccgcagcgcgcatcggcgcaaccgtgcaaatgttcggcgcggtaggctccgattccaacgccgacttcctgctgggcgccctaggtgaagctggtgtgaacaccacgcatgttcgccgcgtgcttggagcatccggtacaaccgtgatcaccgtggacgcaactggcgaaaacaccatcgtctactctccgggatcgaacgcgcaggtcactgtggactatgtggaatccgtgcgtgaggcgctggtacggtcttccgtgctgggcctgtgcctggaaagcccgatcgagaccgtcaccgcggccgcgcgcatgtgccacgaggcgggcgtgaaggtgctgctcaacgactcgccgttcaccccctccctgccggtggaactgatcgaagcatccgacatcctgctcgtcaacgagcatgaaatggcgcaactgctcgacatcgacgagccggagaacgacgattgggattcgttcgactggtggcacgcgctcgacgaactgcgcggattcggcttcgaacaggcgatcgtgacgctcggcggcgacggttccgtggtactcgacggcaccgcggacgatccggagcatcgcatccagcgcatcgctccggtgcgggtcaaggcagtagacaccaccggctgcggcgattccttcatgggcaccgtgctggcaggtctggcgtccggactggcgctgtccgaatccgccgaactcgcctcgtacgtttcggcgtacgcggccaccggctacggcgcgcaggcgtcctacggcaacgcggcgcagatccgcgaggcgtttgcgtccgccgaatagtccggtaatccggttttccccaaaccattggcgttggtatgtgccttctacgtcgatggtttggggattttttgatgttgccgacggcagtttggagcggtatggtgaaacgcttccgcaacggccgcgtgccgtgggcacccgcattgttatattggagtttggcttattttcacatatcgaacaattgggaaggcaagcatgtcggcgattctcgaaggcactccggataagaaactggctctggtgacgggtcgcgcgtaccccgagcaggctcaggaaaccgcaaaatacctgggaaccgacgtacttgagaccaccgcatacgatttcgccaacggcgagatgtacgtgcgctacaccgagcccgtccgtggcgccgacgccttcgtgatgcaggcccacaccgagccgatcaacaagtggatcatggagcagctcatcatggtggacgccatgaagcgcgcctccgcacgttccatcaccgtggtcgcgccgttcctcggctactcccgccaggacaagaagcatcagggccgcgagcccatcaccgcacgcctcatgttcgacctgttccgttccgccggcgccgaccgcatcatgacggtcgacctgcacgcagcccaggagcagggcttcttcgacggcccggtcgaccatctgaccgccatgccgatcctgcttgactacgtgcgcaacagcatgccgctggagaacaccaccatcgtgtccccggacgccggccgcatcaaggtttccgaacagtgggccgccaagctcggcggactgccgctcgccttcatccacaagacccgtgacaccacgcgcccgaaccatgccgaggcacacggcatcatcggcgacgtgaagggacgcgactgcgtggtcgtcgacgacatgatcgacaccgccggcaccatctgcgaggccgtgcgcacgctgaacaacgccggcgcgaagtccgtgacgcttgtcgccacccatggcctgctgtccggtccggccgtggagcgcctgcgtgactgcggcgcccgcgaaatcgtgctcaccgacaccgttccggtgcccgaagagaagcgcctgccgaacatgaccgtcctgtccgtggccccgctgctggccgccggcatccgctccgtgttcgaatccggctccgtttctacgctgctcaacggcctgcccgaagacatgcgtccgcgcaacatctacgcctgatatttcgtgcgattgccatacggctatcgtgatatttcaggatttattacgattctttgcgattaagccccgcttgcgagcggggctttttgcttgcctccgcacgtgatttcgcgcccggcagacgccgtttcgatacgtcgcggcgtcggggtagcctgtacaagttgccatcaatcgtatccatatgttcattgcgacttatcgatgcctgaaggcagcacgcatacacactcctgccatggaaggtccatggccgatagtccgaaggaggtgggtgatgtctgcgcataagtacgaactgatgttcattgctgatcctgagctggatgagcgcggtctgaagaagctgaccgagcagtatctggaaactgtcaccaaggaaggcggtgccgtcgagaacatcgacatctggggccgtcgcaagcttgcctacgaaatcgccggcaagaccgaaggtaactacgtcgtggtcaactactccgctgagccggccaccagcgacgaactcgatcgtctgctgaacctgaacgaatccgtcatccgtacgaagattcttcgcaagtaagtaaaccaagctttctaagctgcaaagtaagtaggtaacgacatggcaggtgaaactgtaatcaccgtggtgggcaacctcacggccgatccggaaattcgtaccattggcagcggcgccgccgtcgccagctttacgatcgcctccactccgcgcacctggaaccgtaactcgaaccagttcgaagacggtcaggccctgttcctgcgctgctccgcgtggcgcgacatggccgaacattgcgcgcagagtctgtccaagggcatgcgcgtcatcgcgcaaggccgtctgcagcagcgttcctaccaggcgcaggacggttcccagcgaaccgtcatcgagatgcaggtcgacgaaatcggcccgtccctgcgctacgcgaccgcccaggtgacccgtcaaagctcgtccggcaacggaggcttcagcggcaatcgcggcggctacaacaacgccaacaacaacggcggtttcggcggcaacaacggcggatatcagggcggctccagctatgctggcggcgccggatatcagggtggagcctccgctccggtcaacgccgctcccgcacagtccgctccggcctcggacccgtggtcaagctcggataactccggctcgtccttcggttccttcggcgcgtcccagtccttcggaggttcctccgaattcggcggcgacagcgacgaaccggaattctgacggaccgaaccccgtccgcaatataggcgaacagcgaaacaagcagcttaatcgcagtatttccagattttaaggagaacatcaagatgtcacgcaagaggccgcagccgccggtcaagccgtttaagaagaagccgaatccactgaaggccgccaaggtcaccgagatcgattacaaggacgtcgccctgctgcgtaagttcatctccgatcgcggcaagattcgttcccgtcgtatcaccggtgtcaccgtgcaggagcagcgcgagatctccaaggctatcaagaacgcccgcgagatggccctgctgccgtacgccacgtccggccgctgatcttagagaggtttgaacaatggctgaaactaaggttattctcaccaagtccgtcaaccacctgggtcacccgggtgacgtcgtggccgtcaagtccggctacgcccgcaactacctgttcccgcagggcctggccttcgcttggtccaagggtgccgccgcccagatcgaggccatgaagcgcgctcgtctggccaaggccgtcgccacccgcgaagaggctgttgccgccaaggaaatcatcgagggctccaccgtcgaaatcgctgccaaggtctccgagtccggcaagctgttcggcggcatctccgcagagaagatcgccatcgcgctctcctccaaggttgaggtcaacccgaagaacatcaccgttgagccgatcaagaccaccggtgacttcccggcaaccgtcgccctgcacccggaaatcaccgccaacttcttcgtgaaggtcgtcgctgagtgatttcgccccattcaccgctcgacgtccttacggaccggcggtgaatgacttcaggctgaaacacgtctgagcttaagcatcgaaaatcccccgtaccgattggtgcgggggattttcctatatccgctctttagccggcatcagtcctcatcgtcaatcgtgacgctgagcttgccatccctgatgctgaagctgccgttgacggtgaagtgggtgctgtcgtcctgagactcccacgaatcgtcgaaattcttctcttcatacgtgcacttcgccttgccctgccgggtggagaacgtgccgtaatcgagatcgatgtcggacagcttcggatagacgctgatggaccacgcgaagttgcggtagtagtcctcgtcgtacaggtcgaagccgaacgggcagccttccggcgcgtagtcggtggacttcgcgcattcgtccagcttggcgttcacggccttgctcaagtcctccttaagcttggccgtaggcatgatcttgagatcggcggcatcggagtccgcgttcgtgcgcaccatggtgatgccgctggtgacataccctgacttgccgatcgacaccttgtacgaacccgggtagacgcgcagcgtccacgtgctgctgtccgacttctccgcattcttcgcggtcacgtcaacaccgttgacggacaacgattccacggcattgggcaccgacacggtgatggtcttgagcagtgggctcgagatcttccaattcgggaacagcaggaacttcgacccgtccttgttgatggtgagcgaatcgttgacgttcttgccgttcagcgaatacgtcacgttgaccttggccacgccttcgacggttttgacactatcgatatgcgggttggcgatcgtggcgttgtcggccttcgctacggtgtcggacagcagcttgagctggtccttgtccacctgcggatcggcgatgtcattggccttgtcatacttgccgtcggcaatcgccgtcagatagctttgcgccacggatttcgcgctgaagacggtcgagttgagcacaccgtagacaatgcccaacacaatcagggcaccaattacgatgccgctgataaggatcgtcttcttagtttttgggtcgagcggctgacctgcccccggagctgcgaccggcatagaagccgcgcctgctggcgattgcggcagcggcaccgcacccgttgccgtgttgcccgttgtcgtattgggcatggacgtcggggcgaccggttgtggaacggcctgtgaaacaggcgttgcggtaggagcggtgggcgcgggcatcggcgcagccggcgtcgcgggctgggggaccgatgcggccggagctgccggagtagttggattggccggctgtgcggcagccgaagccgtcggcatggtcgctgttgcggtcgtgccgctcgccgtggcagaggtcttcttcatgccgtaggacggatcgcaggacttgacgtaatcgaccacgttctgcggggtctgctgcacggtgccaccgacgatgatccgccacatgcccggcagggacgccaccagcgtcggaccgaacgtcatcgcggccacctcgatcaggaacgtccagatgccggcgacgaggaaataccacatcggggtcgtcatcgacatgctggacgaggcgtatcccgccgcgaaataagtgaacaggaactccgcggccagccagaacaccatcgcggccaccggagccttccatgtatgctgccagcccgcgtaatacgggtcgtacatattgcgcgcggtctcacgcagcgcgatatagaacgtggcaagcaggaacagcacgaagcagatccacagaatccagccatactggctgagggaggacacgttgaacaacgtgatcgtatggacgctgtagctggacgtcgagaaggcgatgccgccgaacgaggacagcgaaatcagcataagcggcagagccgggaacagcagcggaaccagcagcagaccgcctgcgccgagatggttcgcggcggacatggcgatcgtcgccaccaggccaagcaccaggaacagcacgccgtagatcgcaaacgattcgaccagcgtgcgcacgaagccacgagcgcggtgcgcccaacgccaagcggcggagaagacgttacccgaatcgcccgcatactgtgccaacgcgtagccggccagcgcaccggccgccgacagcaggaacgccatgcagaacgtgcggaaggacacgccggaaagcgacgcggaagcggaatagtcgctgtaggaaccacccaccgtcaccgggaagatggcggcgaagaccagcagcaccaggccggacagcacgccgacgatcagcgagctgatgacgcccgtccacttgaaacgaagcgcgaacctgcgtgccagcatatatgcgccgaacgcggcgccgatcgccaatgccacgccgggcagtccgaccggcagcgtcacgctgacgtgcgaggcgtcaatgccgagattgctcagcgagaagccctgggagctggttttgagattcagcgaaccgccaacgccgagcgtcatcacggtgaagagaatctggaagaaattcgggccggagccggacacaccgttgttgcccaggaaggaggcggtgtcggaaaagcccggaatgccggcaagcccgttgctggccgcggcattgcccatgaagaagacgatcgatgcgagcagcgcgaacaccacgctcgcgccgagaccgatgccgaggctggcgcccatggtcttcatggactgcggtgtggtcagcgcggtgatggtgggatcggccgccggacgggcgatttgctgggtcggctggcttggctgcggcgctgctgccggctgcggggccggggatggcgcatactggaactgctgcgtcggcgcggcctgtggtgccaccgtttgcgttgcctgcgcctgagcggtcggctgtgcttgcgccgccggttgcggtgtggtgggctgcgggacggtggtttgcggagctgccggtgcggcgctattgggcagtgggacggcagcggtcggcatctgcggggccggtgccatgtgcggcgcggaagacagcatggtgccgtcatcggattccgccgcggccggcgcttgcggtgccgccgcggtcgtttggatgagcggtgagccgcacgaggcgcagaatttagcgccttcgatggtcggctgaccgcaatttgggcatgccataggtaagcctttctccttcttgatgcgcgtcatatactcctgtgacgcgccatggtccttattataaagggcctctggcgcgtcgacgggctcgacgatgatgcgtgctattcggctcgccgcggtggaaatgtgtgatggaaaagttcgtgccgttgactgtcggagtggttgcattgcgccagaatgtgaagaaaatgtgattacttggattctagggcgccatcgcgccgcatttttcgtcgtatgacgcgatgtgcaccatagatggcgatttgctgaaaacgttggaaaatagcggttttatgattgcgacacgccgaaggttgcgttctttccgattctgagtatatttactctatgtgctcagcgagaacaaaaacctcgccaagaccaacgcccctttagctcagttggttagagcagctgactcttaatcagcgtgtccagggttcgaatccctgagggggcacagacaagacccaagccaatggcttgggtctttttcgtatttcggacatgcgtccacccaaagccgcgttacttcctccgtgcggagtaaggtagtgcgctgttgtccgcccagagcggaatcgcaattcatctcgaatcgcacgaatcgtaagaatcgttagagaagaagcaatagaggaaactgcagtggaatacacactcttcaccaagcttgccgcggaattcgtcggcaccgccgtgctgatggtcttcggcaacggcgctgtcgccaacgcggaactgaaaaacaccaagggctaccatgccggctggctgaacatcgccatgggctacggcttcggcgtcatgttcccggtcctgatgttcggcggcgtctccggcgcccacatcaacccggccatgaccctcgcgcaggccgtcaacggcatgttcccgtggaacgaggtcctgccgtacatcatcgcccagctgctcggcgcagtggcgggccagctcatcgtgtacgtcacctacctgccgcactacaaggacaccgacgatgccgaagccatcctcggcaccttctgcaccaccgacgcgcacaacgaccgcgtgaactacttcctcaacgagttcttcggcaccttcatgctggtgctcggcgccctgtgctgcctgtccctgccgtggggcaaggcgaacccggccgccgcatccatcgtcgtcggcttcatcgtgtggggcctcgtgacctccatgggcggcccgaccggccctggtctgaaccctgcccgcgacctcatgccgcgcctcctgcacgccatcctgccgattccgaacaagggcgattcccgctggggcgaggcctggattccggtcgtggccccgatcgcaggcgcgatcgtcggcgcgttcctgttcaaggtgctgttcgcctgagcattactttgacgattgccggcattcgtctgacatgctggtaaggcccgtgattccctccggaatcgcgggccttacgcataggtggtatgcatggcggtcggcggcttcggcatgttgactgagactggtactgttgccgaagagagaaacatcaccatatcgggaggctggattgaagcggattcgtcgtatcatacgtgcgctcgatccgaaagccgacgccacaatgggccaacgggaacggcttgaggcgtttcgcatccgcagggccgccgcgctggtgctcgtgctgttcctgctgatcgcatcgatgacgtcctgcagcgtgcacgcactgctggtccgcatgacgccgaacacgcagacgacggcacaagccacgcattcgacgtcggccaagaagccagccaagaaaacagccaaaaccaatcagcataagacggccaaaaaaaccaaaccggaaaccaaacaatcgcaggaagagcaggccgtcgccaaagcggtgagcgcgcaatcggcggcactgagcgacgacgagaaaaccgcgattctgaacaaagcgcaggaaaccgcgcaaaacagcggcaaaccggtaacgcaataccattactgcatcgcaaccaaaggaaacgtcggttcggccgacgaattcggcaacgcggcgttccgcatcctcaacgacgaacacggatggccacgcgccggagccatattcgaccaatccacggacggcaactgcgatttcaatctcgtgctgtcccaagcgtcggaaatgacgtcgttctcgccatcatgctcggtggaatacagttgcagggtcgacaacaacgtgatcgtcaacgacgaccgttggaacggcggcacgcaacaatggctcgccgccggcggcaacctggcgcgataccgcacgatggtgatcaaccatgaggtcggacaccggctggggcacatcgacaacgaaacgacctgcgccggcgaaggccagttggcgccgctgatgcaggagcaatccatgcatttggacggctgcaaggtcaacgaatatccgcttgactcggagctgtggatcggctgaacgtcgactgcttcccgttattttctgctgctttctgctgttttccggactgaccgggtcgtctcggcaattcggcgagacccggccagccgttgtcacaggccgaaatacgcgtcgaaatcgtcttggctgatactgcggtcggccgtatcggcccgtaccttaccccaatcgaactcctgcaacgcctcgacggcgctcatcggctgcggactggtatgcgcggaatcgccctgcaaaccaagcagccacgcacaatagccgacaacctgttccgcggtgacgccatgcgcgcgcagcgcccccatatccaaagagcgctcgcgtttggcgagcctgcggccggccgcgttgtcgataagcggcagatgcgcataccgtgggttttcggggttatatggggtgtattgcgattgtggtgcgtgctgcgatggtgcagaggcctgcgttttcgccttgcggaatcccgccttgataagcgctcggcgaatggcgatttgcaaggcgttcgaccggagcaggtcgcggccgcgcacgatgtcgtcgacgcccatgtcaagatcgtccgcgaccaccaccagctggtaggagaacaggccgtcggcgcggcgcacgatggtatcgccgacgtcgtgcgccagattgaattcctgatggccgaacactgcgtcatcgaattggacggttgcgtgcgggtttgtgtcggcgggcatggcgatgcgcagcgaatggcggtcgccgttggccagccgccgccggacggtatccggattgctggcgataagccggcggcacgtgccgggatacaccatgaaacggtcgccttcctgcggtgcggaggctgcgcggatgtcggcgcgcgagcagaagcaagggtaaatcagcggggttgtgccagcgattgcgttgttggctgtgctgccgactgcgggggtgtggtcgttgcgctcgtcaaacggcgaatcgtatgcgtcgtcaatcgtcaggttttccaagcaatgcagcgcctcacggtacaggtcgtgccgagcggattggaacaccggatcgccgtcccaatccaagccaagccaatgcagatcgtccatcatcagttcggccgcgccgggcaccacgcgcggttcgtcgatgtcttcgatgcgcagcagcatgtcgtcgccgcggctgcgcgcggacagccatgcgccgagcatcgcatagatgttgccgatgtgcatgcggcctgatggggtgggggcgaaacgacctggcacggggttccttcctgtcgttggcgggcggttcggtgttgccgatgcggagaccggtcgcgccgatgcttgcaactgtacctgcatcggcggccggaacggtgggtttcgtgggacgcgattgcggaatgcgttgctggacgtgccgtgacgtgccatgccgaggttgcggcgtgctccgaaaacgtgccgtcgctgtgagatatctcacagtgtgagaaggatatttagcgcatggtgatacgggccgcgcgtttcgtttggggtgtgcgtaaggtggtgtgcgtcatccggtattctgggtggtgatttcggcaattcggtctatgcgttatcggtatggccggtcaaaaggggatttacaaggggcgaatatgacgaagcgacagttcagcagagcggaaatcgaatacctgcgtacattgccgtcgatcgacgcggtgacggacagcagaatcacgtatgcgaaggaattccaaatcgactgcatgaggcggtatctgcagggggagaagccaactgcgatcttcatttccgcgggattgagcccatcggtcatcgggcacaagcgcatcgaacgcaatatcgcacgctggaagcgtgacgaggacatcatgcgcaaggcggccgaagagccggaaccgcatgatacggctgtggacagccacaatgcgatgtcggaagtgccgttgggcaagatccaatcgctggtatgccaggtgatggtgttgagcgatcgcgtcgataaattggagcgtttggtggaggggctgcgcaagggggataaaatctgaaaaaaagttttcagatttattggttttttccggcggttcgcgcgcatttatctgatacattaaatgcgtagacggagtctttgaagtcccccttctactgccgtctggttttatagcccgcgcgaatttatgaccgctttatcgcttcacttcaggtcatcgcgcgggcttctttatacgttgtcggcggttttctggtaacactggtatcgaaatatcagccgacatgccggaaacggtggtgccggccgcggaccggcggtcgaatgaacttgcgagaggtggacgatgactgcatacatggatcacaagaacctcgccaacgaggtgatcgacgatgcgcgcgcacgtgagatcacggacggcgtgcatcgtgtgctcgaccgcatcgcggcagctgaggaacaagccggacgcgaagccggctccgtgcgcctgctggccgccacgaagacgcgcgacatcggcgaaatcatggttgcgattgatgccggcgtgcgcatgatcggcgagaaccgtccgcaggaagtgacggcgaaggccgaagggctggcacggcgatgcgcggaacgcgggttttcgctgggcgtcgcaggcgccgcgccggatgctgcggcggagcatattccattccacctgatcggccagctgcaaagcaataaaatcggcaaagtgctgccggtggtcgacaccatcgaatcggtcgattcaatcgatttggcagaaaaaatttcacgtagagccgtggctcgcggtattactgtcggcgtgctgctggaagtcaacgaatccggcgaggaatcgaaatccggttgcgatccggcgcacgccatccgcatcgcgcagaaaatcggcacgttggacggcatcgaattgcggggactgatgacgatcggcgcgcatgtgcacgacgaaacggtgattcgccgtggtttctcgcacctgcgcaagacccgcgacctcatcctcgcatccggcgaaccgggcacggaccgttgccgggaactgtcgatgggcatgaccggcgacatggaactggccatcgccgaaggttccaccatcgtgcgcgtcggcactgcgattttcggtgagcgtgcgttcatctgagcgctttctttgactttttctgttttttttaaggatttgcggggcttgtccgcctggattgcattcgtctggcttacattcgtccggcttgcattcctctgaaaaacggcttgtctgagctgcgttccgccggtaggtggggtgctgcgcggtttggtgccaaaattgccggtttcgtgcctgaaaccgttgtctttctaggggtaagccctcctatagggggcaagggctttcgtatggcgggtgtgaacatgggtgtgttcgaaggagaaacccatgttttggtctgcctctcgattgatgagtaaacccgtccgtctgctcgcccgcaggacggattcctacgtgcatgcgcatgaggtgctgcgttcgcccatgcggctgttcggtgccgtggcgggcgcctcggctgattcctatgatgccggtgacgataacgatggcatcggcaatggcgccggagtcggatctgatgccggtgcagctgccgacagtggtcatgccggaactgttgcgttcgctggaacgtctgctggaacgttcgctggaacgccgtcgttttacgaggcgattgacattgccgatgtggttcgcgcgcgcaggctgcggcggattcgtttcatattggtgcggtgcgtgtccgtgctgctgatcgtgggcgcggtggtggtcgcgtcgttgccgttcgccatgcaggcgcattccgcgcggcgcttggccgagacatccgattcggcggctcgcacggttgccggatggccgtatccgatggcgatggaggagttggaacgggcgcgcgcatacaatcggcggcttgccgtggaaggacagccggtattgggcgaggcggccgatccgttcactaccagaccggctggcacttccggagatgctgataccgccgacgattcggcacattccggcggtgccgggctttccgcggcggacacggacgcgaactatcagggcctgctggattccggcgcaggcatcatgggcacggtattggtgcccaaaatcggtgtggaactgccgattcggcatggtacgtccgaaccggtgctcgccgtcggcgcagggcatctgtacggcaccagcctgccggtcggcggcactggctcgcatacggtggtcaccgggcatcgcggcctggtcaaatcgttgatgttcacacggctcgacgaactgcacgacggcgatttcatgtacatcaaagtgatggacgagacgctgggatacgaagtggaccgaatcagcgtgatcgaaccggacgacgtctcacggttgaaaatcgtgcccggcgaagaccggctgacgttgatgacctgcacgccatacggcatcaacacgcatcggctgctagtctccgggcatcgcgtcgcaataccgctgcccgcgccagatccggccgacgtgcgcgacgagcgtgcgaccgaactgggcgcgctcgccatgaccatcgtttgcacgatgggcggcatgctgttgtgctgcatggtcgtgcggtcgatgcggccccgacaccgaatcatgcggcacgcttccgcctggccgcgtaaaggataagggggaaggccgcgattttcgcgggtccgtacgttccccgaacccatcaatggaggggacgggtttcaaaacgttcatccataaggttcaaggcatggaggcgcataggcaattcgccgcagcgccatgagagatggacatgtcatgaagtggatgaaggacccgcttgccggcttcataagccggtgtggcgcgcggatgggaaaattcaccgcattgcttgtcacgattgcgatgctggccggcaccacgggagccggcgcgaccgcgttcgccgacgaaacggtgacggatggcggcaacgtggccgccgaatccgcagcgagccagccggaatcgacacaacaatccgatgctgaaaacgcagtcggatcggacgttgccgacattgccgggcaagatgttgccggacagtccgcgacggacgatgacgacgcacaatgccttacggacgacggtgaatcgcatcagccatcgaacgaacaaacgcaatcgcaactgcagtcgcaatcgcaaccggaacaaccgtcggagacgatgccggaacagcggcagccgtgcgataagacggaacagccgaatgagcagaaggagcaggaacggcaggcggttaggcagctgacggctgagaacgctgacgtacctgcaaatggtgctgcaccggctcaagacggcgatcgaaacgaccatgccggcgatgcggacgatgctgacaacgatggcaacactgctgaagatgccgacgatgccgacaagaacggtaagaatgacgccgacaaggatgccgcgtcggctcaaaacggcaacgataacgacaagaatgatgctgccaaagacgatgccgacgccgacgaacacatcatgcgcgatcgcttcaccttcaatcgcaaaaccgtgatgcgtgccgcgcgtaacgtcgccgtgccgcagccggaccacacgaaaagcatcacatacaacaacggcggcaaatacacgctgaacctcaacgtggtgggcaaggatacccgcgaaagccatgagaccacggagaaaatcgaagtggtgctcgtactggacacgtccggatcgatgaactactgcatggacggaagccaaagaagatgcaacaaatcgaatccgaagcggttgacggcgctgaaagaagcggcgaccagcttcatcgacgccaccgagaccaccaacgacaccatccaggacgaaaacagcaaagtgcgaatcgccatcgctcaattcgggcagacatccggcgtggtgagttccctgaccagcgataccgtcgctctgaaatcatcggtggctgtccgccaatggcgcgacccctgcggacaaaggcatggccgccgcgcagacggcattgctgcaggcaaggccaggcgcgaagaaaatcgtcattttcttcgcggacggtgtgccgaccacgcaaagcgcttttagcacaagagtcgccaatgacgccgtgcaaaccgcgctcgccatgaaatcggccggcacgctcatctacagcatcggcatcttcgaaggcgccaatccggagcggcaatcgttcgacaactgggagaacgacaaagccaaccagttcatgcacgccgtgtccagcaactatccgaacgccaccgcgtacgacgaagccaattggggtacgggcggcaacctcggctactacaaggccaccaacagcgcgagcgacctgacgaagatcttcgacgacatccagaaggagatcaccacgggaagcgcctacagcggcgtctcgatcgtcgacgagctgtccgaatacgcgcaggtcgatggcgttgtctggaacatggccggcatgcggaacttcggcggaacgacctactaccgggtgaccggcggcgtgacgctcaacgtgacgaatctgccttcgggggctacgcctccagtgctggaacgtgattacacattgtggtacagcgacgccggcaacggcaagatccgcgtcgaattcgccggcgattacgagctgctgcacaacgcgacctacacgctctcgtacggcatagtgccaaccgacagcgcctacgcgcgggtcaatatggtcgacggcggcatcaactacgacgcgaccggcgacgcgggcaccggcacgacctccgcaggaaagccgggcttccgatcgaacgcgtcggcgcaggtctgttacaccttcgacaagcagtccgcctgcgcggcctaccagcatcccgtattgcaggtgccgtccgccaacgtggtcgtgacgaaacattgggaaggcggaatgccggcgagcggagccacattgcgcatcgatttcatgcagggcggcgcatcgaagctgggcaaagacctttccgaagatgacgagctgcctaccggcgaatggcagtacacattccgtggcgtgatggcgggcgactacaccgtcacggaaggcaacatcgccggctatcacgcgaaaggcaacgtcacctcagtgccgatcagcatcaccagagccgacatgtggagcgcgttcgacaagggacagaccgccacctacgaagcctcgttcaccaacgtgaaagagacggtggccgtgctgccgctgtccggtgcatcggaaggacggacctggctggtcgtggccggcgtcacggcactggtgctgctgcttgcgggcatcgtcggactggctttgatcgggcgcggacggccgtgacggaactgccggacggcaatcgcaattctctgatcgcaatccggcaatcgcaattttcaatcacaactaaagagcaacacaacatacgaaacttcccataaaaccaaccaatcggctgcagtaacaaggccgaccaaaccaaggaagagaggtctctcatcatgaagacgagaaggctttgtgcagtaatcgccgcggcggcaacgttgctgggcggtatggcgctcggcaccgccggagcgtacgcggccggtaatgcgtcgatcgaagtgcggcattcgcagaaggggcacacctactccgcgtacaagttcgcctcgctgacagtggacggcgacgccgtgcaggtcgacaccgacgccgattgggtgactgctgtgaccgacgcggtggccgccgccaacaacaacatggaccccgttgtcagcatgccctccgaatatgacagcaatccggccgcgttcgccgcaaccaagaccggcgataacgacgccgcatggttccgcacattcgcggcctcattggcggttggcgatggcgtcgttgccgacaaaaccgttgcaggcaacggcggtacggctgccatcggttctcttgaagaaggctggtatctcatcaccgatgtggatggagagggtggccgaggcaccaacgccatcgtcgccaccacgctgaacggcgtggccgccacattcaaagtgaagggcgatccggcaaccggccagggcaagatcaacgctgtcggcatgtttgtggccaagaacgagaacgagcccgaccagccgggcaagacggccgatacgattaccaccactgaaggcgtgagcattgggcagaccgtcgcctacaccatcacgctggatattccgaacgcggccgaaggctacgacaagtatccgtacttcgtgaaggacgtggcatccaagggcctgacggtcaacagggacttcaaggccgttgttcgagccgcggatggcacggaaacgaatatgccgttcacctacgtgaccgttccgaccgttggagccgacggcaagaccaccaccgtgctggaattcgacttggccaacaagagcggccagctggtcatcacctacaccgccgtggtcaacaaggacatcatcgacatgggcaacaaggttaccaacaaggcggccgtgtcccgtgacaccgaggtgtggaatacgccggtcgaattcgactcctataccgggggcttctccttccacaagtacggtgtcggaagcgatgccaatggtctcgcaggagcgaagttccacgtgttcgagggaaccgaggtttcgcagaccccgctcaagttcatcaagattgtggatggcgaataccgccttgccgaagcgaacgagaacggcgctgtcgcggatgtggaaaccaccaccggcgacgtgaaaatcatgggcttgaagtccggcaagtacacgctgaaggaaaccggattcgcggacggctacgcgaagaacttcgtgccgaccttcaccgtcgaactagctgtgaaccaggaaaccggcaagtcgaccttcaagctggtcggcgccaacaactttggtctggcaagcgaggtcgacaaggtgatctgggtcaagaacgtgaagaacgtcacgcagctgccgctcaccggcgcaatgggcaccgcgttgttcaccatcgcggccctggtaatggccggagccggactggcgctcgtgctgcgcttccgcgaatccgatacgccgatggcggtctgagcgggccagcagacaggcaacggggcttgttcgggcgggtgagtcgttgagcgatcaacggttcacccgcttttgttgtgacgaatacgggcgatttagggtttcgtaccgcctgaaatggttggaaaaacgccattcgtaccggtatgatggaacacgaagcgaacaacgaatcggattgcggccttgcatcgcaaacacgtatcgcaagccgaacaggggaatggcatgacggaggccattcgactgccgtgcggtggaagggagccgccgcacgccaagccgaaagggaacatcatgtgcaacggtgggggagcgttcagtccggaagaagtcgaatatctgcgctcgctgccggtggtggccgaagcgacgtcgcgacgcatcacctacacggaatcgttcaaacacaactgcatgcgccggtaccatgcgggcgaatcgccggtcgaactgttccgcgaagccggactcgacccatcgctgatcggctataagcgcattgaacgttgtttcgcgcgctggcgcaagattgcctgccgtatgggcacggaccggctggtatcggttgatgggaatggtggagtggtgccatcggcgtcggcggatgtggcgccgtcggcggaatctgcggaggttgctcgatctgcggtatcgcagccggtacagccaacgcaaccggcggaaacgcaaagcaatgcgacgctgcccgcgccgcgcaacgcagccgaagccccaattctgtcgggaggtgacgtgcgcgacctgctcatcgcccagcaggtgcgccgcatcgacgagctggaacgcgaggtggcggcgttgcggtcggaactgcatcgcaaataatcgcaaaaatcgtaaaaaatgcgagcaatcggcatcgtccgcaaagcgacgcatgtcgagaacggcgggcgtggcgagcgggtagacttgcgggtatgagaatcgcacgttttacgcataatgatgtaccgcagtacgccttcgttcagaccgacaagaacgacggcaaggactatctcgtggccttgaacggctatccgctgtccggccaggccgtcgagccgaccggcgagcgctatccggtggatggtgacggcattcgtctgctggctccggtgattccgtcgaaggtgtacggtttggcgaagaattatgaggcgcatgcgcagttcatgcatgaggccggtcattccgatatcaagcatgcgccggaggatatggtgattttcaccaagccgagcacgtcggtgattggtccggatgatccgattgtgattccgctgtgttcgaatgatatgaatttcgagccggagttggctgtggtgatgggtcgtatcgccaagaatgtgccggtggagcaggccatggattatgtgctgggtttcacgtgcgtgaatgatgtgacgttgcgtgatctgcagggtcttgatccgacgtggacgcgtgcgaagggttttgatacggcgtgcccgttgggtccgtggatcgtgacgcgtgacgatgtggattggaaggatgcgaagatttccttcacgctcaacggcgaggatgtgccgatggcgtcgggtaccacggcgaatctgattcacggcattcctgagcagatcgcggcgattacgagtttcaccacgctgctgccgggcgatgtgattatgacgggtacgccgaacgcgtcgggtcatctggatccgggtgacgaggcgatcgtgcacgtcgagggcatcggcgatctgcgcaacgtggtggtgcgcggctgattttcggcttgctggcggactttggattaggcgggtttgcaacgtttcgtgatttcgttacgttgctgcccgcctttttcgtatgtattgcgattgccggtgagcgctggtgattgtcggtgactgccgtcctgtgtcgaaagacggttttgagaaacgcaaaaagttgagtgtgtgggactcaagttttgggaatataatggcgatgaagtcggttgagcatatcagacaacgacatatgcgtccgaacgccggcccggtagcgaaggccgggcggccgggcgcgaaccatggaggatgatatggaacagaagttcacgcagatggcgcaggaagcgctttcggacgccgttcagaacgcggcggcgctgggcaatccgcaggtagacaccctgcacctgctggacgcgatgctgcgtcaggaaaacagcatggcccgcgcgctcatcgaagcggcaggcggcaacgcgcaaaacgtgagcgccgaagtgcatcaggcgatgcaatcgctgccgagcgccagcggatcgaccacaacgcagccggacgtcagcaggcagctgtcggcggtgctatcgcaagccgaaaaagaaatgcaacggaggggagacgagtacgtcaccgtcgacctcatgctggtcgcaatcgcggccgcgaaaccgaatcaaagcgcggacatcttggaaaagaacggtcttaccgcggataagctgcgtaacgccctgaccgccgcgcgcggcagcgaccgcaaggtgaccagcgccgacgcggaaggctcgtacaaggctttggagaagtactccaccgatttgacggccgccgcgaaggaaggcaagctcgacccggtgatcggccgcgaccaggaaatccgccgcgtcatccagatcctgtcccgccgtaccaagaacaatcctgtgctgatcggcgagcctggcgtcggcaaaaccgccgtcgtcgaaggcctggcgcagcgcatcgtcgccggcgacgtgccgaccaccctgcagaacaagaagcttatctcgcttgacctgggctccatggtggctggttccaagtaccgtggcgaattcgaggaacgtctgaagagcgtgctcgaggagatcaagaaggccgacgggcagatcgtcaccttcatcgacgagatccacaccatcgtcggcgcgggcgcggccgaaggctccatggacgcgggcaatatgctcaagcccatgctggcccgtggcgaactgcgcctgatcggcgccaccacactggacgaataccgtgagaacatcgaaaaggatccggcgctcgaacgtcgtttccagcaggtgttcgtcggcgagccgagcgtggaggacaccgtcgccatcctgcgcggcatcgcgccgaagtatgaggcccaccacaaggtgaccatcggcgacgacgcgctggtcgcggcggcaaccctgtcgaaccgctacatttccggacgccagctgccggacaaggccatcgatctggtggacgaggccgcagcgcacctgcgcatggaactcgactcctcgcctgaggaaatcgacgaactgcgccgccaggtggaccgtctcaagatggagaagtcgtacctgctgggcaatccgaagaacgacaaggccgcggaaaaggccgaagcggaactggacgacagcgccaaggaccgtctcgccgatttgaaccaggaaatcgccgacaaaagcgaaaagctcaacgggctgaaagcgcgttgggacgccgaaaagaacggccacaaccgtatcggcgacctgcgcaagaagctcgacgagctgcgtacgcaagccgaaaagtacgagcgcgaaggcgacctggcgaaatcgtcagccatcaactacggcgaaatcccggccatccagaaggaaatcgcccaagccgagaagaacgaggcggaatcgggcggagccgacaatgccaacgccgacgtgccgatggtccccgaccgcgtcgacgccgactccatcgccgaaatcgtctccgactggaccggcatccccgtgggccgtcttatgcagggcgaaaacgagaagctcctgcacatggaggagtacctcggcaagcgcgtgatcggccagaaggaagccatccaagcggtttccgacgccgtgcgtcgctcgcgtgccggcatctccgacccgaaccgtccgaccggctcgttcctgttcctcggccccaccggcgtgggcaagaccgaactcgccaaggcgctcgccgacttcctgttcgatgacgagaaggccatggtgcgcatcgacatgagcgaatacatggagaaggcctccgtgtcccgcctgatcggcgccgcgccgggctacatcggctacgaagagggtggccagcttaccgaagccgtgcgtcgccgtccgtattcggtggtgctgttcgacgaggtggagaaggccaatccggaagtcttcgacgtgctgctgcaggtgcttgacgacggtcgcctgaccgacggccagggcaggaccgtggacttcaagaacacgattctgatcatgacctccaacctgggctcgcagttcctcgtcaatcccgacatggacgcggacgccaagaagaaggccgtgatggacgccgtgcacatgcagttcaagccggagttcatcaaccgtctggacgaactggtcatgttccacccgctgacccgcgaggagctcggcggcatcgtggacattcaggtcgcgcaggtgtccgcacgtctgaccgaccgccgcatcacgctcgacgtgaccgattcggcgcgcgaatggcttgccaacaccggttacgatccggcgtacggcgcacgtccgctgcgtcgcctggtgcagaccgaagtcggcgaccagcttgcccgcatgctgctggccggcgaagtgcacgacggcgacaccgtgctggtggaccagaccggcggcgaccacctggagctgtccgcgtgggccgcggaccagctggaggatatgggcgaggagaagacggacgattccgccgacgtcccgaacccggctgagtgacgattatcgattggttacctgtcggtcgtaagcctgcaataccaggcctgcgaccgacagcacggtcgaaccgagcagtatggcgatcgccagcttcggttgcacgccgaacgccagccacaacgcgcacgtccacaccgcgaccaccatcgtcaccgacgtggtgatctgcagcacacgtgcgcggatcgcatgacctaccacagcgcggaagagcaattcttccgcgcttttttcttgcgttggctcaggggatttcgcttgagatcgcgccgattctgttgattctgttgactgtgccgattgcgccttttctgtttctgccgtctgctgcgcggtcatcgcgtgttgccggacaagcgtgccagccagcgaaagcgtcgcgaccacgccgacgaacgcgaaatacggatcgcgcgagccggccgggaaaatccacgacaccacgcacagcagcaggctgtacgcgtaaacaatcgccatgccaagcgaaaccagcgaatcgccgttcggacgtcgccgctgcaatgcgggcaggccgcggtggtgaatcggcgccgcgcaatagaacatgaccggcgtgatgacgatggcgtgcggccacggattcgtcagccagcccggcatggcgattttggccagcgccagtaatgtgatgacgaacgttggaatggtcaggataagcgcgatgacgaggcgcttgccgaggtggtcggtgggttgtccgtcgatgtcggatgtcgattcgccgtctaccgtcactttgccgtctatcgtcactccaccgtcggttgtgtgggataggtcggcaaatccgccgtccgtccgcagcggaatcgcctggcgtgcgtccgagcttggaaacagccgcaacaacgcccaggtggcgatggatgcggccacaatcgacacggccgccaaaaacagatcgaatcccataatgtcccttcgtgttgggctgatgcatttcgcgttcggctgatttcagcatagtgcacggttgtgtggcatgcggtcggtcttgcgaatgaatgtggatgcgtggattgatgtgttcctgacgacgtgataccatcgaacgtatgttcgataatcctgtgtttgtagtgatattgctggtgatcgtggccgcgctcggagcggctgcgggcttcttcgcgggccgtgccaaagggcaggatatggcccgtggcgcgaaggaatccgacctgaacgaggcgaaggcgcagatcgaggcggacaaacaggacatcagcaatctcaacgcggctgttgtgcaataccgtacgcaggcggaagggctcggccagcagctgacgtatctcaaatcgcaattggcacaggcccagcgtgccgaggaaatgcgcgtggaacgtgaacggcagcgtgccgccgaagaagcgaaccgtcgtcaagccgaaagcgaacggaaactgcaggagcaaagcaaggtgctctccgcactggctccggtgcagaagaacctcgacgccctgcagacgaaggtcgcgcaaatcgaagagggccgcaagcatgagatgggcgcgctcggcgaacagctcaaaggtcttggcgaacagcaggcgcgattggatcgcgagacgagcgccctatcatcggcattgcgcaacaacaaggtgcgtggcgcgtggggcgaggcgcagctgcgcaacatcgtggaatcggcgggtctgttggaacatgtcgatttcgacacccaagttgtggtcaccgacgccgatggacatacgcaacggccggatatgatcatccacatgccgggcggcaaaaccattccgatcgacgcgaaagcgccatacgccgactaccagcgcgcatgcgagattccagacaccgcctcaccggaggagctggcccgcaagaacgagctgctgcattcccatgccaaagcggtacgagaccatgtgaagaccctgggagacaaagcctactggaacgcgttcagcgatgctccggatttcgtgatcgcgttcatccccaacgaatcgttgctgcaggccgcattggaaaccgacccgacactgatggacgacgcattcgcgcagaaagtcgcgctgacctcgccgatcaccctatgggcggtgctcaaatccgtggcatacgcatggcagcagcaaagcctgaccgatgacgcgaaaatgctgttcgacctgtcccgagagctgtacgaacggtttgcagtattgggggagcgagccaccaaactgggttccgccatcaccaaaacggtcggcgcatacaactcgttcgccgcgtcgctcgaatcgcgcgtgctggtcaccgcgcgcaaactgcaacgcgtcgaccaaagcaaggtcatcggcaccgtcgacatgatcgcgcccgaaaaaggggatatccgcgagttgtccgctcccgagaccaacgccgaataaccatgtttatcgctcataaatcacccataccgcacggtgaatgacgagccgaaaggataggctggaaccatgaccgaagagaacactttccgcaagacgacaccggttccgacgcatgattccgctgcgggccagtctgtttccgcttcgacggaatccaccgtcgatttcgccatgctcgaaccgcgcgaccagctcaaggcgctgctgcaggccgaaatgaaggacaagccgttctcggaactctcctccgtgctgttcgatcaccgtggagcctccatcgtcggccatatcctgctcgacaccttggaagaggccggctattccgtcgatgattgcgacgcggtcggcgcattgaccgccgcggccgtgccgctggtctccgccatgattcaggccgccgcctcccgtggcgaggatttggacggtttcgtcatggacttcgtctacccgtccatcaagggtccgtccatcaagggcaagcgagtggtgctgatcgactcctggctgtccgaaaaatcgtatgtgcagacctcatcgctggtcaccctgcgcaacggcaacgagctgagcctcgacttctccgtggtggagaacgaaggcgccaaagtgctggccgtcgcctcgctgatcggcggtgtcgacatggtcgacccgaccatcaaggtcatcaacccggtcacttcggaggaatccgaactgccgttcgttgaagtgttcaaggaatccgaactccactgaacaccgagtttcccgccgaccgaccgcaaacatatctgccgttgacgtcgtcgaatgtgcgatgacaagcatgatgatgcatacggatgcgcgggcctttgacatatttgtattgctgttcctatgaaggggagaacgtgcacgatcccaatcccatcgatgttgccgcacaggcatccggcgaaccgacgttccgcgaggtcggcgtaggaccgtggtcgcaaacccatccaggcgaaccacgcccggacgatgcgtcatcccccaattacgacatccgcttcgactccaccctgctcgacgaaggcgaccgccgcaacgtgctcgaccgctaccgctactggacggtcgcggccatcaaagccgacctggactcccgcgggcgccacgatttcgaagtcgccgtggagaactggacccacgatttcaacatcggctccatggtgcgcaccgccaacgcattccaagcgcgccgcgtgcacatcgtcggcccgcacaaatggaatcgcaagggcgcgctcatgacggagctgtaccagcacgtcgaaaaccatccatccataacggaacttgtcgaatgttggaaactgcgcatcgccggcgaaatcgccgccgcccaatcgcaagccgccgccatcgccttccatatgcgtggctccgcagccgcgacggacggcgcttccggcactgccccgaacacaagcgaaaccatggcccaactggaagccttggacgcgaaaatagcagaactgcaagccgcccgcgtcatcgcgctcgacatcattcccggcgcggtgcccatggaaacctaccatttccccaaacgctgcctcatgcttttcggcgcggaaggcccgggcctgtccgaaaaagcgctcgaactggccgatgacgtggtctacatctcccaattcggctcggtccgttccatcaacgccggcgccgccgccgcggtctccatgcacgcctggatcgcccagcacgccgcgccgcaagcctgatcgcgccatcggcacgcggcaagaaaagccgtcgaacgttgctgtaccggaaagatgaccaggtgtccaacaattgggttgcgaaatggaaggcaacgtccgcggccgggttgcgaacggggcacgaaatagggcacacgctcgtcacacagacgcgttactgttagggtcatgcctactttcaccaaagaagaaatcgtgcatttgggcgatctggcccgaatcgcactcacggacgaggaaatcacccgtctgcagggcgatctgaacgtcatcgccgaatccatcaacaaggtccaggaagtcgccaccgacgacgtggaaccgaccgcgaacccggtcccgctggaagcctacctgcgtccggacgtccccgagaccccgctgacccaggccgaagccaccgcaggcgccccggtctccgaggccggcatgttcgtcgcaccgcgcattctgggacaggagtgatatgagcaccaccgaactcgtcaagctttccgccgccgagatggcggccaagatcaaggccaaggaagtttccagccgtgagctggtcgaagcccaccttgcggtcatcgaatccgccgaaccgagcgtcaaggccttcctaaaggtctccgccgaccaggccctcgaacaggccgacgccttcgacgccaagtccgatgaggacaaggcgcagatgccggaactcgccggcgtgccaatcgccatcaaggacatgatcgtcaccaagggcatcgaaaccaccgcagcctccaagatcctcgaaggctgggtgccgccgtacgacgccaccgtcatcgagaagctcaaggccgcgggcatgccgctgttgggcaagaccaacctcgatgaattcgcgcaaggctcctccaccgagcactccgcctaccagaccacccacaatccgtgggataccgagcgcgtgccgggcggttccggcggcggttccgcagccgcagtggccgcattcgaagctccgctcgccctgggtaccgacaccggcggctccatccgccagccgggctcgctgaccggtaccgtcggcgtcaagccgacctacggcggcgtctcccgtttcggcgcgatcgccatggcctcctcgctcgaccagatcggcccgtgctcccgtacggtgctcgactccgccctgctgcaggaagtgatcggcggacacgacaagcgcgattccacctccattccggaaggcccgcgtccgatggtcgccgcagcccgcgaaggcatgaagcgcgatctgaagggcctcaaggtcggcctgatcaaggagcttggcggcgaaggcttccagccgggcgtcatggcccgcttcaacgaaggcgtcaagaagcttgaggaaatgggcgcggaggtcatcgaagtgtccctgccgcacctgccgtactccctcggcgcctactacatcatcatgccgtccgaggtcagctccaacctggcccgttacgatggcatgcgctacggcctgcgcgtcatgccgccggcaggcgttccgcagaccgccgccaacatgatggcctacacccgtgaggccggcttcggcgacgaagtcaagcgtcgtatcatcctcggcacctacgccctgtccgccggctactacgatgcctggtacggctccgcgcagaaagtccgcaccctgatcatcgacgacttcaagaaggccttcgaaaaggtcgacgtgctcgtcggtccgaccagcccggtcaccgccttcaagttcggcgagaagaccgaggacccgatggccatgtacgccatcgacatcaccaccattccggccaatctcgccggcgtgccggccatgagcatcccggccggcctgagcgacgacggcctgccggtcggcttccagttcctcgccccgcagcagcgcgacgaggtcatgtacaagccggccgccgctctcgaagcggccctcgaggaaagctggaacggcccaatctggcagtccctgaagaccccgtggctcgacggactggacaagtaggaagcatcggaggaaagaaaacaaaatggctgaaaagttgatgaagtacgccgatgccgtcaagaagttcgacccggtcatcggtctggaaacccacgtggagctgtccaccaccacgaagctgttctgcccggccgaagtccacttcggcggcgagccgaacacccagctcaccccggtgagcctcggcctgccgggctccctgccggtggtcaacaagaccgccgtcgattacgcgatcaagctgggtctcgccctgcactgcgaaatcgccgaatggagccagttcgcccgtaagaactacttctacccggacatgccgcgcgattaccagatctcgcagtatgacaagccgaccaacggcaacggctacctcgacgtggagcttgaggacggcaccatcttccgtgtgccgatcgagcgcgcccacatcgaagacgacgccggcaagaacacccacgtcggtggcgctgacggccgtatcgaaggcgccgaccactcgctggtcgactacaaccgcgccggcgtgccgctgatcgaaatcgtgaccaagccgatcgaaggcgcaggagaccgcgcccccgaaatcgcaggcgcctacatgcgcgccatccgcgacatcgtgcgtgcgctgaacatctcccatgcccgcatggagcagggcaacatgcgcgccgacgtgaacgtgtcgctgcgcaacagcccgtccgatccgttcggcacccgttccgaaaccaagaacgtgaactcgttccgtggcatcgagaagaccatccagtacgagatccgccgtcaggccgccatcctttccgaaggcggcgagattctgcaggagacccgtcactgggacgaggcctcgcagaccaccgccggcggccgcgtcaagtccgacgccgacgactaccgctacttcccggatccggatctggtgatgctgcacatcaccaaggagcacatcgaggaaatgaaggtccagatgccggaaatgcctcgtgagcgccgcaaccgcctgaagggcgagtggggcttcaacgatctggagatgcgcgacgtgctcaacgccgacgcgctggacctgctcgaggacaccgtcaaggccggcgcttccgcctcgggcgccaagaagtggtggctgggcgagctgtcccgcgaagccaacaacaagggcgtgagccttgaagagctgccgatcaccccggccgacgtcgccgaggtcgagaagctcatcgccgacggcaagctcaacgacaagctcgccaagcagaccgtcgcaggcgtgctcgccggcgaaggcactccggacgaggtcgtcaagaagcacggcttccaggtcgtttccgacgacggcgcgctcgaaaaggccgtcgacgaggcactcgcggccaacccggacatcgtcgagaagctcaagagcggcaacatgaagccgatgggcgcgattatcggcgctgtcatgcgcgccacccgcggccaggccgacgcgaaggccgtcaccaagatcgtgatgggcaagatcaagtgacgttccggcgattgccgaacgttgcctgattgatggcatcgaaaggcgtgcgtttttgcgatgagaggaatcgtaaaaacgcacgcctttctgcattttgttgctttttatctgcttttacatgccttttcgtacgattcacgcgtcggctgggggaggtttcacggggattttgcctaacaaaactcccagctggcgttcagtcgggtacaataccgtcggtatgggtgtggcgagggaccgcgccgagaaacatagggaacgataatcatgtcagagtacgctgaaaccacagcgaaggaacagacgacggaccagcgggcgagggagctgccggaacgcatcgtcattccgcccatcaagggcgagatggtgcacttgcgccccgccaccatcgacgacatcgcacgcatggaggtcattgaggcgtacgtcggcgcatccggcatcaccggcaaggaccgcgtggccgaacgtggcgctgtgaacgcgtgggtgcgtcgttccgtggcatggtccaatggcgaaaaatcgaacgaatccggcgtgggggatccggaatctcgtcgtaccatcgcatggtccatcgtcaccgaagccgaccatgacggcgacggcgagcttgacgcggcctcttccgacaacgtgatcggcatgatcttcctcatcgacatcgacggctgggcacgttccgcccgcatccaagtggtgctcggcaaggactaccgcggccgcggctactcgcgagacatcatgccccgcgtgatgacgtacggcttcgcgccggaaccggcgggcctcggcatgcaccgcatttgggtggccgtgccggaacagaacacgcgttccgtatccgtctaccagtcgctcggcttcgtgccgtccggccgttcgcgcgatgccctgtggaacgcgtcggagaaccgttaccaggacctcatcgtcatggacacgctcgtcgacgaattcgacccgatccgctcgctcgacgcgttcggcatgcacgtgatcgaagacaatccgggcgtcaaggaggcgttgagcgcccgcgaacactcgatcgccatccaactcaactccgtacataagggcgatgcggacgatgccgcagcggcaggccagagtggagacacggcgcagacctccgccgacgagacgtctgccgcgccatcgcaggaatcgcagccgaacgaagcatccggaacggcgaagacggaccagaaggccggcgatgccgacaacaactggccgtacagctcggatgagcgcaaaacctcgaaggatgcttggtggcgcacgcttggacgtggccgcaagcgcgacacggaaggcagacgatgagcgccgaggacctcgacaactacgaaaccgacgccgagctgtccctatacaaggaataccgcgacgtcatcaaactgttcacctacgttgtggagaccgagcgccgcttctatctggccaacaaggtcgatttcaacgtgcgttccgccggccaggacgtctacttcgacgtgcggctgaccgacgcgtgggtgtgggacgtctaccgttccagccgtttcgtcaagaacgtgcgcatcgtcacgttcaaggacgtgaacgtcgaggaagtgcagaaaaccgacatcgacattcccgacagcatgtagcagacctacggaaaaccagtcttcggcggaagccgtacggctggttttccttctatcagggcgattgctgtcggacttggcggtgattttgtgtgcatgcgcacaggtgcgctgtgcgtttccctaccttcgggtagaatatcttcgattttgtttgtaaggagacttcaaagtgacgcaaaagcaatccgtggtcatcatcggtggcggccctgccggcctgactgccgcttgggagctcgtcaaggacggtggctccgaacagtacgacgtgaccgtgctggaagccacccgcgaattcggcggcatctcccgcaccgtcaagcatgacggcaatcgtatggatatcggcggccaccgcttcttctcgaaggacgaccgcatcatggactggtggaaggacgttctgccgctgcagggcgcacccagctatgatgacaagaagctccaccgcgagcatgatatggagccgggcggcccggatccggaaatcgaagacaaggtgatgctcaagcgccaccgcgtgtcccgcatctactggaaccgccacttcctcgactacccgatttccctgagcgccaacaccctgaaggccatgggcttcaagctcaccatggtcgccggcttcagctacctgaagtccatggtgcacaagctgccggaaaccaacctggagaacttctacatcaaccgtttcggccgtaagctctactccatgttcttcgagggctacaccgagaagctgtggggccgtcacccgtccgaaatctccgccgactggggcgcacagcgcgtcaagggcctgagcatcatgggcgtgctgaagaacgccttccagaagctcctgccgaagaagcgcgacaactccgaagtcgaaacctccctcatcgaggaattctggtatccgaagctcggcccgggccagctgtgggaaaccgtcgaatccaactgcgaagccgccggcgtgaaggtcatcaccgacgccaatgtggtggaaattcgccagaaggacggcaagatcgcatccgtcgtgtacgaggattccgaaggcaaccgcaccgaaatggccgcggacgacttcatttcctccatgccggtcaaggaccttgtcaacgccgtggacgcctccgaccagccggctccgaaggatatgaccgaaatcgccaacggcctgccgtaccgcgatttcgtcaccgtcggcctgctcgtcaagcacctgcgcctgaccaacaccaccgacattccgaccctcggcaacccgccgatcgtgccggattgctggatttacgtgcaggatccgggctacaaggtcggccgtctgcagatcttcaacaactggagcccgtacctggtcaaggacgtcgacaacaccgtgtggatcggcctcgaatacttctgcgaggaaggcgactccttctggaacatgaccgacgaggaagccaccaagttcgccatccaggagctcacccgcatgcaggtcatcaacggcccgcaggacgtgctcgactcccaccgcgaacgcgtcaagaaggcttacccggcctacttcgacacctacgaccgcatgcccgaactcgtcgactacctcgactccttcggcaacctgtactgcgttggccgtaacggacagcaccgttacaacaacatggaccactccatggccaccgccatcgaagccgtcaaggacatcaagagcggcgaaacgtcgaaagacaacgtgtggtcggtcaacactgacaagtcctaccacgaagaaaagtagaaaaataaataacgcgtgcgcatacgccctttctccggcgctcgacgtacctttgtatgccttcggcctcagacgggcgtcttcgcacgcgttatttatttttcgcagcgtaactttgatcaagcccatgctttttggcatgggctttttcattgcgattttcattgcgattgcgcggtgcgcgaaccgcacgggcggaccgcgcgtgcccgctttgcgttggtctgggttgcgttgtatggttaggacagttcgaaaaccgcgatgtttcgcggcggacttttcattcgacggaaattttccgcaattcttttttacagctgtcgcgggcgcatgcctgtggaagccaaggaaaggcaactaccagtggcaacaagccctaatctcgatgatatgaaactgcccgagctcaaggagctcgccaagcagatgggacttcgtggtgtctccaccatgcgcaagaccgaactgatcgcaacacttcaagccgcccgttccggcggccaggctccggccggcgtcaccgtgcgcgcgccaaagtccgctcccgccgcagacgctgaggtcaaatcggcaaaggacaagaaggccgatgaagccaagcaggaggaacgccccgtccgtgccaagcaggccaagtccgcggaatcctccgaagtcgcggatgccgtggcagcggtggacgcgttgaagccgaacgatgaagcgccgaagcgtcgtcgccatcgtgacgccgaagccggcgccgacctgctcgccgaactgggccttgacgatgccgctccgaagcaggatgaccgccgtcgccgtcgtgatgacgaccgtagggacgatttcgagccgcgtcgccgccgtcgcgtggcggacgggccgaagagcgaagacgtcgtgcgcgaccttgatgacatcctcgccacgctgccgtcgcaggaagacgccgacgatgataagcgtcgcgacgagaccgaagacaacgaataccgtcacagccgtggacgcaacgatcgccgtggccgccgtatgcgtggccgtgaccgcgattacgacgagcgtgacgagcgtcgcggcaggggcgatcgcaatgatcgcaacgaccgtaacgatcgcgccgaccgcatggaccgcaacgccgaccgcgaccagcgcaacgatcgtatggatcgcgccgaccgcgaccagcatcgcgacgagccgaaggaagacctcgtgccggtcgccggcatcgtcgacgtgctcgactcctacgcgttcgtgcgtacgtccggctacctgccgggaccgaacgacgtgtatgtctccatgggccaggtcaagaagtacggcctgcgcaagggcgacgccgtgcacggctccatccgcgccccgcgtgaaggcgaacgtcgcaaccagcgtcagaagttcgtgccgctgcagtccatcgactccatcaacggcatgagcgtcgaggaagcgcagcatcgtccgcagttcagcaagctcaccccgctgtatccgcaggaacgcctgaagcaggagaccacgccgaacaagctcaccggccgcctcatcgacatcgtggcgccgatcggcaagggccagcgtggcctgatcgtgtccccgccgaaggccggcaagaccatcaccctgcagaacatcgccaacgcgatcgccaccaacaatccggaagtccacctgatggtcgtcctcgtggacgaacgtccggaggaagtcaccgacatggaacgcacggtgcagggcgaggtcatctcctccaccttcgaccgtccggcctccgaccacaccaccgtcgccgaactggccatcgaacgcgccaagcgtctcgtggagctcggccaggacgtggtggtgctgctcgactccatgacccgtctggcccgcgcctacaacatcgccgcgccggcctccggccgcatcctgtccggtggtgtggacgcgcaggcgctgtacccgccgaagaagttcttcggcgccgcccgcaacatcgaaaacggcggctccctgaccatcatctcctccgcgctggtggaaaccggttccaagatggacgaggtgatcttcgaggaattcaagggcaccggcaacatggaattgcgcctgagccgtgagctcgccgacaagcgcctgttcccggccatcgacgtgaacgcctccggcacccgccgcgaggagctcatcaccgatcctcaggaactgccgatcatctaccgtctgcgtcgcctgctgggcggcctcgagccggaacaggcctaccagacgctcgtgccacgcctgaagaagacagcgaccaaccgcgatttcatggcgtcgctcatccagcagagcggcaacgccaccaacggcaactgagtcgtcggctgcaagcgaatctgaaggtttgaggggctgcatggcaatcgccgtgtagcccctttcctatgcgtacgtttcgacgaatttcgtgaaattgaccacttcttggacaacgttgtcaattaaaaaataggtaaaaatacgacgagaaaagataaatggggaaaatatatatggtcgatatgggggtatgagctaaataaaacaaagatatttcatgacagcgttgcgccgtccggataaactgcggcgattccgcgacggtatgtgcgcggtagtgggtatggtaaggaagaaaaagaacatggaactgcagtggggacggtcgattgcggccggtgcagtggattgttggaaaaggggtatgaatgaccaacagtgacaatggtccggtagacgcacgtacggttgcgagccagctcgacgcgaccgatggcgtaatcctcgacatgcttgaaaaggatggccgagccacgctgtcccacctttccgaggcgacaggcctgtccgtgtccgccgtgcagtcgcgcgtgcagaagcttgagcgtcgcggcgtgatccgaggctacaaggcggttatcgacgacgagcgccgcggccttgcggtgaacgcctacatcgcggtcacgcccatcgattactcccaggaagccgagattccagacaagctcaaaaacatcgacggcatcatgtcctgcgattccgtcgccggttcgcccagcttcatgctcaccgttcgcgtcgaatcgcccagcaagctcgaagagctgttgaacctcatccatcgcacggtgtcggtcagcaccgaaaccaccatcgtgctgcagcgttacttcgcgaagtgaccgctgttcggcagatgccgcggtagggtgcgcggtaggcttatacccatgagcgacagcgaacatgactggcttcggccagaagaagaaaccgaatccgaaaccatcatcgacgcgcgcaccgcgcagaacaaccccgaagtggccgatgtggtggctaaaatcgcctcgctgcgccaatcgatagacaacgtcgacaccgccatcgtctcgctgctggcggaacggttcaaatacacgtcgcaggtgggtgtgctcaaggcgcgtgcgggcttcgcgccggccgattaccagcgtgaacatgcccagatcgagcgtctgcatcgcattgccgacgaagccggactggatccggaaatcgccgaaatgtaccgcgaattcgtggtgaccgaggccaagcgccgccacaagcgcatcgccgaaaacgggggagacccgggcgtactcgacgttttcgcctgagccgtccgttttccgcgcgccccgcgcgaacgtccattgccgacgggcatgccgggcactacattaaatgccttggaaagttgtttcgattgcgattgagaggtccggcatgcgccacgccaccgcgaaccgtccatccggtgcccgacgcccgcttgccgcggcgatcgcggtcgccgtcatcaccgccgctcccgtcgcggcagtcggcgtgaacgacgcgatatcggccttgcaacagaatgggcagtacgcggccgatgcatcgcatgatgacgtgatgagcgcctacacctccatcgacaaaccaggccgccttttcctgaccaacagcggatcctccacgtcgaaacgcgttcccaaaggcgttgtcgcattgccgtggaaaatatccgcctccttcaccctcaacgggcccgacgtaagcgtttccgacgtttccggcgcttccggcatgatcggcatacgcatcgccctgcatgccacgaaacccgacgtgaccgccaatctgacgccaatcgtcgccttcaccattcccggacgcgtcggcagtgacgtgaccgccgatgacggcgtgctcgtctcatccgacaacacctcgaccctggtggctgcggtcggcaaaccgggcgaggacctgaccttcaacgcctacgtgacggcgaagcacttcaccatgagctcactgtccatcgccgcggtggaaggcaacgttcagcaatcactgcctgacctgaccaagcgcgcaaccaccttggtggacggtctgaccaacgtcggctcgcaacgcaaccgcaagctcatcgcccaactggaacagctcagagacaacgagaaagcgcttgccaaacagaccatcgccgtacgttccaaagcgcacgatcaggcgttcgacggctacatcgacgcgtacgtgggctcatacaccacgcatctgtccggttcgatcggcaacgccacacagcttcccgccattctcggcaccgcgtccgaactgaacggcgatacctccgtagctaaatccgtggcagacctggccaacgccgtcaacgacgtgagcgccgcataccggcatatcggcgcggccgacgccgtcgacgaggtgattcgcaccatcgaacagcgcggcacatccggcttggtgaacgagctcaccaagcgcgccggcgaggaacaacagcgcggctccaaagactacagtgccggccaatcgcagctgtccgcggccatgatcccgtattcgatggatttcaccgacgcatacacggctcggcttaaggaactgggcgccaccgcaggcacggctggcagctacgaaacccaggcgatcgccgacgtgcgtgccggcatcaaagacaatgagaagctcaaaaccgcgtccgacaaggtgtccgcggcgatgaccgcgttggcggacgccagcgagcacaccggacaggccagcgcattccaccagatcgtgctgcgattcgccgaccagctggattcggatgacgacacgtccgaatcgggcgctgccgatgacgcttctgtgctggacatgttgcgttccgcctccgccagccaatcgttgtgcgcgaaagccgagaaacggcggtcccgtgcgcaacgcaaggccgaacgcgcgcaggcgaagaacaacaccgccgattcgaccagcttggtcgatgacaagaacgccatcagcatggatgatgtgatgagctacgcgggcggactacgcccgtcgttcggcgccgcagcggacaccacgtcgaagaatgtggcgaaagtcgggggagtggacggctcttcgaagaacagcggttccgattcctcttcttccgccgattcgatgtccagttcgttgccggttgccggctatggcttggcgaaaaccggtttcacgccggataatggcgatttgattgacgagacggtcgaattggccgccgctgcggaagttttcgacgatgcgctgcaggccggattgggtgggaacggttccggaaattcgtccgctggcccgcagtacctcctgtccgttccggtgttgtagagcacgcggttggtgtggtgcactaaatccgatagtgctccgttgcttacgtggtacgtttcggggtttttgattgcgatttccgcctccgcttgtgcattcgttgagattacgcccataaaaaccatttttcgcgtacgggtttgtgcgcaggggcaggaatgtacgctgagaacagccgagaacgggataaggacggttctatgcgcgcacgtcttgcgatttagggcgattctgcacggacgtgagcaaaaggggatatgatttcgaccgttttgcctgcgatttataccccttttcgctcacgaaagcatttttcccgcgattttgactgaatatgagcaaaagggggcacggttagttgcagacagtgacgggatatacgaggggcctctccttcatgcaaaggaaaggcccctcgtatgtgggtgaagtgagcggctgcgctacaaaagccgctggcggctcacctcagagactcacttcttcggtttcttggccggcggttcgcctagctcgctttcggcgaccgtcacatcggcggcctcgttctcaccctcggcggcagccggtgcggtgaaggcgatcggtccggtcacgcgaccagcttcggcgatatcgcccagcgcggcctcgatggacccgcgcacatcgtcggcaacggcaagcgtcacagacaagatcggggtcttcatcgaaaccttggccttcgacttgatgccacgcagcgcggccagagcctcaccggcatgagcaagcagatcggcggatgcgtcgccggcggcggccgcgtacacgtcggccacaggccatgcggcgcggtgcacggagccctcgccctcatgcatccagctccacacctcttcggtggcatacggcaggtacggggccagcaggcgcgcgaacgcatcaagacccaggcccagcgtggtgcgtgcggacttcaccgcggcctcgctcggcacgttgccggtggaatcggcggtgccgtaggcgcggttcttgaccagctcgatgtagtcgtcgcagaactgccagaagtagttctcgatgacttccagagccttggaatgctcgtagttgttgagatcgtcggtggcttcgcggaccacggcggccatcttggacatcgcggaacggtcgatcggctcggtcacgtcggccgggttccatgcggcgactgccggagcgcccacgtgatggttctcgtcctcacgtccgatggccagagcgaacttggtggcgttgagcagcttgatggcaagacggcggccgatcttcatctgaccctcgtcgtacgtggcatccagacccagacgggcggcggcggcccagtaacgcaccgcgtcggcgccgaactgcttgatcggcttgtccggcacgaccacgttgcccttggacttcgacatcttcttgtggtccggatcgaggatccagccagacagcgtggtgttggcccacggcaggcacttgttctcgagatgcgcgcgatccatggtggagaacagccaggtacgaatgatgtcctgaccctgcggacgcaggtccatcgggaaggtggcattgaagatcgcctggttctcctcgcccggctcctcccagcgggtcacgatctgcggggtgagcgacgaagtcgcccaggtgtccatgatgtccggctcggcggtgaagccgcccggcacgtcacgctggtcctcggtgtagccttccggcacatcgtcggtcgggtcgatcggcagacgatcctcgctcggggtgatcggatggtcgtaatcggcggtgccatcctccttcaccgggtaccacagcgggaacggaacgccgaagaagcgctggcgggagatcagccagtcgccgttgaggccgtgcacccagttctcgtagcgcacgcgcatgaaatcggggtggaagttcagctccttgccgcgcgcgatgagctcggcgtttagcttctcgtcggtgccgccgttcttcaggtaccactggcgggaggtgacgatttcgagcggcttgtcgcccttctcgtagaagttcgtcatacgcttggtcggggtcggctcgccgtccagatcgccggcagcgcgcagctcgtcgacgatgaccttacgtgcggagaacgtggtcttgcccgcggtctcctggaagatacgcttgccttcctcgtcttcgatccaatccggggtgtccatgacgatgcgcccgttgcgctggatgatggaacgcagcggcaggttcagatcgcgccaccattcgacgtcggtcacgtcgccgaacgtacagcacatggcgatgccggcgcccttgtccatttccgccgccttatgcgccagaatcggcaccttcacatggaacagcggggagtagacgtactggccgaaatactgcttgtaacgctcgtcgtccggatgcgcgatcagcgcgccgcaggcggccagcagttccggacgggtggtctcgatgtagatcggggtgccgtcttcgaaacggaaggccaacttgtggtagaagcccgggtattcgcgcgattccagttcggcctgcgccactgcggtctggaacgtcacgtcccacaggcccggggcgtccttctgatacgcctctccgcgagccaggttgcgcaggaacgctttctgggccacgcgctgcggatgctcgccgatggtgtggtaggtctgcgaccagtcgatggacaggccgagggagcgccacagcgcctcgaactgcttctcgtcctgggcggtgagcttttcacacagttcgatgaagttcttacgggagatcggcacctggtccttggcgtcgatcttcttgccatcggtgccttcgaacggcggcacgaaattcggatcgtacttcagggaagtgtccacgcgcacgccgtaatagttctgcacacggcgttcggtcggcaggccgttgtcgtcccagcccatcgggtagaacacgtcgtagccgttcatgcgcttgaaacgcgcgatcacatcggtatgcgtgtaggagaacacgtggcccacatgcaggtggcccgaaacggtgggcggcggggtatcgatggaatagacggccttgcggtcgcgggtgccctggaacttgtagactccgctctcgtcccagacgccacgccacttgtcttcgagaccgtccacgccgaccctgtcgggcagcggcgtgaggttcgcgttgatggtgttatcttggctttcagtcatagtcgctagtctagaaagcgaatgtgacaactgccgtcgtatcagcgcctatcgaaccgaatgccggaatcgcaggcaaatcgcggaaaatccacataaaaaaccgtggaaaaatcagtgcagcgtcaatctgttcaacggcagcagacggtcggtcagattcttcggatacccctgcagcccatcggaaacggcaaggaagttcttgcgcgtgtacagccagtcgctggccgcgttctcgctgacggcgcgcgcgtaatcgcgcatgcgggcctgataatcgttgtcgttggtcgcggccatggcattggcgtaagcctgctgcgcgtcgccgttctcgaaatggaacacggactggccgttgtcgaagacgcttgcgtcaccttcgtcgctcatggtggtcagcgcgatgttataggtgccggcgttcatgcgttccgtcacgtccgcggcggaatcgagcacttccagattggtgttgatgttgaggttttcgatggcggttttcacgtcgttgccgatgctttcgtattccttcggcaccagaatgtcgattggcgcgatgtagttcactccgaaatacgtgcgcatccgttgcccctgttcgaggttgtagaggtacagtccgctcaggtcctcatacccgtcttccagcgggctgatcggccctcctagcggcgcgtacgcgtcgggcgcgttcttggcgatggtcttcgcatcgatggcgtatcgcgtcatcttgcggatctgctcgtcggagaaggggctgttgttgtcgttgttgaacgcgagcatcaccttgtcgaagctgatgccgctgtccgcggtaataccgttggttttgcccagttccgaggcggttgaagcgctcagcggcagcgccatgctgattttgccggctttcatggcatcggccatggattcctcgttggcgtagtagtagagcgtcacttgcgatgatgcggcttttttgccccaatacgagtcgttgcgttgcagcgcgatttgcgattggtccgcggttgacacggtgaatggtcccgatccgaccgccgatttcgcatagttggttttgctttccgcgtcgtacacgacgcctgcacggccggccagcgcgcgcaacagccgcggattcggcttggcgagcgtgatgaccaccgtattcgcattgggattggtgatttccttcagatcaccaagctggtcggctcccacgtaatggttgttgacggcgttctgcagcgaccagaccacgtcggacgagtcgagtttgtgcccattggcgaacgtcatgccgccgttcaacgtgaacgtgtacgtgagaccgtcgtcggaagcctgccaggagctggcgattcccggctgcagcttgttggtttcgctacgtgacaccagcgtttcgtatacgttgccgagcagcgcttgctccacggcggtgccttgttcggtgcggatgtcaagcgatttcggcgcattgccttcgatgccgacggtcaccgacgagtcggagacgagcgtgccgaaggatgtgatgggattcttgcggcctgtcagcgacagtcccagccacagcagcacactgagcacgatcgcgacgccgaagaagatcagccagcgcgtcgcctcggctttcagattacgtttccgcccgttttcatccatgcacccgagtctagttgacgcgtgctacacgcccgatggccgggtgcgattcgacggagtgccggcgcggcggctggcatgcgtcggaatcacgcggcgaacgcgctcggacacgtgtcgttgagggggcagtcggcgcaatccggttttcgcgcatggcagatggcgcggccatgcaatatcaaacggtgagacagatcggtccattcttcgggagggaagcaggcggtgacctcacgttcgatggccaccgggtcaggggaggggctcgcccagtcggaccgccaccgcaatcgcccagtcacacgaatcacatgcgtgtccacaggaaaaccgggcacgccgaacgcgttgcccaacaccacgttcgcggttttgcggcccacgcccggcaggctgaccagcgaagccatatcggctggcacctcgcccccgaatcgcacgcacaactcatgcgacagcccgatgatattgcgcgctttcgtacggaagaagccgatggtgcggatgatgtcctcgacgtgctcgggattcgcggcggcaagctccgccggaccgggatattcgccgaacagttccggcgtgaccatgttcacgcgcttgtcggtggtctgcgcgctcaacaccgtagccaccagcagttcgaaaggagaattgaagttcaacgcgcatttcggatcgggaatctccacgcacaactgctcgtattcctgatgcatgcgcgcgatccgcgccttcttcgattcccgaggcatgcctcccagcctacccctcgcatgcggacgaacgcgggaaacctgcggaaacgtcgcaatcggcaaaaacagcgaaaatccatcgaaaaaacaacgggaaatcagcgaaaggccaacgaaaacaaacggaacccgtcgaacatcaacggaatgatcgcaagaaaaagtcagctttcgccggattcgccgtgagccgcatccttggccgcggcctcatgctcatcctcttccggcggatcgaaacgatagccgacgttgcgcacggtgccgatgagatgctcgtactcgccacccagcttggcgcgcagacgacggatatgcacgtccacagtgcgggtgccgccgtaatagtcgtagccccacacctcctgcagcagctgcgcacgcgtgaacacgcggcccggatgctgcaccagatacttgagcagctcgaactccttgtacgccaagtcgatcggatggccgtgcagactggccgtatagccatccgtatccaccaccaaatcgccggaacggatcagaccatcctcgttctgcacgccctgctcgccggtgctagcggccgtgctggccggcgcattgccccgttcggacaccagacgcagacgcccctccacttcggcgggggaagcggaggccaccaccacatcggcgatgccccactgcgaattcaccacggtgaaaccaccctcggtgagaatgagcacgatcggcgtggacagtcccgacgcgtgaatcagacggcacagcgttttggcggtggccaggtcgtcacgcgcatcaagaaacagaatggtgttctccggcatcttcaccaggctggccgcatccatcggcaacacgcgcacgcggtgggaaagtagcaccaacgaggggagaacggtagctggatcgctagcgaacgtcataagcgtaagatccgtcacgtcagctcccttttgttctaaactgatgccgcgattgtacacgcaaaatgtattatcggcgtttcatcgattgtaactgaagtatgtggacacatacggctacatttattcatattgcatacgtattgaccacaatatgaaaagggggtccgagatgaccgctccgcaggccgtttcccagcaaaacccgtcgaaggtcgctttcggcaaagtattggcgatccagatcgtcgcgtacgtggtattggtggcgctcgcgctcgttcccggcatcgcatacggcgattccgccaatcccgccgtggtgccgttcaccatcatcggatcgctggcgatgatcgcgctgctggtagtgttcagcccgttccgcgacggcaccgccggacacgtgatcgccgtcatcgccggcctgctgtcggtggtgtgcgccacgacgatgacgctcggacgggcgattttcgccgccgacgcgaccggcggcaaggacttctccatggaggacggctggatcgccggcgtcggcggcctgctgatcctgctgatcgtgatctccttcggacgccagatggcccgcgaaaaccgcacgcacctcatccgctcgctgtcgcacagcgtggtcgaaggcgttgcgatgatcgccagcgcgggctggtgcttcctgccggtgctcctgccgacaacgcattccaaggccgccgccatgtccgctgcctccggagccacggtggacatgttcagcaacgtgaccacgacatgggtcgtcgccgcgatcgtgacggtattggtggccgtggcgctcaccgtgtgctcgtacttctggcaccgcgacgccgaccccgagccggatgcgcgttcgccgtggatcggcctcgcactgctgccggtcatgctgaccggtctcgcagtcggtctggcggcgctcgccatcgtcgtgctgtaaacggctgttctaatgacaaagcccgtaatcgcaatgattacgggcttttattatgttggattggcagtcaaccgaggaatccgagatgctcgaacagcaccttcacgccgataagaatcagcacgatgccgccggcgatctgcgcgggcttctgccaccgcgagccgaacgcgcggccgatatacaggccggcggcggagaacaggccggtggtgatgccgatgatgaccaccgacagccagatgttgagcgtcatgaaagcgaagctcacgccgacggcgaaggcgtcgatgctgcaggccacggcgagcggcaacatgtgccgccaatcgaattccgcggtctccttggcgttctcctcgtcttcttcgaaggcttcgcgcatcatattgccgccgatcagagcgagtaggccgaaaatgatccaatggtccacggcggtcacgtatttgctgaacgtgctggccgcgaaatagccgaacagagggaacagcgcctggaatccgccgaaccacagggcggttttgagcgcatcgacgccgcgaagcttcttgacggtcaggcctttgccaatggagacagcgaacgcgtccatggacacggacacgccaataagcagaatctgaatgagcatagctggtgaaaaggttcatcccgccggtctccccacgggatgggcctcgacggattgcgttccgcctacgcctaggagtaccgacacagaactgccgcacgcggatgtgatatgtgacgtccagcgggctttgaattcagcgaatactgttcgcatgccgaaaattacaagagaccactataccgcggtacgaagaaatcggacgctttggtccgttggactccccgcaacggcacctggcctccactggctggaaaagagaaaaagcccactgtcgggggcagtgggctttgacataaaaaggggagaagcgatcacttctcgctatcagcgaggcgcttgcgggctgcgacgatttcctcctcggccttagcggcaccggtccagtaatcgcccggcaggacttccttgcccggctccagagccttgtactgctcgaagaagtgcttgatttcagccttgtggtactcggaaacatcttcgacatccttgatgtcgtcgaagcggacgtcagccggcacgcacagcaccttgtcgtctccgccggcctcgtcgaccatgtggtacaggccgacggcgcggcattccaccacgcagcccgggaacacggagttcgggatcatgacgagagcgtcgagcggatcgccgtcctcgcccagggtgccgtcgatgtagccgtagtcatccgggtagcccatggaggtgaacagggtgcggtccaggaacacgcgaccggtctcgtggtccacttcgtacttgttcttggaaccgcgcgggatctccaccacgacgttaaaggtttctgccattgttttctccttgatcgatatgatcagcagtagttcgttacttaggatacccgctttcgcgccatgtcggcaccattttccggatacctatatgaatggtgctcagtgctggggagataaggcgtgatgcgctcgctggtcaacatctttttggccgattgtgattgactatcctgccttggaacgttggaagaacaattccgtaggtggttttgctcttccgtaggtggttggctctggtatccctgcggcaaaaaggcttgatttcagccattctgtttgcgtggattgaccggagagcacctacggaatcaaaaaaccacctacggaatgcacaaagccgggttgaaaacgtgagaaacgtcttcaacccggctttgatctatgtgttttgcgctggctggatgctaggcagagtgcctagcatccaaactcactcagtcctcgatcaccgtcagcacgtgcgccacgtcggcccacggtgccagcgaaacgtagttgtcgtaaccccattcgaagtcgcggccggtcagttcgtcatgcaccttgagcggcttgtcggtggcgaaaccgaagtccggcagctcgatgtggacgatggactgatgcgcgttgtggccgtcgaggttcaccaccacgatcaccgtatccggcttgccggtaccggtaagctcggccggggtctggcgcaggaacgcgatgacgcccgcgtcgtcgctcggcaggacgtgcaggttgtggtagctgcggcatgccggatgctcggaacggattttgttgagcgaggtgagcagctcggagatgccgtacttgtcggcctcgtcccaatcgcgcaccttgacttcgtacttctcgttgtcgatttgctcttcgaatcccggacgctgcttgttctcgatcagctcatagccgttgtagatgccccagctcggagagcccatcgcggcgagcaccgcgcgcaccgcgtgaccggcgataccgttgtcgcgcaggtaggcggtcatgatatccggcgtggacggccagaaggtgttgtgctggtagaaaccaccgtcgccgttggtctcctccaagtactcctcaagctcctccttggtgttgcgccacgggaagtagcagtgcgactgcgtgaagccggcatagctcagcgcgcgcatcatgcccggacgggtgaacgcctcggccaggaacagcacctcgggatgcttcttggtgaccgcggcgatcacatcctgccagaaccgcaccggcttggtatgcggattgtccacacggaagatcgtcacaccagccttgacccacaggtccatgatgcgttcaacctcggcctcgatgccttccatgtcggcgttgaaatcgatcggatagatgtcctggtacttcttcggcggattctcggcgaatgcgatcgttccgtccggcttggtgcggaaccagttcggatgctgcttgacccacgggtggtcaggcgagcactgcagcgcgaagtcgagcgccacttcgatacccagcttgtgcgcgtaatcgcagaacgccttgaaatcgtccatggtgccgagcagcgggtcgacggtgtcgtggccgcccagctcggagccgatgccgaacggggagcccgggtcgaacggtccggccaccagcgaattgttgcggcccttgcggttggtcacgccaatcgggaagatcggcggcaggtacacgatgtcgaagccttcggccttcgcgcggtcgaggccggacagcgccgtcttcagcgtgccctgcacgatcttgccgtcggcgtcgaaatacgcgccttcggaacgcgggaagaactggtaccatgcggcgaagctcgacttcggacgctccacgcggaagcgctgcggattcgacgcgctcaggccgtcgcgcagcggattggtttcatgcaggcttgcgattgcgtcggtggtcgctgcggcaagacgcgcggtcgcgtcgagcgacttgtcggcaacggccttcgccgcttcgcgcagcgtcttcttgtcgtcggcggtcagcttggaatcgcgtgcgccagcccaacgttccagcagctgcgcgccggattccagcgcgttctccacatcgtcgccgacctcgaccttgatttgcgcgtcgtgcagccaggaagcgtacgtatcctcccagccttcgaccacgatgtgccattcgccgagctgcttcttgacgtcggcatagccatcttcccacggcttcaggtcgctgtggtcgccgatcttgaccatcgcttcccagcggtccaggcccggattggtgcaggtcatcgggaagcgggccttctcggtgccgcgcgtgttgcgcacggacacggtggcaccggccttggtgcggccttcgatgaacacctgcgcggtgaccttgaatgcctcgccaagctccacgcgagccgggtacaggccgttttcggcggacggagtgatgtcaagaacgtttacgcggccgaactgttccgggctggtgcggttgatgataggtgctggagtttcgccgacggttcgcttcgttgcggttttcggcttggaagtgcgcttggtggttggttttttggttgtcgtctttgcggttgatttcgcggctgtcctcgttgtctttgtggccgctgccttggctgttgtctttgctgttgcctttgtgcgcggtgtcgcgcttgatgatgttgcttcattcatatagccgattatagaggtagttgtgttctttttgtgatttccctttttcgtaacgattacggcgatgcggctacaagtactttcttcaaatacttttggtaaagcgttttaatacatggtttgcgattatgttcgattatgaaggctacagcggcatgaccatacgttgtgtgtgccggttgcgttcgatatgtatggggactttatataaaaggagcgaaacgtcctggggaaaacaaaaaaccggaaaccaaaaggtttccggtttcaattggtagcggggcatggatttgaaccatggacctctgggttatgagcccacgttctctcatattgttctagtttgttattgtctattatatagtgcgacaatggcttaaaacacggcattttgtttgttccgtattggttgtgattggcgagtttgtccaacttttgtccagattatttgtgtccagatttgtccaaatttggtagcatagaaccaactgttgaaggagtaggcgatatgacgaagcgggaaacatccggacagatcaccgaattggagcgaggacggaagtattcgattcgtgtccgtctcgctccagacaatgaacataagtcttggcactggtcaaagtcgcgtaaggtctatgggaacaaagccgaggccacagcagcgatggttgcctacaagcaggaactcgaggatgagcgttccggcaagaacgtgacggtagcggaatacgctgacatgttccagtccaatcgcaaggctctcggtacggtttctgtactcactattgagcgggaccaacatgagattgaccgaatcaaaaaatatcttggagagataagggtaatcgaccttacctcgcagcagattgagaatgcctatttacgcatgtcggaacaggatggagcttcgccagacgccattcacaaggtccatatgaaattatcccagatcatgcgcaaggctttcttggatgaactgattaaccgcaacccatgtgatgcggtggaaggcatcaaacgtccaaaggtgagccaacagaagcgtagggaaacgcgaatcaccaaggagcaagccttagcgttcgttcacaagatcaagcaagagccgcaggatggacgaatcgtggctgtctggttgggcgtggccacaggtcttcgccgtggcgaagcattggcgctggtgtgggaagacgtggatctagacaacgcacgactgcgtatacgcaaacagctcggcaaggagaagattctgaaggatcccaagactgccaagtctcgacgtaccatttccatcgataaacagacagttgaatttctgaaacagtggaaagctcgccaacatgacatgttcagcgcagcaggtgttgaacagcaagatgattcaccggtatgcagcaacgaattatgcggcttcttggatcctgacaacttcagccgttggcgtcgaaaattttacgtcaaagaaggtttggcgcactatgccaatgagactcgatatgttgataagcgcggagtcgaaagggtgaaacagactggctacgtcggtcctaatttccatgcgcttcgtcgtgctcaggctacactacttgttgccggaggcgtggatcctaaaacggtacaagcccgtcttggtcacgagagcctgaacacgacgttgaatatctatgctgaggaggtaggagaaaacgaccgcaaggcagctgactttatgggagagctgcttcgcagccaatgttagtgacctactctccgtatggtcccatgaaacgggatccgttgaagtgcatcatatgatctggtgtgtcggcgcaccatgcttcggtttcccatgctagtagggcgaggtacttttgcatggtcttgcgatcaggaaagcatgagaccaatacgattttgccccactgctcggagaacagttcgtgcagttcattctttctggtcacgtcaaccgggccgtgagtacttgcagcttccatgagaaatagccagccacgttttgcatcccaagcgatgacgtctggcgctttctcgcgagccttaagactgattccaagttcatccaacaatgcggggtctacggcaccatgcttatggtcagtatcgtcgatataagcgacttggcatccgggagcaaagcgtggcagcatttcctccaccattgctttaatcagaagagactgaccacttggagatagactcagggcagcacctgaaggaagaatcacaggtgtttttggcatattcttccgttcctctgcaagagattgataggattcatgctgctcgaggaatctcttgagaatcaattcgaactcggactcgccgcgatgcagcagcatattcaacgtgtcatttgttatacggtagttccattttggagaattgattgggcgatcgggtcgatcggcattctcctccactaattcggcgattacgaattgatggagcgtaaacctgcggatggtttcacgggtatttggtttgtagtccacttcatagtagtctctaatccaatccatgatggcgcgggttcccaacatgggattggtagcctgctgccagttgtctccgggcttgagctgaagtaaggcgagcaatgtcattgcgctacgctcattttgttggtccttgccaactccaagttcgcgcaatgtgtcaatggcatcagcaatcagctggcttttgtccatgaaaataaacctccaaccgtttgatcaatcaggctttggcttgcgtaaatatcagtaggtagcagacgtgaaagctggataagctgttccttggatggacaggggagttgccgtagatcagttgcgttgacttgggtgctaccggaaatctggcggtaccagttgtcgatgatagttgtggatagccagagcgttaacccgcgtgcgacatcactatccagaggcattgtcctacgcgatgtgccctgatgaatgtaattcaacttattgtcggctgcaaattctacgtcgctgctgaggcacgaagcatgaatgcgatgaagctgctctttggctgagaaccgattgacaagacaatagtcgccagccggaagcaagacattgcgatcggttgcgctactggttacccattgctctcggtcacattcgataggatgttgggtcctcagcccattttgattatcggaccagtataggggatatccgtccacgggtttgttttccgacagtagatcacggttccggaaccacaccaatttgccagtcgatacccatagtccttgggcttccaaagacttaaattcggatagacgagaatcttgctgctgtatgcaaagaatgcgatctcttccaagggtgattgagtctagggaagcctgcactgatggttgtgaccctaatgagcgaactggcgtgatattgccgtaaatagtgacactgcgtgtttggggacgcttggataccctaagcagcatgatttcctgaagaatagacatgtccttaaagtgttcctgccgtgaaccgtataccgcaattacgtcaaggctgcattcatcgagtagccattttcggaaatctttaaagtacgcaccattcatccacgaacggggaatgattgcgacgcattccccgccctcggaaagcgcctgaactgcaatcactaaaaaagctgcatagaggttagtgattttcaattcgcctctactggtaggaatggtgattggacggatctttttgtatggaggattaaggataacccgatcgaactcagcattgagtaaaacgttaaacaccgatgtatggatgacctttgtcctatcgcaaacttgggcgagagagagctcggaagcagaggcgagcttgtcgtcctgttcaatggctaagacgctgctgccgggggctgcttgacgtgcagtcaccgctcctaagatgccggtgccggaaccaagatcgagtatgtgaacgggcttatcagagtgagtgaagagactcgcggcttgttcggcaactggcatgggagtaagaaactgttcccattgctgctgctgttctggagaaagcagagtggcggctttgttgcgtatttcggcgatggtttcactcatgtggttaaggataaccggtcccgtcgtcgtgcgcagaaaggcccggcctccttctggctatttgcctaagaagaaaaccgggccgaagttttatcggcgacgtttgggccagctgatggggataccgccattgacggtgaggtagtcggtcaaagccttttggctgacatagtccttgttgcccactcggattgatggcagcgcatccatcattagacgggccttggaacggcctacgccaaacatggcttggagagctgcgacatcgaggaatttgagctgtatgtctggttcaagcttttccatgacgtgcctccttaggcaatgcgaaatacgaattccaatagctccagatgacttcccgacagaaactgacttgttttgttgcgaactcgagcagatcggggtagtcggcttcgcaggccttcagaagatcgaagtatccgtgaatgttctcttcctccaccatcttcacgatggacatggcgtcggcctgattaccctcgattagtgcgatcttcttccagtccgcaccgttgaactcgagcacgtcttcggggctatacggggccttacccggatcatccatgtggattaggtaccgggccattcctcgggggttctccagccgcaggataacctttggtccattgaactgttcaaagaacctttcggcattctggcgtgtggtcgtgttggcccacatggcgatcacatggcggtgcggtttcttcaactcgccggtggcgatgtcggcaatgtcctgatcatgtacgggagagacgaggatttccagaccgctgatcttcatccggtcttcccaatcgtcgggacaactatcgggatagattagaccagcccagtaccggcctttttcgctcgtggcttttctctgatgagtcattttgtccctcatccctcatcccttgtgggggcgtcgtcgtagtagcccccacaaattgtccgttgagtgtgagcgggctctcgctgtcgcttcgcccgttcgtcatcattgccgaggcgtcgcagtgactgaatgtcctgatccgtcataaacggcacgtggatatacttcaccgtgttggattcgctatcccaaaggtagccatcgcctgggcggttataactgatctgccatggacgggcaccacgctgcacggcgtcctcgccaagggccatcacagcctcgctcttggaattcagacgcaacgctaacgtggtaagcagcagactgcgataggggagactggtgctcacgcgtgggttctgcgtggccacgaccacggtgcagttcaatgctctagaccgagacagtgccgatctgatggactccacgcacgcgtccgaagtcttcttatcagaaccggaacggatgagatcggcggcctcatcaatgacgagcaggcggtgccgctcgcgctgatcatcgacggtgcggacttgcccacgccaacgttcggctcgtgcatccacgtccgtgttgaaagcggagagaagatcttttgcttcttgcaaggagtaagccttgttatcgagcacggcggcgtagttttcggcctccatgccggacttcaaatcaatgaaccagacttccccgccagcctccacttcttgcctgatgatgtttgcgatgacgctgcccttgccggaattggattcaccgatgatggcgaggtgggcggtgcggggtatcgaggccatttgctttggcctcgatacctctgcacctagctcataccgttgaacggcattttgtttcttaagaagcattatcggagctccttcagttttgcgaaggtgaccttgtattgcgctgatcggaagagcctgcgtggaatgatccggacctcggtgggctggaatctcattcccaatcgtggagctacttcgtccgcccatttgttgattccctcgtcgctcgtgtaagcggctggaattgtgaaagtgattcgtgaggggttccagcgccattccacggagcagcatttgatctgttctttcgtgagggacatcggcttagcagatagtgcggatgccatgagactattgcgtagagcggataccacgtatgctgcgaccccgataactgcaataacgcaggcgattgcaagaatggcagccggatgttgatgtactaaggtgatgagtgcgtccatttgtcctcctcgtggacttaagggtttggattgtggatgtggctggagggcgtccgacaacgtcctccagcgctatatgtcagatgccgagggtctgcttgatcatggccatttcgagcttgctggggaagattctgccgatcgacattccgtcgagcaggacttcgatgcactcgtagcggttaccggctttgctgataccctgcacgatttccgcgtgcagccgtggtgtctgttcgtctgccatttcatcacctcctttctgcgttgcgtttgcgtgtgtaattccatccaatcgcatgtctgaaagcatgcattcagaaaggtgtagaatttacactttaggttttgctttctgttggaatagcaacgttttgaggatttggagaattatgcaaattgattctgaaatgcttgtagaagcattaaagaaatctgccctgaaacagggaatgacatacaaacaacttggacgccgactgggcttcagtgcggataaagccaagaatgtgtttaccggtcgaactcggctaagtggtgatgatgtgttgcgtattcttggggatccgcaatacgacttaccgcgattgaagaaatatctcccatactggagattgcgtcgagcaatagtagacgtcgacagaagtagtgacatcattgatgctgtcaatgagagtgtgatgatgtttcctcgtcgtattcaaggatctgctatgcagacgaatgaccatgaaccgttgagtgaacttgctcgagatgttatggatgataaggaatggtgggtgctaaggaatggctggatatgttcggcagagattaaaggagctctgattagctttgctccaatcgcaccggactttgtgacggctgtacgggcaatgaagaagatggggtggatttatcgcaatggtcaatcagtgcatgctgattgggaaaaaatcaatggaggggcgaccggacaaaaagcctcaagcaattgtgaaaaacagttgcgtgcattcattttggacgaaaaaaacggttttgagctagatggtgactttcgtcaatctgttagcggctccgctatccaagaaattgaagtcgatcgtgccgcccaactagaacactacgttgacgaagttgaaaacattgttgagaattggccacgatataagttgcccgaaactgctgacagatatggcatatcggttaaggctatgtatcaaagcaagtttgattatctagaaaccaatgttcttggaatgtgcggtatctacgatgagttgaaagaagaaaaaatcgatattgatcaagatgtggaacgacgatacaaacgaattatgtctgaggacggtagtcattatcggtactcagtgttgatcgatcccatacttgcggtgaatgatcggcgtgggcatttagctaatcctacgcaagatgattgggagagatacagcaaccttcaaagcagtggacaataggttgacgtgttgattccgtgtgattgcacttggtggatttgtccagaatttgtccagatccacgactcgcgaagacgtgatggaaaacgagaaaaggctaggaaccacatgattcctagcctttcaattggtagcggggcatggatttgaaccatggacctctgggttatgagcccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcaattggtagcggggcatggatttgaaccatggacctctgggttatgagcccagcgagctaccgagctgctccaccccgcgtcggcttgccttcattgaggcagctctaactactttacggatgttggctaataagtcaaatcggcgtgtcgcatattgcgttgctagtgaaatcgcatatccgataacgcgttatccgtttttcgtataacgctgcggaccgtcgatgaaaaccgccgaatacgccatatccgggtccgcaccataataggaaacatgcctatcaagattcccagcggccttccggccagagacattctcgactccgagcgcatcttcgcgcttgaaaagcccgaagcggagcgccagcgtgtgcgtccgctcaagctggtgatcctgaacctcatgccgaagaagatcgagaccgaaacgcaactgctgcgtctgatctccaagagcccgctgcaggtcgaggtcgacttcatgaagacctccacccacgaggccacgcacgtgagcgccgaccatctggtgaagttctacgagacgctcgatgcgttcaaagacaactattacgacggtcttgtggtgacgggagcgcccgtcgagcacctcgatttcgagcaggtcgactactgggacgagttcaagcagattctcgactgggcatccacccacgtcttctccaccatgtacctgtgctggggcgcgatgggcgcgctcaactatcggtacggcgtgcgcaaggagttgctgccggagaagctctttggagtgttcccccagtatctgcaggacgaatactgcttcctcaccaacggtttcgacgagatctgcctgcaaccgcattcccgcctggcgggggtcaacgagggtgatatcgcccataatcccgagctgcaggtgctcacgtggggtccgaagtccggcccggggctcatcgccacgcgcgacttctccgaagtgttcgcgctcggccattgggagtatggcaagtacacgctcgccgaggaatacgagagggatatgaagaagggcatgaccaacgtgccgttccccgaaaactatttcccgcacgacgatccgaagctcgaaccgctgttcgcctggcgcgcccacgccaacctgctgtggcgcaactggctcaactgggtctatcagaccacgccatacgatttgagcgaagtaccgcagctgcgcgaggagaagcgcctcggcaccgaccgttcgatccggcacgagcccggttctccgcgtgtcgacgcgttcacgccattctcgcacgatggatacggtgtcattcgcggctgatttcacgaagatcggcgagtactgacaagtattggcgattgtcccacgattgccgcttttgcgcggtgtcgtgggctttttgcgcggtttttgttgcctgctgcgacatcgtttcattttcgctgtcatatattatggtgcgatatgttaagtaaaacgttttatcaagcagtgttgtaaacgatgtctattttggtgtgaatgggggtgaaataggccgaatcgacaacggccgtggttgtgtctaatagtccccgcaacgtgcgaaacgccggttttcgctatacggtagtaggggaaagctcccggtgcggcatgttgtctagccacgggctgataatcctttgcagccattcggggctggtatgcgaacgcgtttatgggcgcgttaacatagaacccgaaggatgttctggtttggtaaccggaatgtcacattcgactcagctgttgggctagactaacagctgacacaagagcaggaggcgtgaatgattagtgcattgggagagggcatcatgaccatcgccgatggtccagagatgccgagcatcaatgacttccttcccgatccgtttgtttttcaaggcacgccgttcgccatcaaccgcatcatcctcgttcgtattcttgcgaccgtcatcatgctgctggttctcggaattacggcaagccgtgcaaagctcatccctggccgttggcagggcgcagtcgaatggctgatcgagtttgtccgcgacaacatcgtctatcaggtgatgggcgagctgcgtggcaagcgttatgtgccgatgatcaccaccgtgttctgcacgttgctggtcttcaatctgtgcggcatcatcccgggcttcaacatcgcggcaagcgcgtccatcacgctgcctctggtgttcgccatgtggtgcttctgccagtactggattgccggcatccgtgaaaagggccttggccacttcctgagggacgagatcttcccgaagggcgttccggccccgatctatattctgctgtccccgattcagctgcttgagctgctgattatccgcccgttctcgttgacgatccgactgttcgccaacatggtttcgggccacctgatccttgcgttgtgcctctcggccacgcagttcttcctcgttgatgtggtgaacaagctgatgatgccgttcggcatcatcaccttcgcggctggcatgttcatgttcctgttcgaggcgctggtcgcctgcctgcaggcttacatcttcgccatcctgaccaccgcatacatcaatatgagctatccggagatcgactgaccgccggctttttaagtgttgcttcttgtcaagcaataaccagaaaggaaacaatcatggatatcgttaccctcgctgaggttgccggcaacctgaacgtcgttggctacggcctcgccgccatcggccctggcatcggtctgggcatcctgatcggcaagaccatcgaaggcaccgctcgccagcctgagctcggcagccgtctgcagaccctcatgttcctgggcctggcattcgtcgaggtgctggcactgctcggcttcgtgctcgccttcatcaagtaagacttgatccccaaggtaaacaccgaagacgcaaacgaacgtgaaaggaggaagacactatggtgaccgcagctagcgagatggaactgttccttccgaaaagctacgacattttctggtcgttggtcattctgatcatcgtcgccgtgttcttctacaagttcttcctgccgaagttccaggccgtgttcgatgagcgcgcagccaagatcgaaggcggcatcgccaaggccgaacaggcccagaaggatgccgacgaagccaaggcgaagtacgatgcccagctgagcaacgcacgcgtcgaggcttccaagatccgcgacgacgctcgcgcggaggcatcgcacatcatcgccgacgcacgtacccgtgccgaggctgatgcggcgcagatcaccgccaccgcccagcgttccatcgaatcccagcagcagcaggctctggtgagcctgaagggtgaggtcggcgtgctggcaacggcactggccggcaagatcctgggcagcaagctggagagcgacgacgtgcagtcgacgatgatcgaccagatgatcgccgatctggacagcgacaagaagtgatcgaaaccttcaagaaagggaggtgaccaatgcgaggagaagcatcgcgtatcgcagaccgcgtttcgcgtgactcgctggcccccaggctgcgtgacagcggcgaggacgcatggcgcatcgggaacgaactgttcacgatcaccaacgcgctcgaccacaacatccagcttgaacgtgccctcaccgacccgtcgcgcccagtcgaagacaaggttgcggtagtcaagaccctcattggagatgaggcccatccgttgacgatggaaatcatgtccgatctggtggcccgccgttggagccgcgtgtccgacatcgccaacgccaccgaggatttcggtgtggatggcatgatgtactacgcggaccacacgaatgctactctgcaggtctccatcgagcttgcccagctgcattccgcactgctcaaccttccggtcgtacgcagcaagctgtatgacgcaaccgtccccgccgaagcccgtatcaagctgctgtacagcctgatcggcaatgccgacttcaatgtggtgaccaagcgtctggccgagcatgcgacctgcaatctgcgcaaccgccgttatctgcagaccattcagtggctgatcaacaagttctcccgtcatatgggcgaatcgatggtcaccgtcaccacggcaacgccactgagcaaggagcaagtcaagaagctcgtcgccatctattcggcgaagaccggccatccggtgcacatcaactcggtggtcgatccgaccgtcctgggtggtatgcgcatccaggtgggcgacgaggtcaccgacaacacggtggtcgcacagctgcaacatcttcagcgcacggtgaaggcgaccgcctgacggcacgccacacggtgaacaagcctgaaacaagacttgactgaatttaaaaacaacaataaggagtgatcatggcagaacttaccattgatcccaccacgatacgcaaggcgctcgatgagttcgtcgagtcgtacaagccgtcggacacgccgacccaggaagtcggttatgtcgcgaccgctggcgacggcattgcgcacgtgacgggactgcctggttgcatggccaatgagctgctgaccttcgaagacggcacgcttggcctggcgttcaaccttgacgcccgcgagatcggcgtggttatcctcggcgatttcaccggtatcgaggaaggccaggaagtgcgtcgtaccggcgaagtgctctccgtgcccgtcggcgacggctaccttggccgcgtcgtggacccgctaggcaacccgattgacggtcttggcgagatcaagaccgaaggccgtcgtattctcgaggcccaggcacctgacgttatgcatcgtcatccggttgacgagcctctgtccaccggcctgaaggccatcgacgcgatgacgccgatcggccgtggccagcgtcagctcatcatcggcgaccgtcagaccggtaagaccgctatcgcaatcgatacgatcatcaaccagaagcgcaactgggaatccggagacccgaagaagcaggtccgctgcatctacgtggccgtcggccagaagggctccaccatcgcatcggtgaagcagtccctggaagaggccggcgccatggagtacacgaccatcgtggcctccccggcttccgattccgcaggcttcaagtacatcgcaccgtacaccggttccgccatcggacagcactggatgtacaacggcaagcacgtgctcatcgtcttcgacgatctgtcgaagcaggccgaggcttaccgctcgatttccctgctgctgcgtcgtccgccggggcgtgaggcttacccgggcgatgtgttctacctgcactcccgtctgctcgaacgttgcgccaaggtttccgatgacctcggcggcggctcgatgaccggcctgccgatcgtcgagaccaaggcgaacgatgtgtccgcctacattccgaccaacgtgatttccatcaccgatggccagatcttcctgcagtccgacctgttcaacgcgaaccagcgtcctgctgtggacgtcggcatctccgtgtcccgagtcggtggcgctgcccagacgaaggccttgaagaaggtctccggcacgctgaagatctcgctggcgcagtaccgttcgctggaatccttcgccatgttcgcttccgatctggatgcggcttcgaaggctcagctgaaccgtggtgcccacctgaccgagctcctgaagcagccgcagttctccccgtattcgatggaacaggaagtcgtgtccgtgtgggccggcacccatggcaagatggatgacctgccaatcagcgacgtgttgccgttcgaaaagggcatgctggattatctggatcacaacaccgatatcctcaagaccattcgcgagaccgaagacttcaccgccgacaccgaggctgccctcgacaaggccgtggaagcgttccgtgagaccttcgtgaccagcgcgggcaagccgctggtcgagaagaagcctgacgagaagcacaccactccggtcgagcaggaaaagatcgtcgcaggagagaagtgattcatgggctcgcaactcgcattgaaatctaggatcgcctccaccgcgtcgctggagaaaatcttcaacgcgcaggagatgatcgcgtcttcgcatatcgccaaggcacgtgacgtggccttgaacgcgaagccgtataccgatgcgattttcgacgccgtgcaagcgctggtggcccatacccatatcgaccatccgatcgtgaaaaagaacgaggacaaccctcgcgtggctgtcctcgctctcacctcggatcgtggtatggcaggtccgtacacctcctcgatcatccgcgaaacggaatcgctgttggcccgactcgacgagaagggcaagcagccggaactgtatgtgtatggtcgtcgcggtgtgacgtattacaagtaccgcaaccgtccggttgccggcacttgggaaggcgataccgaccagcccggcgtggaagtcgcagagtccatctcgaaggcactgttggacgcttatatgaagccggcggaccaaggtggagtctccgaactctacattgtgttcaccgaattcgtgaatatggtggttcagaaggtgcgtgtgctgcgcatgctacccgttgagctcgtgcttccggaacagccggaatccggtcctgtgccggaatccgatgccgatgctgcgactcctctgtatgcgttcgagccaagcgttgacgaagtactcgacgcgattctgccgaagtacatccagtcccgtatccatgaatgcctgctcaccgcagcggcatccgagactgcaagccgacagaacgccatgcacacggctacagacaacgctcgcagcctgatcgatgaactgactcgcaagctcaacgcttcgcgtcaggcatcgattacccaggaacttaccgaaatcatcggcagcgctgatgcgctgaacaagaaggaagagtaggaacgcatatggctgagaatcagaccacagcggctcccgagacggctgcagagccgaccgctggacgcgttacgcgtatccagggttcggttatcgacgtcgaattcccggtgggccacctgcccgacatttacaatgcacttaccgttgaactggccaacaccggtgtccacgaagagggcgagaccaccaagaagatcacccttgaggttgaacagcatcttggcgattccaccgtgcgtaccgtcgctctgaagccgactgacggcctcgtgcgtggcgccaccgtgtacgacaccggcggcccgatctccgtgccggttggcgatgtcaccaagggccacgtattcgacgtgtccggcaacatcctcaacaagaaggccgacgagaccgttaaggttaccgaacgttggcctatccaccgcaacccgccggcattcgaccagctggagtccaagacccagatgttcgaaaccggtatcaaggtcatcgatttgctgaccccgtatgtgcagggtggcaagattggtctgttcggtggcgcaggcgtcggcaagaccgtgctgattcaggaaatgattcagcgtgtggctcagaaccacggcggtgtgtccgtgttcgcaggcgtcggcgaacgtacccgtgagggtaacgatctgatcggcgaaatggacgaagctggcgtacttgagaagaccgcactggtcttcggccagatggatgagcagccgggtacccgtctgcgcgtgccgctgaccgcactgaccatggcagagtacttccgtgacgtacagaaccaggacgtgctgctgttcatcgacaacatcttccgcttcacccaggctggttccgaggtatccaccctgctcggccgtatgccgtccgcagtgggctaccagccgaacctggccgatgagatgggcgcgctgcaggagcgcatcacgtcgacccgtggccactccatcacctcgctgcaggccatctacgtgccggccgatgattacaccgacccggcccctgcgacgaccttcgcccacctggacgcaaccaccgagctgtcccgtgacatcgcctccaagggcatctacccggcagtcgacccgctgagctccacttcgcgaatccttgatccgcgttatgtgggccaggctcactacgagtgcgccaaccgcgtcaaggcgattctgcagcgtaacaaggagctgcaggacatcatcgccctgattggcatcgacgagctcggcgaagaagataagaccactgtgaaccgcgcccgtaagatcgagcagttccttggccagaacttctacgtcgccgagaagttcaccggccgtccgggctcctatgttccggccgatgagaccatcgaagccttcacccgcatctgcgacggcgtgtatgacgacgttccggagcaggcattctccggtatcggcggcatcgacgatctcgagaagaagtggcacgacatgcagaaggaatacggtgcgtgatggccggatcgacattgcaggtgaacatcgtcgccgctgaccaccctgtgtggcacggcacggcgaagtctgttaccattcccgcctccgaaggcggaatgggcatcctgcccgaccacgagcctgtgctgaccgtgatcaaggaaggaaccatcgttgtggtggatcctgaaggcaatcgcctctccttcgaggtgactgacggcttcatctccttcgattcgaacaagctcaccgtcgcggtcgagcgtggaaccaacgtgaagcgcgccgaataagccgtttccgcttgacgtaaggtggcccggtaatcgcaatatgtttttgtattgcgattaccgggccgcttttgtcttttacgtggctttccgccgccgcgaatacgtatgccgtacgtacggcgacgcgcatggtagggtagtgcctcgtgcgaattattgttgctgactgctctgccgaatattccggacgattgaacgcctccctgccgctcgccaagcgcgtgctgctcatcaaggcggacaacagcctgctgatcttctccgaactcggctcatacaagccgctcaactggatgtccgcgccatgcagcatcagggacatcacccccgaccacgccgatgacgacgttgatactgaagtgccgcaaaaggtgatccgcgcgtcggccgacaaatcgaacgacgtgctggaagtgacgttgcagcacatctattcggacgaatcgtacgacctcggcgaggatccgggcctcatcaaggacggcgtcgaagaccatctgcagaagtacctggccgaacagatcgaacgcatcggcaaaggcgcgaagctcgtgcgccgcgaatacccgacagccatcggaccggtcgacatcatggcgattgacggcaacggcgagcacgtggccatcgaaatcaagcgcaacggcggcatcgacggcgtcgaacagctcacccgctactgcgatctgctcaaccgcgacccgctgctggtccccgtgcacggcatcttcgccgcgcagaccatcaccccgcaggcccgcgtgctcgcgcaggaccgcggtttcaaatgcctgattctcgattatgaggagatgaagggcaccgaagacgactctctacgactcttctaatgaaaaagcctcccgggtgggaggctttttgcggttagaccggctggatcagtaggcggcgagaatgtcgaccacgaagaccagcgtggaattcgccggaatcttctcctgatccttgtttccgtagccgaggctcggcggcaccaccagcagcacctgggaaccgaccgtgtggcctgccagaccctgcttccagcccttgatcacgctgtcaagcgagaaggcggaggactgtccgcggtcccacgaggaatcgaactgcgtgccgtcaagcagccagccggtgtagtgcgccaccacggactgcgtatccttgaccacagcgcccttgcccttgatgaggtcttgggaaatcaaggaatcggagcccttatagccattcatgtcgatcgacggcttgccgtccttggcgagcgtcaccttcggcaggtcggccggaatgtcggcgaccttctcgccggtggccttcttcaggtccttggacaccagcgtgagtaccatcaggtacgaggtgccggaggaattcgagtcgttcacgccgaacgccacggtggaattgagcttgaggctcttgaagatcttgtagtagttctcggtcatctggctggtatccgaggtgactacggtggagcagtcgggggtgttcttctcccacgtgctggccagttcggaaccatccttgacgctgatggcgatgccctgcgagcagacgcggtcgccgtcctcgatctgggctccgtcgcccttctgcagcaccacgtagctgttgtcctcgaccgtcatcggcgtcttgaacgagacggtcggcttcttgccgagctcgcccttggcggtcacgccggcgatctggtgcatgccgattttttcggaagatgaggaggaatccgagttcgacttgtcggatttcgcgctggaattaccgccgcacgcagtgacgcccaggcacatgaccgttgcgcagactgccgtgacggccttggaaagaagtgatttacgcatagggccaaccatagcggcaaagcatgattttcatgtttttttcaggcttgtgcaaacggacactgtagaatggaaaagctatgactgtattgcaggaagaacaagagaagccgcagatcgagacgggccctacccggcatgcgaagatcatgcgtggcatcgtcacgcctattttcggcttgcttgccatcgcatgcgtcgtgtttggcgtgttgaattcaaccgtctggaaaccggacaatgagatcaccgccgccgctccggtgaacggttcggaatacgtggtcaccgatccgaacgtgctgcagctggtagacagccgcgtcaatatttcggccaaatcccgtgacaagaaatccaatgtgtgcatcgccataggttccgcgcgcgatgttgccggatggattgcgggaagcaagtacatgcgcgtctccggtctgtccgattggacgacgctttccaccatgaaggtctccgcgcagggaaccgcggacaattcccagaaccaggtggctttcaaggactccgacatgtggcgcaccatcaagtgcaatgacggtgccgttgatatgcaggtcaaaggatcgaacagcaataacgccgaggatgttgtggcgttgattgatttcggcaaccgcaagggagacacggtcactctgaattgggaccgtcgtaacctgccgaatttcgccatgccgttgtatcttgccggcggactgctggcgattctcgccgtgctttccgcttccgtattcgccatgccgccgcataagcgccgcaacaagcgcgctttcgccatggtcgaaggcgttggcgtcaacgaaggcgatgagaacgaggtttcggcttgggtgaagaacgccgaaaccgccgccagcaacagggcacggagcaggtcgcgtcacggcaggcgtcgccatgcggaacatcgcaccggcggtcgtacgtcgtcgttcgaggaaacgcaacagcccgtcatcgtcgatcctgtggcacgtaacctggtcgccgaccagcagaacacgattgcggaaagccagccgactgtgtccgaatcgaccgtatttgaatcgacggcgggcgaatcgtctgttgacgacgaggcgacttccgtgatctcgcaggatgagcttgccgcgtatttcgctcgtcttgcccaagaggaggttcagacggaaacgcaggaagacggccaagaggaggaccagtgatgaggaagcgtagtcaggcgattatcgcggccatgctcgcgctgggaatggccgtcggcatgtgcggttgcgaaggccagctgccgaccccgaaagccaccacccggcaggatgcgccgaacttgagcgccaagcaggagcaaaaggtccgcacgaggattctcaaaacgctcgaccagtgcaatcagaaccgtgacactgatacgttgccgacgattctcgaaggtccggaactggacatccgcaccagcgagctgaacgtagcgaaagccacgggcaatcttgaccgtaagaccaccatccccacggatctggcccaggccgtgatctccactgatgccggctggccacggtccgtgttctccatcacgtccacaaccaaggaccagcagtccaagcgtctgctggtgttcaggcaggattccgcacgccagaactacaagctgtggggtgtggcgcgactgttctccggcgtgaagatgccgagtttcgaaatctccaaaaccggcagcgcgcagggaacgcctacggacaccggtctggtcatgacgccgaaagcggcggtggacgcgtatgcggacctgctgcagaacggggcgaacagcaagtacgccagcaaatttgcggatgatgatctgcgatcgaagcttgccgatctgactgcccaggtgcagaaggccatggagcttaacgaaggcacgcagcagcagaccttcgaaccggtcaatggagccatcagcgtcatgcgttccgcggacggcggcgatctggtggtggcgcagatcaactccgaatggacgcgttccgccggcgctggccgtgaatcgcagccggcctctgacgcggaaaaggcgctgttcggcaatggcaaggccaccagcaccatgaagacgagctatgtgaacgtcatcgcgctgtatgttccgccggcgaattccgggcagaaaatcaccgcggtcggttccgaacgccaaccggtgaaggtcgaagcgctgtaaaacgacgggtccttggacgcgcatcgtcggcggttttccgcctatcgcgcatccgtgggaatgaaaaccgagaaatcgttgttggcacctatagttggtgccagcaacgatttcgtgtttttggaggcaagtatggcagagcagcaagcgttccatccgggtgtttcattggcgggagccgttgatctggaagcgctcaagcatcaggtgaaggccgagccggggcaggcgggcggcgctccggcggctggcggatatgtcatcgacaccacggagaacacgttccaggccatggtgcagacctccgccacgttcccgattctgctgttcctgtgggtgccgaccgacgaccgtctgttcgccatggcacgcgcattgggtgacgcggtgaacaagctcaacggccagatccagctgtcccgcatcgacatcgcatccaatccctccatcgcacaggcgttccagattcagggcgcgccggcgctgttcgcgttgatcggcggccgtccgatgccgattctgcagggccttccgtccgacgaggaactgcagcagatcacagacgtggtcgtgccgaagcttatcgccgccgcacagcaggccggcgtgaccggcaccgctccgtattcgggcgatccggattccgacgcggccaattccgcatccgccggcagtgtgcaggatcaggtgccgccggaacatcaggaagcgtacatgctggcacagcagggcgattacgccggtgccgccgccgcgtacgagaaggttttggaagccgatccgaacgatacgcgcgccgcccgcgaacgtgcgaaggcgctgctgctggcccgttccgccaatgcggacgtgcgcgtggtgcgtgccgctgccgccgacaagccggacgatgtggacgcgcagcttgccgtcgccgacatcgacatgatcggcgggcagatccaggacgcgttcgaccgtctgcttgatttcgtggcggcgggccacaaggccgacatcgagccggtgcgccagcgtctgctcgaatacttcacgatccccgagccgaccgacgagcgtctgaagcgcgcacgtcgtcgcctcgccaccctcatgtactgagcgtgcagcgcgtgctggttgcgccgagcactctgatgcattgagcgcgcgtactgactttcccaacgattgcaaggtctgcgtcacgtttttcgccgaatcgtgtcgcaaacgggcgcagaccgtgtacagtagtgcgttgcatgggtttgtagctcagcggatagagcgtctgtctccggaacagaaggtcgtgggttcgatccccatcaagcccaccgggcaaggctccagtcgaacggctggagcctttttgttgctcgtttgttgtatttttccgcggttttccttgcgattccgccgttttcgtgcctgctgcgccgtgtggtgccaactccggccatatcgttctgtgaacggtttttcccgcttccacccatcggaaaagtatgatttcaggtgcgacgcaaatagcgcatgtacgggcatattggcacatacttggcgcgcgtttacataccttgcggcaacataccttacgacaaaggagaacagtatgagcgaaaagctggaagcagtggccacctccgaagccccggcagcactcggcgcctacagccaggccgtgaaggccaacggattcgtgttcgtctccggccagctgggcatcgacccggccaccggcgaactggccggcgagagtgcgggcgagcaggccgcgcaggcgctgaagaacatcaagcacatcctcgacaccgcgggcagcggcatcgaaaacgtgtgccgcgccaccatctacatgaagaacgtcgaggacttccatgaggtcgacgacgtatacgccaaggtcttcatcggctccgtcaagccggcccgcgtggcctttggcggcaacgacattccgaagggcgcgctcgtcgagatcgacgccatcgccgcgctctgagcatttcgcgcataccgcgagtagcgcgatcgacggcccgcatgccttcccggctgcgggccgccgctgttccgggcgttcctccgctcgcggtcgatccgacgatgctcgcgcattgccgtgagcctgccgtatagtattgcgattgtgcggccagccaaaacacacgccgcacccaaccaaacgcgcaggaagccggaggcaagcatggcgcaatcgcaagcagagcagcaggcacaggcgcagatcgccggcgaaccgacgcggacgaaggaacggcagccgcagccagcgaccggaaccgccgcggatcccacggcgcaagcccagcagaacgtcgaacagggcggcctggaacgcaagatggaaacgcgccacctgaccatgatctcgctcggcggcgtgatcggcacaggcctgtttttaagctccggctacaccatccatcaggcgggcccgctcggcgcgatcatcgcgtacgccatcggttcgctgctcgtctacttcatcatgctgagcctcggcgagctgtctgtggccatgccgtacgccggcagcttccacctgtatgcgaagcgtttcatcggccccggcaccgcgttcaccatcgccgtgctctactggctgaattgggcggtggcgctcgcctccgaattcacggctgccggcctgctgatgcagcgatggttcccgcattcgcccgcatgggtctggtcggccgcgttcatcgtggtcgtgttcctgctcaacatcctgtcggtgcgcctgtacggcgaatcggaattctggttcgcgtccatcaaggtgttcgccatcatcgcgttcatcatcattggcctgctggccatgttcggcgcgattccgatcgccggctatgaccacgcgcccatgttcgagaacttctacagcgacggctggctgcccaacggcgtgctgccgattttctccacgctgctgacggtcgtgttcgccttctccggcaccgaagtggtcggcgtcgcggcgggcgagacgaaggacccgtccaaggcgattccgaaggccgtgcacaccaccgtgctgcgtctggcgatcttcttcatcggctcgatcgccgtcatggcggcgctgattccgtggcgcaagtcgggcgtcgacaccagcccgttcgtgctcgtgttccagtcgatcggcatgccgttcgccggcgacatcatgaatttcgtggtgctgacggcggtgctgtccgccgcgaattccggcctctacgtgtgctcgcgcatggtgtggtcgctcgcgcaggagggtatgattccgcgcaagctcgccaaaacgaacttccacggcgtgcccgttttcgcggtgatgttcagcatggccggctccctgctggcgctgctgtcctccgtggtggccgcctcgaccgtgtacctggcgctggtggccgtctccggcctggccacgctggtggtgtgggcgtcggtttccgtctgccacttgcgattccgccaccaatggctcgcgcagggacatacggttggcgagctcaagtaccgcgcgcctggctacccgttcgtgccgatcgccgcgatcgtgatgtgcgtcggcgcactggttctggtgatttgcgatccgtcgcagcgctccacgctgctgtacatgattccgttcgtggcgctgtgctacacgggctactacgcgtccgtggcgtggcgtgcgaaacggcatggcgggtaggacgatgctcagaacgccttgcaaagcgttccgcaggacgtatcgcaaccccatcgtgaggatggacaggaagactgattctgtcagcgtgcccggtattcttggaagaatgagtccagaagcccttagtgaactgattttcaacattgccaacacccttgtctccgaaggcaaggcaggcaccctgaccgccgatctgattccgccgcaggccaagttcgccgtgatgcgcccgaaggaccgcgcgcacggcgattgggcgtccaacgcggccatgcagctggccaagaaggccggcatgaagccgcgcgatctcgccgaactgttcgccgccgaactgaccaatgccgacggcatcaagtccgtggaagtggccggccccggcttcatcaacatcacgctcgactccgcatccgcggccgcagtggtggacaccgtgctcgaagccggcagcgactacggcaagaacgaccacctgtccggcaagaccctgaacctcgaattcgtatccgccaacccgaccggcccgatccacatcggcggcacccgttgggcggccgtcggcgactccatggcccgcgtgcttgaggccaacggcgccaaggtggtgcgcgaatactacttcaacgaccacggcgagcagatcaaccgcttcgccaagtcgctcgtcgccgcggcccacggcgaggaaaccccgatcgacggctacaagggcgcgtacatcgacgaaatcgccaagcgtgtcatcgacgaagccaacgcggacggcgtggacgtgctgagcctgccgcgcgtcgacggtggcgccgaccaggacggcaacccgctcggcgaaggcgattccgaacagcgcgaggagttccgcaagcgcgccgtgccgatgatgttcgacgaaatccagcgttccatgaagaacttccgcgtcaatttcgacgtgtggttccacgagaacagcctgtattccgacggcgaagtggaccaggccatcgccgatctgcgcgcccgcggcgacatcttcgaaaaggacggcgccacctggttcgaatccaccaagcacggtgacgacaaggaccgcgtgatcatcaagtccgacggcaactacgcgtacttcgccgccgacatcgcctactaccgcaacaagcgccaccgcgagaccaacccggccgacgtggcgatttacatgctcggcgccgaccaccacggctacatcggccgcatgatggccatgtgcgaggccttcggcgacaagccgggcgagaacatgcagatcctcatcggccagctcgtcaacgtcatgaaggacggcaaggccgtgcgcatgtcgaagcgcgccggcaacgtcgtcaccatcgacgacctgaccgacgccatcggcgtggacgcctcccgctattcgctggcccgcaccgactacaactccccggtggacatcgacctgaacctgctgtcctcgcattccaacgagaatccggtgtactacgtgcagtacgcgcacgcccgctcctgcaacgtggaccgcaacgcggccgccgccggcatcacctacgaaggcgccgacgtgagcctgctcgacaccaccgccgacggcgaagtgctcgccgcgctcgcccagtggcccgccctgctgcgcgaagcgggcgacctgcgcgccccgcaccgcgtggcccactacctggaggacctcgccgccacctaccacaagtggtacaacgtggagcgcgtcgtgccgatggaactcaccgatccggaggcccgcggggaacaggccgacgccatccgcatcgccaaggctccggaaccggcccacgccgccgcccgactcaagctcaacgacgccgtcaagacggtcatcgccgaaggcctcgacctgctcggcgtcaccgctccggacaagatgtgaagcgaatccacgaaaaagggagatacgcaaaccatgcctgtaagcccaatctggccggccggatcggccgtgaacgccgaaggcgagatcaccttccacggccgcaccgccgcaagcctgctcgacgaattcggttcgccgctttacgtcatcgacaccgatgaggtgcgtgaccgcgctacgaaattcgtgcattcggccgccaacgcgttcaacaacaccgtcacccacgtcagcttcgccggcaaagcgctgctgagcaaggagatctgccgcatcgtcaccgaatccggcatgctcatcgacacctgcaccatgggtgagatgcgcatcgcgctcgccgcgggcgtcccaggccgccgcctcgtgctgcacggcaacaacaagtccgatgcggaaatcgagctggccatcgaacagggcttcaacaaaatcgtgatcgacgagccggatgagccggcacgcatcgccgcgatcgccaagcggctcggcaagcgcgcccgcgtcatgctgcgcgtcacctccggcattcacgccggcggccacgaattcgtgtccaccgcccacgaggaccagaagttcggcgtggccctgctgcccgccggagccgacgcgggcaagcttgctgtgctcgacgacctgaccgacgtgacgccggcagggtcgaacgcacgattgggggagaacgcgtcttccgccgacggctccgaccactccgcccacgcggaacgcaagctccagtacgacgtcaaatacccgtacgacctgagccacgagaaggtctccgaaggcgaccgcaggctcgccgaagccatgaccatggtggccgacggtccggcgctcgccgtgctcaaggacatctaccgccgccaggacgtgctcgaactggtcggcgtgcactcgcatatcggctccaacatccatgacgcggacgctttcatccaggcggccaagcgcatgatgctgctgcgcaagaccttctacgccaccgacgcgtacaccctgccggaggtcgatctgggcggcggttattccgtggcctacaccgacggcgaggattccatggacatcgacgtggagctcggcaggctcgccgacgcggtcagcaccgtgaaccgcgcgctcggcatgccggccccggtcatctccttcgagccgggccgctggacggtggcccccaccggcgtcacgctgtaccgcgtgggcaccgtcaagccggtcgagctttccggcgaggcgaaggacaagtcaggcaatccggtgacggaacgtgtgtacgtgtccgtggatggcggcatgagcgacaacattcgtccggcgctgtacggctccgactacaccgcgcgtctggccaaccgcaagggaaacaagcagaccaagctgtgccgcgtggtcggcatgcactgcgaatcgggagatatcgtcgtcaacgaggtgcggctgcccgccgacatcaagcgtggcgacatcctcgcggtgccggtcaccggcgcatacggccgcacgatggccagcaactacaaccaggcgctgattcccgccgtggtcggcgtcggcgaggccggcgcacacgtcatgatccgccggcagacgatcgacgatctgctgagctgggacgtcagcgaatagtccacgattgcgtctcacggtatggacggttttcgggcttccttgcggggaaagcttcggaaaccgtccattttcttgatattccgcggccttacgtcatattgagaccgtacaataagcaaggtcacaccaatacttcacattcaagggaggatgccttggcacaggaagatgttgcgccgattcgcgttggattgctgggcgcaggtaccgttggttcccagaccgcacgcctgctggtcgagcagaaggacgagcttgccgcacgtatcggacgaccgatcgagctgaccggcgtcgcctgcctcgacccggtggaaaccgatccgttcccgtggatcgacaaggccatcgtgaccaccgataccatgagcgtggccaccaattccgacatcgtcatcgagctgatcggcggcaccggcgtggcacgcaagttcgtgctcgccgccatcgaatccggcgcctccgtggtcaccgccaacaaggcgctgctggccaagtatggtccggagatctacgcggccgccgaagccaagggcgtcgacatctacttcgaagcctccgtgggcggcgccatcccgttcctcaagccgctgcgcgaatccctcgtcggagacaaggtgacgagcatgctcggcatcgtcaacggcaccaccaactacatcctcgacgagatgaccaccaagggcctcgacttcgatgacgtgctcaaggacgcgcaggctaagggctacgccgaagccgatccgaccggcgacatcgagggctacgacgcggccaacaaggccgcgatcatggccaccctcggcttccacacctccgtcaccatcgacgacgtctccgtcgagggcatcaccaagatcaccgccgacgacatcgccgccgccaccgcggaaaacaaggtgatcaagctgctcgccgtcgtggagaacaccgatgccggcgtgtccgcgcgcgtctacccggcactgatctccaacacccatccgctggcctccgtgcacggctccttcaacgccgtgttcgtcaaggccgaagccgcggacgacctcatgttctacggccgcggcgccggcggcgctccgaccgcctccgcggtcgtcggcgacgtggtcaccgaagcccgccatatcgcacagggctgcaccggtccgtccatcccgctgtacaaggatctgaagaaggctccgatcgaggcgtccaaggccgagttcgcggtccgtttcgtgattcacgacaatccgggcgtgctcgccgcgatcgcagccaagttcgccgaccatggcgtgtccatcaacggcgtgaaccaggatctgaagccgacgctgaaggatccgggctatgacggcgagctgcagcagctgcgtctggtcacccacatgaccgacgagctcaccctgcgcgaaaccgtcaaggacgtgtgcgagctggattgcgtgtgcggagagccgtcgatcctgcgcgtgctgaactgatatcggatgcgattcgggcccatgatgcgattggcatgcaagccatgccaagccgccgtcatgggcccgaatacgatgcacgggtgcggttccccctgaaatttgactctggcactgccacggtatacggtgcttgatttgtaatgaagatgtgacgaaggacgacgagagatgactccagttacccgcaaggtgcgtgtgaaggttccggccaccagcgccaatcttggctccggtttcgatacggtcggtttggctttggattaccatgacgagcttgaattcacgctgagcgccgacccggtgaacaccgcggcgcaggtgatgatcgaaggcgagggcgaggacaccctgccacgtgacgagacgcacctggtggtctccacgttccgccgcgcatgccagaccttcggcctgggacgcgtcggattcatcctgcaggcgcacaacaacatcccgcaggcgcgaggcatgggctcctccgccgaggccatcgtcgccggcatcgccgccgcggcagccttcgcgcaggacgacgacctcaaccgcgacgccgtgttcgagctggccgctgccatcgaaggccatccggacaacgtggccccggccgtgtacggcggcctgaccatgtcctgggacatggagaccgcggaaggtgtcggatccgtgccgattccaggcggcgagccgatgcacaacggcttccacaccatcaattaccgcgtggcggacgatctgaccgcggccgtgttcgtgccggactacgagctgtccaccgaaaaggcccgtcaggcgttgccgactgagattccgttcaaggacgccgtgcacaacgtctcccgtgtgagcctgctgccggccgccatgaaccccgcgatgctggcctccggctcgcgtcagaacgccaacgcactgctgttcgcggccacgcaggaccgcctgcatcagccgtaccgcgcctcgctgatggagccgtcttgggcgctgatcgagaagatgcgctcccacggcttcgcctccaccgtgtccggcgctggcccatgcgtgctggtgctgcaccatggcgacgcccacgaggaactcgaacggatcgccgccgaagagctggcatccggccattggcgtgtgctgcatctcgcggtcgacaccaagggtgtgcaggtggaacgcgcatgagcatcccgctgattctcgcctcccagtcccgtccacgccgtgacgtgctgttctccgccggcatctgcccgaccatccgtgtctcgcacgtcgacgagcctgccgcgcttgaacgcgaggcggccgcgcttggcgtcaccgtgaacgacctgagcgtcgaacagcgtgtgatgattctcgccacggcgaaggccgaggccgtgcaccaggcgtatcgcaacatcgccgataccgcggcgcacgcgcgcggggagcgcgtggtcggcttcccgctccgggcagcagacgatcgcgacgcatcctcggcgggcacagccgcacgcacggacagcgcgcagtccgccgacgagacgaagacccgcgatttctccggcatcgccattcccaccgtcgccgagccgatcgccgatttcgtggatggccgtccaagcctgacccgttcgaaggccggcccgctgattctcggctgcgattccatgttcctgctggacggcgaatgctacggcaagccgcatagcgaagaggtagcgcgcgaacggctgcgtgccatgcgcggtgccaccggcgagctgtggaccggccattgcctcatcgacttcgcgtcgggccgcatggtgcgcggcgccagcaaagcgaccctgcacttctgcgaatattccgacctggatatcgaacgctacatcgccaccggcgagccgctggaagtggccggatcgttcactttggaaggtttcggcggcgcgttcatcgactcgatcgaaggcgatccgcacggcatcatcggcctgagcctgccgttggcgcgccgtctggcggcgcaattgggcgtcgaatggaccgatctgtggaacgtcacgcgctccgacctcgcgccggacgccgaatatgatgcgaaaacgggtgccgcgaagccgctgccgcccaaggagaacgtgcaccagccgggagacggctgggtcgactgcgcctgcggtcgcaagcattggggtacgaacggcgcgtccggcgtgctcttggcccgccgcagcgagacgaccggtgaggtgacgcacgtcgtcatgcagcaccgcgcggtatggagcgcggaaggcggcacgtggggcattcccggcggcgccaccgccgatggcgaaagcccgatcgagggcgcactgcgcgaatcgtacgaggaagccaacatcacgccggaggacatcgacgtggtcggatcgtactgcgaggaccacggcccatggtcgtacaccacggtgttcgccttcgaaaagccggggcaccgcgtcgaacccaaggccaacgacgacgaaagcatggagatcgaatgggtgccggtcgatgacgtgcccaaccgcaagctgctgactgccatgcgcaccgattggcctaacttcgcggcgcgtctgcgtgctttggcggccgtgcggtagcctgcgtgcagtgtgccgcatccttggaacatgacggctgttagcgctaactgaagttgcgtgtacaataggcgaacgtaccaacagttgtgtgcgaaaggcgatggggcatggcaggcaaacgcaatgcgggcaataagcgtccttcgatgttcgaagtggcgaaactggctggtgtgagccaccagacggtctcgcgcgtcatcaaccattcgccggacgtttccgacgccacccgtgagaaggtgcagagggccatcgaccagctcggataccgtcccagcaactccgcccgcgcgctcgcctcgcaccggtcccgcaccatcggcctgatcgccggcggccagcatttctatggcccgatctccacgatttccgcgattgagacgatggcccgccagcatggcctgttcgtgacggtgagcatggtgcatgaggcgctgtgctcgcaggaggaattcgacgacctgtgccgcaccttcgacgagatgaacgtcgacgcgttcatcttcctcacgcccaccgatgtcatgttctccgcggcatgccggacgcggatcgcgcagcctcgtgtgatcgtcacatccacgcacggtggcatcggcgtgcaggacggcctgcggctgatgaagtccgccgaccgccgccgcgtatccgtcgtcggcatggaccaatggtccgcgatggccgacgtgatgcatctcgtcgtggaatacgggcaccgttcggtgctgtatttcgccggtcccaaggagtggcgcgacgcggcgacgcgcctgctggcatggaacaagctatgcgcggccaatgcggtcaattccgtgacggtgcagtgcgagacctgggaatcctccgaagcgtacggcaagatgaaccacatcctcgacaacatcggccgcaccggcggcaatctgccgacatgcatggtctgcgccaacgacagccaggccgtgggtgtggcccgcgcgctgcatgagcatggcgtgcgcgttccgcaggatgtgagcctggtgggtttcgacgacatgcctgccatggacaatatgttcccgccgctgaccacggtccgtcccggcttcgagcagctgggtgtcgccgccatgcgtgagacgctgtacttgctgggcgcgggggaggagaactccttcggatcatcgcagcatggcgtcggactggtgtcggcgcagatggtcaaccgcagctccctgggtcctgtccgccgccgctaaggcgctgcttcttttcgatttgctcgtatattcattgctccgatgacacgtcggatttggtgcgtcacgggtttgtgcctacaatagtgagcgttaacagtgagcgctaacattcagttgacagagtggttgcgaggcgctcggacgcaaggagttcgtgaactatgacgcaagagcaggtcgcagtgaccgccgagaagatccgcgcaggcaagacgagcctgggcatcgagttcggctccacccgcatcaaggcggtgctcatcgatgacgcctaccacaccatcgcggcgggcgactatgagtgggccagccatctcgaggacgggctgtggagctacacccaggaggaaatctggaagggtttgcagaccgcatacgcccggatggccggcgatgtcgaaaccgcctatggcgaacggctgacccacgtggggcacatcggcttctccgccatgatgcatggctacctcgccttcgacaagtccggcgaactgctcgtgccgttccgcacctggcagaacaccaacacccacgaagcccacgagaagctttccgagctgttccagtacaacattccggaacgctggtccgtggcgcacctctaccaggcggtgctcaaccacgaggagcacgtctccaaggtggactacatcaccacactcgccggctacgtgcactggaagctcaccggcgagaaggtgctcggcgtgggcgacgcctccggcatgttccccattgacccggccacccatacctacgaaaccgagttcatcaagcgattcgacgcgatcgaggaagtcgccgcgcagccgtggaagcttgagaacctgctgccccgtccgctcgtggcgggcaccccggccggcacgctcaccgccgaaggcgccaaactgctcgacccgaccggcacccttcagccgggcgtcgtcctcgccccgccggaaggcgacgcgggcaccggcatggtcgccaccaactccgtgcgcgtgcgcaccggcaacgtctccgccggcacttcgattttcgccatggtcgtgcttgagcacaagctggcgcgcctgcatccggaagtcgacctcgtcaccactccagccggcgacctggccggcatgagccacgccaacaacttcacttccgatctcaacgcctgggtcggcctgttcggacagttcgccgccgcgatcggccagccggtcgatgccggcacgctgtacggcacgctgttccgcgccgcgatcgcggacgatgtcgacgccgactgcggtggtctgctcaactatccgttccgctccggcgaattcctggctggcctgccggaaggccgaccgctgttcgcccgcagcccggaggcgcgcatgagcctcggcaacttcatgagaactcagctgttcagcgccttctcgccggtcaagatcggcatggatgtgatgaccaaggacgaaggcgtcgccgtcgactcgctcgtcggccacggtggcatcttcaccacgccgaaggtcgcgcagaagatcctcgccgccgcattcgacaccccgatcaaggtcatggccaccgccgccgaaggcggagcgtggggcatggccgtgctcgccgactatctgtggcacgccgaccagccgctcgccgactacctcgacacccgcgtcttcgccgacgcggcctccaccacggaagcgccggacgccaacgacgtggccggcttcgaagccttcttcgaccgcttccgcaaggggctgccgatcgagcatgccgccatcgaaagcatcccgctggaaaccaaataaccgtccatcgcaacaacagcaagcctgacgaaaggaacacaatatggcaacgttggctgattacggcccggaagtacgagctgaagtcaagcaggtgcgcgaagtggtcgccaccctgcacgagcagctcatcaagtggaatctggtggtgtggaccgcaggcaacgtctcgcagcgcctgcacaccgccgacctgatggtcatcaagccgtccggactgcgttacgagtacctcaccccaagctcgatggtcgtgtgcgacctcgacggcaacgtggtcgacggcgccgaagcgccgagctccgacaccgcgtcccacgcgtacatctaccgccacatgcccgacgtgtacggcgtggtgcatacccactccacctacgccaccgcatgggcggccaccggccagaacattccgtgcggcctgaccatgatgggcgacgagttcggcggcccggtgccggtcggcccgttccgcctcatcggctccgaagccatcggcgaaggcgtggtcgaaaccctgaagaagtatccgaagtccccggccgtgctcatgcagaaccatggtccgttcaccatcggcaaggacgcggaagccgccgtcaaggccgccgccatgaccgaagaggtggcgcacaccatgtgggccgccaagcagctcggagacatcatcccgatctcccaggaagacatcgatagccttaacgaccgctacaccaacgtctacggccagcactgacgcgacggaaactgaaacgacaaacccaacaacgaagtaaggaataatccaacatggcaatggaaaacccatttgaaggcaaggaaatctggtttggcgtcggatcgcaggacctctacggcgaggaggcgctgcgccaggtggcccagcagaccggcgagatggtcgacttcctcaacgcgaccggcaagatcccggctaagatcgtgctcaagccgaccctgaagtcctccgacggcgtcaaggccttcatgaccgaagcctccgccaacccgaacgtcatcggcgtgatcacctggtgccacaccttctccccggccaagatgtggatccgcggcctcgaagtgctgaccaagccgctgctgcagctggccacccagcaccacaaggaaatcccgtgggagaccatcgacatggacttcatgaacctgaaccaggccgcccacggcgaccgtgagttcggctacatcgtctcccgtctgggcattccgcgcaagatcgtcgtcggccactacaccgatccggaagtcgccgaaaaggtcggcacctgggctcgcgcctgcgccggctgggatgcctcccagaacatgaaggtcatgcgttggggcgacaacatgcgcaacgtggccgtcaccgaaggcgacaagaccgaagccgaacgcgtgttcggcgcttcgatcaacacctgggccgtcaacgacctcgtcgccgcctacgagaaggtcaaggacagccaggtcaaggacctcatcgaagactacaaggccaagtacgacgtggcccccgagctgcttgattcccgctacgatgagctgttcatcgcagccaaggaagaggccgccatggtcaacatgatgcgtgagaacggttgcaccgccggcgtcgacaacttcgaagacctcggcaccctgccgcagctgccgggcgtcggcccgcagcgcttcccgtccgagtacggctggggcttctccgccgaaggcgattggaagacctccgtgctggtgcgcatcggcgccgtgatgggctacggccttgagggtggcgcctccctgatggaggactactcctacaacttcgtgccgggcaacgagttcgacatgggctcccacatgctggaagtctccccgtccatcggcaccatcgccaagccgaagctggccatctacccgctgggcatcggcggcaagtccgacccggtccgtctggtgttctccggcaagccggccgacgccgtcgtggtctccatggccgacgagcgcgaacgcttccgcctgctcatggacgaggtcaccatcgtcgaaccgcagggctccctgaagaacctgccgtgcgcccgcgccgtgtggaagccgaagccggacctgaagaccgccgtgcagtgctggatcaccgccggtggctcccaccacacctgcatgaccacgtccgtcggtcgtgaggcttgggaggacttcgcccgcatcgccggcgtcgaactcgccgtcatcgacgagaacaccaacgcccgccagttcgagaaggagctggagctgagcgaaatgtaccaccgcctcaacaaccgtcactgaaataacggagcgttaacagcacggcaggaaacttgacgtaccttcgtacgccggcgtttcctgccgcactgttaccgcacgcgttatctcagcgatacggggtgcgcttaaaaaacagcacggcggggaagttgacgtacttttgtacgcagcgttccccgccgtgctgtttttgtttacctatgtgcggctcagcgcttgccggcgtacagctgctggtcgatcacgtcggcgaacacgcggttcactgccggacgcaccaccttcagcgacggcgtcaggcacttgttctcctgcgtgaactgcgcatccagcaccacgaacttacgcacggattcggcgcgcgaaaccgtcgcgttcgccttgtccacatacttctgaatctcgtcatgaacggcggcggtagccgccacgcggtcaagcggcgtatccgcggacaggcccacggacggcagccaggccgccaatccttccggatcgagcgtgaccagcgcgccgatgaacggacgattatcgcccaccaccacggcatgctccacaatcggacacttcgcaatctcctgctccatcggaatcggcgacacgttcttgccgccggcggtgatgatgatgtccttcttgcggcccgtaatcgtaatacgaccctcatcgtcgatcgacgcaagatcgccggtgcgcagccaaccgtcctcggtgaacacctcggccgttttctccggcagattgtggtaacccatgaacacgttcggtcccttgacctgcagctcgccatcgtcggaaatacgcacggacgatcccggcgcaggctggccgacggtaccgatcacattgtccgtgacgcgggtcgcggcaaacggcgccgcggtttccgtcataccgtagccctggatcatcggcaggccgatgccattgaagaaatgcgccagcgacacgtccagcggagcgccaccgcacgccacataacggatacgcgggcccaacgcgccacgcacggtgtggtatacggacgcctcatacgacaggtgttcggcggtctgcttcatggtcggtttctcgccagcctgctgcatgcgcgaccagtcgcgcgcggattcggcggccttgaggaacaggcggcccttccaacccatgccggccttgcgggaagccgcgttgtacaccttctcgaacacgcgcggcacgcccagcaggtacgtcggctcgaacgaacgcacatccggcagcagcgtcttggtgtccggcagatagccgaccacgccgtcatcggaagcgatcgacgcgtactggatgaagcgcgcgaagcagtgggcgagcggcaggaacagcagcagacgcggatggtcttcaagaatcatctcgtgcagcgcaaggctgccggcacgcgtgatcgacacgaaattgcgatgcgacagctcggcacccttcggtgcccccgtggaaccggacgtgtacacgatggtggccagatcgtcggcacgcaccgacgtgatacgctcgtccagctcttcgtcggacacggtgacgcccaatccctccagcgcgcccatggcattggcgtcgagcatcagaatatgcttcagagacgggcagcggccaatcacggaatcaagacggtcgaagcgttcgcgatcgtcggcgatggcgagcttcacgttggaatcgttgagaatgcgttcggcctgcgccgcggaatcggtgtcatagatcggcacattgaccgcgccgattgcggccagtgcgaaatcaagcacgccccactcgtaacgggtggtggagaagagggtgacggcatcccccttgccgatgccgaacgcgatcaggcctttggccgcggagagcacattcttgtggaattcgccggtcgtcaccttggtccactggcccggagcggttttgcgttccgcgatcacggtgtcttcgccggtgcgcttgatgcgttcggtaagcagggagtagatggattcgtcgtcgcgtacttcgacggatgcgcccggggtcgtgtactcggtgagcatgaagtgttctcttttcttgcgtttccgcggttttcgtgggttttgcgatatatgcgatcgctgcgattgcggtgatcggtgacgtgcttttcgcgtcctgtgtcgcgcctcgcatatcgtaagttacggtgacgtaagtccgcattgtaagaaacaacaagaaatacggcgacgggtttgtttgaactgacaaagtggcacgaaacgtcaacggaacgggggattggtacacggatgcatcatctcgaaaaaaggtttgacgcgttcgatcgcagggtgtccaacgggttgcgcgacgggttcgagaggggtggcccttacgggcgaaaacggtggaaaatgcggcaaaactgggcggagtgacgttgcgaaccacaacatgttccgtgtacactcaagtttggcgcaactaccccttgcgcctaggctgtttgctcaacggcgaacattcagccgcctcacttttcgccgttcccttggttttctgtggttttgctgttgtgcatttgcttgcgagttctgatggttttctatatttttccgacgattttctgcgattgccgttccgtcattgcctttcgtcggtatgcccgatacgcttggagcggatggcgggattgcaaacgattggaaaaggggcatgatgttcgacaagcggctgttttccttggctgacggcgtcggtcgattgatcgcggcgaaagtcgcctgccaatggctgggcctcgtggccaacatcgccttcgccgtggctgtggtgcgtatgctgcaaccgctgttcgcgcccgtaccgtccgccaccgcgccctgcatcgtcattattcttattgccgcggtcgtgcgattcgtcaccattcgcgccgccgcacgtttcggtagcgaggccgccgaacgcgtcaaactcgcgctgcgtgagaaactgttcaataagatgctcgcgctcggcccgtcctacgcgcagcgcgtgcgcaccgccggcgtggtgcagtccgcgggcgaaggcatcgaacaaatccaaagcttcttcgaactgttcctgccgcaactgtgctacgccgtgctcgcccccatcacgctgttcgccgtgcttgcgccgatcgacctgcccaccgccgcgacgctgctcgcctgcgcgccgctcatcgtgctcatcgtcggcatggtggcgatgcgtgctgcccgcgtattcaagaaatactggggcaaatacacggatatgggcgccgcgttcctcgacaatctgcagggacttgagacgctgaaaaccttcgacgcggacgagcgcgccgcacgagtcatggacgagaaggccgaacagttccgcgtgatgaccatgaacgtgctgcagatccaactgcgttcgctcacggcgatggatgccgtggcgtacggtggcgcggccgccggcatcggcgttgcggtatggcgattcgtatccggctcgctctcgccgtctggcgttttcgcgctgtccggcgtgctgccgcttggtttgacgccgatcgccgcggtattgctgacgattctgctagccgccgatttcttcattccgctgcgacagctcggctcgtatttccacgttgcgatgaacggcatgacgtccacgaaacgtattttcgcgctgctcgacgcgcccgaaccggagcatggcagcaaggaactgccggaattcggggcttccgggcgtggtgtcggcgtggagtttcgtggtgtttcgtaccggtatgcggacgcggatgtggatgctgggggtgctgctggtgcggggcctgacgctgccgggtctgcgggtgccggtgttgcgagtccccgtcgtatatcgtccacatcgcattccgatatgcggaacgcggatgtggacagcgttgatgagggcggcggcgcgggtgacgcgcgcgaaacgcgctacgccttgcgcaacgtggccctccgtgcgctgcccggcgaagtcactgcgatcgtcgggccatccggttccggcaagtccacagccgtccagctgcttgccggcacgcttgtcggatatgaaggcgatgtgctgctgtccgaaatgccatccggaatgcaggacgaagtgctgggcgctatgttaagcagtgcggcgccggatgacagtgaaaccctgaaatcgcaccaaatccgcgacctcaccgcagcatcgctcacccgcgaaatctccatcgtctccgcgcacagccacctgttcgccggcaccctgcgcgacaacctgctcatggcccgcgccgacgccaccgacaacgagctgtggcagacgctggaagccgcgcatatcgacgatttcgtgcgcgcgcaatcgcgaggactcgatatgccgatcacgcaggacggcgcgaatctgtccggcgggcagaaacagcgcattgcgatcgcccgtgtactgttgcgcaggtcggccgtctatattttcgacgaggcgaccagcagcgtcgacgcggacagcgaaacgttgattttgcaaacgattcgcgcgctcgccgacgccgacgcaaccgtgctgatggtcacgcaccgcatggcgaacgcggccgacgcggaccgtgtcgtagtgtttgatgggggtgtcgtcgtcgagcagggcgcgcatgacgatctcatggccgcggacggcacgtatgccaagctgttccgggcgcaggaaagcgtggaacgggtgggattgtctggtcgcgtcgcgccgcgcgtatcgcgtatgactcatgcgtctggtgcgtttgccgtgtctcggatgtctggttccgccgaatcgaacgccagtggcgccaaatcggacatgccaacaacccaagtcatcgcccgcttgctgcgcgaagtcggcccactgcgcaaacccatggccatcgcctgcgcgtgcggcatcctcggccacctcgccgccacgttcctgccggttttcggcgtcgccgcgctgttcgccgcagctggcgcaaaagtctggaatctcagccttcctgcggcaatcgcagccatgattatctgcgcactgatccgcggcggcatgcgctacgccgaacagtacatgaaccacaatgtcgccttccgcctgctcgcgctgttccggtcgaaaacgtttgccgcgctgcgtcgcctcgcgcccgccaaactgtccggcaaaggcaaaggcgacctgatcgcgctggtcaccaccgacgtcgaactgctggaaatcttcttcgcgcacaccatttcgccggttgtcatcgccatcgcgaccaccgtgctttacacggtcgcattgcttacgttgagccctgcgatcgctgtcacgctggtcatcgcgcacctgaccgtcggcatcgtgctgccgaaactcttcgccacggcggtaggcggtctcggtggggatattcgccgcgaatccgcacaacttgatgacgaaatgctcgacgatatgcgcggtctcgacgaaatcatccgattcggccaaggccatgcgcggcttgccggcatcgcgtcacgcacgcgctcgctctggagccgccgtgcccggctgagtgccaagaatggcgatttcgcaggcttcggcgcggtgctggtcgtactgttcactgccatcgcggcattgctggcgatggtcacgtccggtacgacgatgcccatcgcttccgccgcaaccattcaaaccgtcatttccgcgcccgccgcccgcctgaccgccgctttcgtgctgctggccagctcgttcggtccgacgctcgcgttgagcgcgctgccggccaatctcacgcaaacgtttgccgccgcccgccgcctgttcgcgctgatggacgaaacccccgcagtggaggagcggggcgatttcctgccgcgctaccatggcatgtccatgcacgacgtcacgttcggctacggcaattcgggcgaggctccaacttccggaagcgatgcggatgcccccgagtcgtccgccgagccaatcctcagccacgtctcgttcgacataccacaacacggcatcctcggcatccaaggcccgtccggccgcggcaaatcgaccctgctgaagctgctcatgcgttactgggacccgcaatccggcttagtcgcactgtccgaggtgccactgccgcagatcgacgcgcatcatcgccgtcgcgtgcaaacgatgatggggcaggaaacctacctgttcgacggcactatccgtgaaaacctgctcatggcctgcgatatgggcggtgcggatagggctgataatgctggcgatccggacgattccgcgacttccggcagagcgcttcttaccccgcccgctcctcccgtttcgtggaatgccgctgattccgcgctttccacccggacgcccctttctgtcggtgatgacgtgctgcgcgccgcgctcgccaaggcttccgcgcttgaactggtcgactcgctcccgcagggccttgatacccccgtcggcgagttgggagggcggctttcagaaggtgaacggcaacgcatcggcctggctcgcgtcttcctgcgcaacgcgtcgctggtgttgttcgacgagccgacgagtcgcctcgacgcctacaacgaatccgtgattctgcaatcgattgacgcgttggcgcagcaggggagcgcggtgctgctcgtctcgcaccgcgattccaccatgcgcatcgcggaccgcatcgtgcgcatgtgagctggcgcgtgcggattgcgaactgatgcggcgagccgatgcgtgcgaactagcgtgtgaatcggcgtaatgcggggcctggtaggtgcccatgcccatgcggccgcatacggacgcgccgcacgtccgcaatgtggtcgtatgaaaatcgcatgtcattcgtgtttcgtatagcgcgcgcgacggcgtacggaagcggacgaatcgaaagccatagtcgcaggtaaagcaagaaaaacggacgaaaccgacgaaatgtcgacggaatcgaaatcataagccaatgaaacaatcatgaaaataaggttgcaaatttagcaaaaccgactttttggtaggttataagattcagttcgcgtgaaatcgaaatgggaaatcgttagtatcgatagcaaacgattattttcgacgaaaggctggcgatggccaacaacaggaacgaactgaacaagaatctggcacagatgctcaagggtggcgtaatcatggatgtcaccaccccggagcaggcgaagatcgcacaggacgcgggcgcatgcgcggtgatggcgctcgaacgcattccggccgacatccgcgctgccggcggtgtttcccgcatgagcgatccggccatgatcaagggcattcaggaagccgtgtccatcccggtcatggccaaggttcgtatcggccacatcgccgaagcccgcattctgcaggccatcgaaatcgattacatcgatgaatccgaagtgctgagtcctgccgacgacgtgtaccacatcgacaagaaccagttcgacgtgccgttcgtgtgcggcgcgaagaacctgggcgaagcactgcgccgtgtcgccgaaggcgcgtccatgatccgcaccaagggcgagccgggcaccggcgacgtcatccaggccgtgcgccacatgcgcaccatgaacaagcagatccgcgaactcgtctccctgcgcgacgacgaggtgtacgaggccgccaagcagctggccgtgccgtacgatctcgccaagtacgtgcacgacaatggccgtctgccggtcgtcaacttcgcagccggtggcgtggccactccggccgatgccgcgctcatgatggagctgggtgccgaaggcgtgttcgtcggctccggcatcttcaagtcgggcgacccggccaagcgcgccgccgccatcgtgcaggccaccgccaactggcaggaccccgatctgctcgcgcgcctgtccgagaacctcggtgaggccatggtcggcatcaacgaggacgagatcgaaaccatcatggcggcgcgcggcgagtgacggcccgcacggcgcatgcgtgacgccggctccgcgggcagcgagaagcaccgcggagccggcacatccgaaagcacaggaacggtaatggttgtagcagttgaatacatttcgaaggaagaatcggccggcgtcgaagccgcgaaacatggcgtgaccggcatcctcgccgtgcagggcgcgttcgccgaacacgccgccatgctggatcgcctcggcgcgccgtggaagctgctgcgcgcggccgaggatttcgacgattcgatcgatcgcgtgatcctgccaggtggcgaaagcaccacgcagggcaagctgctgcgatcgaccggcctgttcgaacccatcgcagcgcacatcgccgccggaaagccggtattcggcacttgcgccggcatgattctgctagcccgcaagctggataatgattcgaacatttactttggcgcgcttgacgccgtcgtgcgacgcaatgcgtacggccgtcagcttggctcgttcgccgccaccgccgatttcggctctgctactggcgattccgccgttttggttgagccgggcgaacgtgtgccggggttcgctgattccgcgtcgggcgcgggttcgactactgagatttcctccgattccatcgtgctgaaggatttcccgctagtgttcattcgtggaccgtttgtggccgaggttgggtcggccgcgaccgttgagacctcggtgagcggcaatgtggtcggtctgcgccaaggcaagattctcgccacggcgttccatcccgaactcaccgacgacacccgcattcacgagctcttcctgagtctctagattccggctcgtcgcgcacgtcttgcgattttcgcccgtttcgttcgtccgtgagcgaaagggggattcgttccgtatggtttcctaccctttttcgctcatgtcttgcgattttcatgcgtttcggccgttcgtgagcgaaaaggggtgtggcgcgccggtcctttcgtttgcgtttccttgattttccaacgatttcgattttgcgtttgacgtgattttgcgcacgtcctgcgattttcgcacgttccgtctgttcgtgagcgaatgggggtatcgtcccgtacggccttacgccctcttttgctcacgtcttgcgttccgggcccattccgcccgttcataaacggaacgtccaagcgaaatacacaagcagaaatgcggggaatcgcacagaaatcctatccccgcttgtccactgatttatacacactccatgccgcagcgtgccgtgccggcacaaagcatctaccataatcgcaagttatccccgcctgacacgccgaagacacgccgaacatgtgtattttctgcgttctccgaccacaaccccggtgcagctggacatcgaatcggcggaagcaataccttcggaccatgaatggtatcaacgatgtgaatggtccgaacggacaacagcactataagccgttggaggcgcagtcgatcgcgcaacggcagcaggaggtgtggaacgtatgccgcgcgttgaaagatcgtaacgagttgtatggcgtgctgacgcggaactccgcgatcgcaatgtggggtgtgccagatccgtcgatggattcggcgcggacggcagatggtgttcccgtggttcatgtcgtggtacagaccgcgcgaaaccgccgaaaaggtattccgggagtggtcgcgcatgtatggaaagggctgtccgaagaacatatctgtcatacgcaagacggcatcgacgtgcttgctccagagccgacatgggcttcaatggcggaaacgttgagcgttgatatgctggtcgaattggctgaatcgcagatgcgtcatggacggacgacgaaggaaaaacttgccgttttcctcgagggaaattcctttcgtggccgtcgcaagtgccaattggcattgttgctggtggaatcgggcagtgattcgcccaaagagaccgaattgcgattgtgcttactgtcgtatggtctgtctggtttcgctgttggatacgtggtttcgggaatttcgtttgagaatggggctgcggtcacgctcgatctcgctgatccggaattgaagatcggcattgaatatgatggcgaccaccaccgtacggataagatgcagtggcgtcgcgatgtttggaagcgccgtcaactggaaagtatgggatggacgattgtcgcggtcacccaactggatttgtcggatgaaccgcatcgtgccgcgctcgccatgaacgtcgccatgattcgtgcgcgtaaatcgggtcatccggttgcgttgcatacgccggtttcctggtagaaatgctctcttcgcggcttgaaaggctgattatgtcgaggctgccgcattggtgatttggcgcatcctatgctggctcgtgatcctgtgtggcggggtgctgtttcctctgcatttgatgagggtattgctggttctgtttttatgagattcgtggcttttcgctcacgtcctgcgatttcgtcccgtttcgtcgttccgtgagcggatgggggtatgttcctctgtgttatggccccctctttctttcacgtcttgcgatttttgtctgtttcattcgtttgtgaacggaagggtgcattccgcttcggtttgtccgttgctgtttcctttattttccaacgattccgatttttgaaggagaggcttttcgctcacgtcctgcgatttcgtcccgtttcgtcgttccgtgagcggatgggggtgttctcccgtcctgcaccaccctctttcgctcacgtcttgcggaaaattgactttcgtccggatgtgtgcgaaaagcgatatcgaatgagggcgattctgccagtcgagcgccagtcgatcgcaaatgagcgtaactaatcgcgagcgaatgccagccggtcgcagtcgatcgcaaatacatgcgtatgtctggatttgacagaatcgcaaaagtatttaagattaaaaatatcaaatggtacacggttgtaccaaatacgttcggaaaggcaatgacgtgcagattcataccggcaaacccgccgtacccaccgcaacccccaatcgccagcctttcgcatggccgaaactgctgacggaaaacggccgcggtatcgcattcggcggcgactacaatcccgaccaatggcctgaggagatctgggacgacgacatccgcctgatggaaaaagccggcgtcaacacggtcgccctcgccatcttcagctgggaccgcatccaacccaccgaggatcgttggaatttcggctggctcgaccgcatcatagaaaaactcggcaaagccggcatcgcaaccgatctggcctccgcaacggccaccgcgccgctgtggctgtacgaaaagcaccccgaagtgctgccgcgcgacaagtacggccatcaggtcaacgccggatcgcgccagtcctggagtccgaccagcccggtattcaaggaatacgcgctgaccctgtgccgcaaactcgccgaacgctacggtagcaacccgtacgtgaccgcctggcatatgggcaacgaatacggctggaacaaccgcgaggactactccgacaatgcgctcgaggccttccgcgcatggtgccgccgcaagtacggcaccatcgacgcgctcaaccaggcgtggggcaccaccttctggggtcaggagatgaacgacttcgacgaagtgctcatcccacggttcatgggcgccgattccatggtcaaccccggtcagaagctcgatttcgagcgattcggcaacgacatgcttctcgacttctacaaggccgaacgcgacgcgatcgccgaaatctgcccggacaagccgttcaccacgaacttcatggtctccacggaccagtgctgcatggactatgccgactgggccaacgaagtgaacttcgtctcgaacgaccactacttccacgaagggggtgagatgcaccttgacgaactggcgtgctccgacgctctcatggattcgtttgcgcttggcaagccttggtatgtcatggagcattccacttcggcggtgcagtggaagccgctcaacatgcgcaagcgcaagggggagacggtgcgcgattcccttgcacacgttgccatgggcgccgacgccatcaacttcttccagtggcgcgcgtccgcatttggcgccgaatccttccactccgccatggttccgcacgcgggagaagacacgaagctattccgtcaagtgtgcgagctgggcgaaacgttgcgaacattggccgatgcgggtgtgcagggtagtgagctggaacgctccgacacggcgatcctgttcagcgccgaatcggaatgggccacccgttccgaaacgttgccgagcatgaaactcaaccattggcacgacgtgcgcgactggtaccgcgcgttcctcgatgccggcacgcgcgccgacattatgccgctgaaatacgattggagcgattacaagaccgtcgttttgccgaccgtcctgatgctgagcgccgtcgatacgcggcgattggccgatttcgcggccgccggcggcagggtggtggtcggttacgcgaccggcctgatcgacgagaatttccatacgtggctcggtggctacccgggtgccggcaacggcctgctgcgcgacatgctgggcatccgcggcgaggaattcaacatcctcggcagtggcgtggaaggcgagccggaggcgattcggctgggtgccggcggtgaggttgcgctggaagatgcagccgcgctgaacggcgccacgacccgcctgtggcagaacgacgtgaccgttaccggcgatcgcacgcaagtcctcgccatgtacgcaggcgaggaggccgacgaatgggagctcgacggcatggccgcggtcacccgcaatccgtacggcgcgggcgaagcgtatttcgtcggttgtgacctggacgtggccgatttgacgaagctgattcggacatatcttgcggcaccggcacaatcgcagcaatcgcaagctaataccgacgttctgcacaccgtgcgcaagtctgccgacgccgcgttcgatttctatctgccgcgcggcaagaaggaagtcgaattgcagggcgtcgagggcgagccggtcgtcctgttccagacggaacggggtgaggaaaacggctcgtataccgtgcgccgcaacggggttctcgtggtgaggcgctagaatcgcccctgtagcagggatactgggcagtatttcgaagcgtatcgggggaaccatgagcgaagcgagacctttcgcgtctcaaaccggcaaatcgccatcagaaaagaagcgcgtcactttgcgtgacgtggccgaagaggccggagtgtccctcaaaaccgcgtcgaacgtcatcaaccacaccggccgtatgaccgacgccacacgcgaaaaagtgcagaaagtcgtggatcggctcggctaccgcgtcaacgtgtccgcgcgcaacctcaaccgtggccggaccggcttcatcacgctcgccgtgccatgcctgaccgccccctatcttgcggggctcgccaatcgggtgatcgacatcgcgcgcatctacgactactccgtgtacgtcaccacgtacgccgagggcacgtcgcgcggcgccgcctcgctcctgcgcaacttcaacgccaccgtttccgacggcatgatcctgtcgctgtccgaaatggaggaccttacccccgaagacctgtctgtggattttccgctggtttgcgtgggcgcgcgattcacgcatcacaaggcggaccacgtcacaccggacgacgtgcaaagcgcgcgtctcgccacggaatatctgcttgaccgtggcgtcagcaggccggcggtggtcggctcgcgcactgatttcgcgcagctttcgactttgcgtgatgctacggaaggcaacgcgcagcttcgtatgcgcggcgtgttcgaagcgtgctgtgaccgcaatatcgcgcttgccactgagctgatgcccaacgtcggccacgattggtcgatcggctctggcgcgcgcaatatgcagcgcatcatcgattccggcgtgccgttcgacggagtgatcgcattgaacgaccagcttgcgatgggcgcgctgtcgacgttggcggccaacggcatttccgtgcccgaccaagtgcaggtgatcggcttcgacaacaacgaggaatccgcgtatttccagccgccgctgaccaccatggattcctgcctcgactggatagcgccgaccgcggtcagtcgcatcatcgaccgcatcagcggcagccgcgtgcttcagccggaactgatcaccacgcagacccgcgtgatcgcccgcgccaccacgtgcgcgtagacgcgtaagcatgtaagcgtgcaaacgttgctatatatgggcgattgaggtgcgttccgcctgcgctccatgtttcgttagcgtaccctgttacgtcggcgaacagaccgtacttgcgatcgtcccttacttttccggcacggcctgcgccgggcaggcacgcagtacggacagcatcgcccgcttctccttcgtcgtgacggtcagcccgtacttggctttcacgccgatctgacgggccacgtaatcgcaacggtatgcgccgttcgtcggcagccagtacgcggccgacgcggagcccttctcctgattggccggcccgtccaccgccagcaggttgtacatgtcgttgccgaaccggtaccgcttcgtacggtcccactggttcgcacccgaccgccaggcattctccaacgccaccacatggtcgatctgcaccgccgacgaggtgcgcgcgccgcgtacgaagtggattgttttgccggtgtacgggtcggccagcgtgcccgattccactttgcatccatgctgccggtagcgcacgtcggtcaggtcgcgcgccagtacgtcttcgcgcacgtcgcatccgttgccgtcgtcgtcggtttggcggaagccgaacaggtcgcgatcgtagccggcgtgccgctgattatcgtcgaccgtcagctgctgcagcgtctgcgcggcgctgccggacgcggtgtattcgcctgttatttcgccgacggtcgggtttgctttcggcatgagcaggccgatggtgacgcccgccaccacggcgatcaccagcagaatcagtatgcgttccaccggcccgtcggcattgagcagcttcttacgaaaatgcgtgccgtcacgcgatccgtgccttgtcatcgcaccctaagcagtctcacgcgtacgtgaacgtcatcggatcgtgcccggcgcgcgtcggcccgtcgagcgcatcgatggccgcatgctcggccgagctgagtacgaaaccgaacaggtcgagattctgccgctgccggtccgcatgcaccgacttgggaatgatgatcgtgccgttttcgatgtgccaccgcagaatcacctgcgcttcggtgacgccatgcgcccgcgcgatgcgttcgatcacaccatcgccggcattgagatccgcgccacgcgccatcggcgaatacgcctcgaccgcgatattgtgcgccttgcaatacgccaccacctcgcgctgctgccacgtgggatgcagttcgatctggttgacggccggatattcgcccgtttccttatgcagccgctcaagatgctccggcaggaaattgcacacgccaagcgtacgcacgcgaccctccgcgcggaactcgtcgaacgccttccacgtttcgccggaacgccaattgaacggggtgggccaatgcagcatatacatgtccacataatcgagctgcagcaggtcaagctgacggtcgaacgccttgcgtgcggaatcgtacccctgttccgaatcgcgcagcttcgtcgtcacccacaggttcttgcgattctcaccctgcgtgaagcccgcgttctgcagcgcacgtccgacgccagcctcgttattgtaccccgcagcgccatcgatatggcgataaccggcttccagcgcgctctcgaccacgggggtaacgccctcgtcgtcgatgcgcagcacgcccaagccgatctgcggaatcagattgccgtcgggaagcgtgatcatcggagtgtggaaaacagccatggaacaaccccttgagtcgaaatgcaatgttcttcgcaccagtgtagcggctgttgcgctcgtaggttgtccggcctgtgtccgcgacccgcctgaacctgtgcgtggcagcccgcctgaacctgtgtccgcaacatcggcaacctgcatcggcagtctgcgtcaacaacctgcaccaacaacccgcactggagccctgcgcttaccccgcaccagacgcatatccaacgattattcaacctcccgtaacagacgtaacaattccgtgcgggcggacgcgctataacgttgcccggatatgaagaacgatttggatatgaagtcggatacagagaacgaagaagacggcactatgagtacggagagcgcggacgtgcggcccgcggagagcacggacgcacggcctgcaggagcccagcaacccacgcaccaccactcccaaccgtcccaccaccacggccacgcgctcgccggcatcctcggccccgcgttcgtggcggcggtcgcatacgtggatccgggcaacgtggcggcgaacatcacgtcgggcgcgcgctacggctacctgctggtgtgggtgctggtgttggctaactgcatgagcgtgctcatccaataccagtccgcgaaactcggcatcgtcaccggcaaaagcctgccggaaatcttgggcgaacggcttggcgacgcgggccgtttcatgttcttcatgcaggctgaggtaatcgccatcgccaccgatctggcggaagtgatcggcggcgcgatcgcgctgaaactgctgttcggcctgccgctgttcgtcggcggctgcatcatcggcgcggtgtcgacggtgctgctgattttcgaaaaaggcgccacgcatcgcattttcgaaaaactcatcatcggcctgctgctggtgattacgttcggtttcatcgccggcctgttcatcgccccgccaaatccgaaagaagtcgtcgccggcttgattccacgcttcaaaggcactgataccgtgctcatggccacgtccatgctgggcgccacggtcatgccgcacgccatctacctgcattccacgctcgtcaacgaccattacgcccccggcgaagcgaagccgagcatcaaaaagctacttcacggcagcaaaatcgacgttgcctgggcgctgatactggccggttcggtcaacctcgcgctgctcatcctcgccgcgaactcgctgtacggcatgaccggcaccgacaccatcgaaggcgcgcaacgggccatccagcatgtgctcgggccggtgatcggcacgattttctcgattggtctgcttgcgtcgagcctgagctccacgtcggtcggcacttacgccggcagcgaaatcatgcacggcctgctacgcatcaaagcgccgatgtgggcgtgccgagtggtgacgctggtacccgcgctggtggtgctatggttcgccaacaatccgacggaagcgttgatcgtcggccaggtcgtgctgtcggtcggcattccatttgcgattattccgctgatgcgctacacgcacgaccgcacgctgatgggggagtatgtggacggtccggtcaagcacgtcgtcaatatcgcggtcgccgcgctgatcgtcgctctgaacgtggtgctgattgtgctgacaatgctcggcaaagcctgattttccgtgatttttacgtcgatctccggcggatttgcggcgcttttttcgtagtttctcagctgattttctagggtttttcccgcagatttcctgcggatttttccacgaaacctacgctgcctgcactttcccgctgtcataatcgaccacggtgtacatgcccttcccctcgcgcttggactggtacaacgcatggtcggcgaatcccaagcagaggttcagatcgacgttcttgccggacagcacgcggcatgcgccgatactgcaatgcacgtcctgcccgtattgcgcggacgcctgcgccaactggcggcggaacaggtccagcgtgctttcgatcacgcgctcgttcgcggtgttctttatcagcgccacatactcatcgccaccgaaacggacgatgatgtcatcatgccggtacagccgcttcaacgtctgcgccacttcacgaatccagaaatcgcccactttatggccgtacgtatcgttgatctgcttgaaatcgtcgatgtcaacgaaaatcagaacagcctggtcgccttcctgcatgtgcgcgaaataattctcaatctgctcgcggccggcgctcttgctccacaaatcggtcagaccatcgtgctgcgcctcgtagctgaccttctgataggcgtcatcctgcgaacggattttcttgttcatttcgatggtgtcgaccacgaacgtgaactggatggaaatcgtgatcgcgatggcctgcaacgccagtccgtaatggagaatctgaacgatggttgccacaatcggcagcacgaagaacgacagcgacgtgacgaacagcggtcggctgaggtttttgcggttttcgatgatcagcatcacaatcagcgcgagctctaccagacccagtatctgcgggatagcgaacagtggtccgcggcggtagtagttctggctgtcgatgtagtagaccatatggttgaactgcgtggcaatcgtcagtacgatgccgagcgcggacgctgcgtagatgacgtcaagcttcttcgaacgcggctttttcggcttggattgggcgttggccgaacgttggttcttacgattacgcttggctccgccgctcgttctggccctccactcgtgcgggctgacgttttcaagcatgtcgtcgccgctgacggtttgccagatatagttggcgaacagtgcgatgaagatgaaattgatcaggtattcaccaagattgccgatgcgcgtcatgtagaagtcaagcttgtcgcagccgccgttgtgataccaggcggacacgtcggccagcagcatcagcgcacatagaagctgcatggaaactttcgtataggtacgccgcgtcctacgtatcgcgcccacgtagacgccacctgcgcaaacgatgcagatgagaacgccccatagctccatcgctatgttgaataacgtgactacggtcatacttcctaaccccctgcgcggcgtattccttccctgtatcgtgccgttactgccaacgcatatgtataccaccccgagatgaacaaatacgaagttttgccaatttttctcggttgaattggaattgaacgtgttcgaatagtttcatctcgcgttcgaccacccgcagtactagactttttgagtctgtttttgcaggagttgcgcaatacgctgcgagtatgcgcggatgagtgatggagggcggtcggtttgccgtcgaaaccggagaagaggtcggaagtgaagccggaaaagaaaataaacgcgaaacagggccgcacccacggcctgtcccagccgcttaccggcgaggaatcgtataaaaacgaccatctgacgcatgccgcgttcgtatcgatcgccattctcacctttatcacgttcgtcggcaacttcactcagctgcagttgagcgccgcactgcccaccatcgtgtccgatttcggcatttccgtgacgaccggccaatggctgacgtcgattttccagctcgtcatgggcgttatggtgccgctcaccgcctacctgacccgccgattctccacccgccagatcgtgatcgcgtcgatggcggtgttcacgctcggctcggtgttcgcctggctcggctcatcgttcgtactggttttgatcggccgtctgctggaagccgtcggcaccggcgtgatgtggccggtcctgcaaatcacggtattctccatttatcctctgtcccgccgcggtatggcgatgggcaccgtcggcatggccatgagcgtcgcgcccgcgattggccccaccttgggtggtgtgcaaaccgatttgaacggctggcgatcgattttcctcacgctgacggtcatcggcgttatttcgctgcttcttgcgattttcggcttgcgtaatttcggcacgtgcgacgcgtccgccaaagccgacttcttctccgtcggcctgtcgattttcggcttcggcggcctcatgttcggcttcacgaacatcgaatcgtatccgttcacgcatccgatggtgtggctcgccatgctcatcggcctggtcggcatcgtctggttcgtgctgcgccagatccacggcgctcgcaggcaggctgccgacccgtccaagcagcctccgctgctcaacctgagcgtgctgaaaaacaagagcttcaccgtcggcaccgtcaccgccgcgctgtcgttcttcgcgttcagttcgatcatggtggtcatgccgctctacattcaggattgccgaggctattccgccacgatcagcggtctggtgatgttgcccggcgcgttcggccagtgcattgcgcagttcttcggcggcaaggcactcgaccgtttcggcgcgcgtccggtggcgctgatcggctcgatcaccctgctgttcggcaccattatgatgagtctgatttccatgacctcatggatttggtgggtgtcgatttggcagttcgtgcgccagatcggcatgggattcgtgcttatgccgatcaccacgtggtcgctgaactgtctggaacctgaggaggtgagcgacggctcggccgttacgaacacggtccgccagattgccggtgccatcggcgcacccgtgctggtgattctgatggaaacgtttaccgccctgcgctgggctgcgatcggcggcgcgaagaacatgtatgccgtggcgaacgtgttcggcatccagtgggcgctgcgcgtgagcgccaccatctgcttcatcatggtggtcatggtcttcttcggcgtccgcggcaacggcgccggctccacccgcgacaccgtccagcgcgccctcaatcgcgtccacccccacgccgcctagcctgacctactcgcccatacccgcattttcgccgttccgtaggcatgtcctgagcgtggtttgctcaagtgccgccattccccgcagcaggaaatgagagagaaatgtccgcatagtggcatgcggtacgggtgcacgtaaaagcactgtgaacctcgcgggaaggaggtggcgcacccgtgccgtgttgcgtatggtgaacgggaacgtaatgaaaggcaaccatgcggcaaacctgcgaaagcgagcgtgagaacggcggcaataacgatgccgaacgcgaacgcacaagcgaaagcgaaatcgaggatctgggcgcgcagctcgacaaagcatgcgccagccgccccctcgaccgcgcgcaacatggcatgacccgccgtaccgcagcaacacaccttctgaccgcggtgctctggctggacaccgccgtcatcctgctggccatgctgctgcgcatgctgcccaacaacctcgacggcaaacggtacgtgccgcttatcgtcgcgctgatgccgtggctgggcatactgtctttgattattgcgatcaccgcgatagccgtccgtgcaataggcgaacgcgtcctactcgccaccgtcagcgtggtgtgcgtggttgtgcaaatcggctggcattggggttatatcaggccgcagcaaacgatttccgacgcggccagcaccgcagtcacgcaggtctcgtccgacggcttgcccaacacgtccgaccggtacgcccgcatcatgaccttcaacaccaaggaagggcatgccgacgccaatcggatcgtcgaaatcgtcaaaaacgagcatgtggaagtgctcgcgctgcaggaagtgtcatgggacttgctcaaccggctcaacggcgccggaatcgccaattatctgccgtattccgtggccgcgcagcaaacgtggcatgacaacggcggtgtgaacgtgctgtacagcgccgcgccgatggaaaacgccaaacagaacctcattcccgtggaatcaagcagcgtttccgccgcgacgatcgatttcggcggcagcaaggtgcgcttcggctccgtccacccgttctcgccgcgcccccgcaaccaaggtctgtggaaccgtagtctcgactcgctcgcccaactgcagcattacgacaatctgtacgtgctgatgggcgatttcaactccacatgggaccacgccagcttccgatacctgctcggcagccgcttcctggattccggccagcaggcgggcgaaggcctgcacatgacatacccggccataatgccgatcgccgaaatcgaccatatcgtgcatgacaaaggcgtgaccgtaggcaacctcaaaactgcatacatccccggctccgaccaccgcgccctcctcgccaccctcgaagtcgcctgacccgcacctaatctgcgcttgaacatatctgcgcatagcaaacatatccgcacgtatccccacatatgcccctcaacgtaccaatagccgcaaacacgcctgctgctatatcgacatttttgacattatgtaggtataggaatagtctatattcaccccgaacctgcatattctgcacaaatgacggttataaggatgatggttatggagtacaaaagcatacggcagacattggcaatgtcatcatccacggccaagccgaaggatgcggctgaggaggaataccaaaaaagactcaacggctattcaacataccggtcaggtattgaattcgaaggtcatgagatgttcgccgtggcgttcagggaactgttgaacgtcatggattcggtccgtggcatggaagtgcaggtcgaatcgctgtgggccgcattgccgccgattgcccgcagggcgtatctgatggaactcatcggcgcggaaatgcagagcacgaactccatagaagccgtgcacaccacgcgcaaggaaatctcagacgcgttggatgcggcggtcgcggacgggccgcacaagcggttgagtgagcttgccaaactctttctcggactctccggcgaaaattccgcaacgttggaactaccgaaaacgttgcatgacatacgtaatatttacgatcaggtgatggctggggaactacgggaggaagacaagcctgacggaatggtattcagagccaagcaagtctctgtgtgtgacggctttgaccgggagattcatcaaggcgcatggccggaatcggaaatccaagtgcaattgaccaaatggctggcgttgctttcggatgaggcgattcctccgctgctgcgggctgtgatgtgccattacgccttcgaatgcattcacccgttctatgacggcaatggcaggacgggccggttcctgcttgctctgcagctgagcaagcacctgtccataccgacggcgatcagcctgagtccggttatcgccgacgcgaaaggccggtattacaaggcgtttgatgatgcgcagcatccgctgaactgttctgacgtctcgctgttctcatatcggatgatccgttttatcgccaccgcccagaagaacatcatctctgtgctcggcgagaagaaaaccctgcttgacaccgcgcggaagaggcttgaacattatgcgcgaacgcagggcattacggaactgcagcggaacatgctgtacttcctgctgcaggaggagcttttcgacgatgctccgaaacccatatcgcgccgcctaatgcgcgaatggcttggcgtgggggagcggaagaccaacaccgcgctcgcggaactggtgaacaggaacctgctcgagttccacggctcccgcccgatccgctattcgctgaccgccaccgcccgcgccgaatttctgcaatgattctgcgcgtattggacgatttgccgcatgcggggaacgcctcgcgctaaaatttccgtttggcgggttgcggaagccatggtggatttcgcaaaaccgcaacacgaaacgttggaagaacggttaaggggtttaggcatgcacatcatgttcgtctgcacgggcaacatttgccgttcccctatgggcgagcttctgatgacccactatctgaacggcaccaccgtgcaggtgtcaagcgccggcacgcgtggtttgccgatgcatccgatcgatccgtcgagcggccgccttatgcaaagcgtcggcattgagtcgagcggcttccgttcccgacgactgacccgacagatggccgacgaagccgacctgatcctctgcttcgaaaagcagcagcgcaaggaaatcgtcacgttggcgccagccgccgtacgatacacgttcctgcttgacgatttcgcgaatatgtgcgattactgcgctcgcaacaatatgattgccggactgaccatccaggaacgtcttcagtcggtaatcaagaagtcctcgatgattcgtccgatgattccccagccgaaggacatcgccgacccgcatggccgcgaattcagcatgttctgcgtcgccgccgaacagacgaacggtgcgatccgcaaaatcctgaaaagcatgcgcaaacaccgtgcggtaacccccgcccccatccgctcccaaatcgttgcctgataattcttttaggtccatggattgattcaccatagcttggccctactcttttttttgagtccgagcgtgtttgtgatattcacccattttttattattgatattttgatttgattggcatgttgcatgccataagaggtaaagaagccctttttgagcatctcttgaaagattaatttcaggattgttggggttgggctgtcggtggcttggggtgaggcgaggatgctttgtgttgcaaggtggtattggttggaaaattttctgaaacgtttgcatatgtgaatttgcgacgatagtgggtgttacggggtgctggtatgggtgtatctgttgctgacagcgtttgcaacagagcagaaaacaattgcgttttaaccgctgtttttcagtaaaaatcactcatttttcaaaggaaaaatgtggtatttttaacgcaacgtatgctaatggcaaacgttatcatatcgaagatgcaaggaagcagggagggtaaagtgcgacttagcactcatacgttcgcgggtatggcgaacgcactcaccagaaaagagcctcctcatgaggatcagcctgagctgatgactcgtgcggagcgcagacgcgcggcccgtaaagcacgcgccgtcaagacctggaagaaggtcgcagcgggaacggtggcggtcgccacattgttcggcggtatgggtgtggcatccaccgcacttgccgccgatcgtgacagctatcaggacaccatcggaaatccttctttcgagtcggcccgtaaccagtacggtctgaccaagcacatgaagaacggcgccatcctgcacgcatggatgtggtcgttcaagaccatcacgcagcacatgcctgagatcgccgcggcgggctacacctccgtgcagaccgagcctatgagcaagatcaaggaagtcgccgccaacggcaagaagttcaccgagaactggtactacgtgtaccagccggcaaacacctccatcggcaacttcgtggtcggcaccgaagccgacctgaaggaaatgaccgccaccgcccataagtatggtgtgcgtgtgatcgtggatgtggtcgccaaccacttcacctccgattggaacgccatcgaccccgattggcaaaacaaggactacttccacaagcgtaccggttgcgacggccccaacggcgagatcaacgattattccaaccgttacaaggtgacgcagtgccacctgcttggcctgtgggatctgaatacgcagaaccaagctgttgccgatcgtatgcagaagttcctgaagaccgctgtggcggacggcgttgacggcttccgttacgatgcggcaaagcacgtcgagctgccgaccgaagtcttcgacaataagcagtcgaactactggaacaccattctgaagaacggctcccagttccagtacggcgaggtgctgcagggcgattccggccttgactacaaggcatacgccaacatgttccgcgacaattcctccgatggcggcggcaacaccgcttccaactacggcaagaccattcgcgccgctgtcggctcgaacaaccttgacgtcaagatggtgaagaacatcgataccggcggcgcaagcgaagaccagctggtcacctgggttgagtcccacgataactacgccaacggcgacaaggaatccaccggcctcaccgactatcagatcatgatgggctgggcggtcgttggttcccgtagggccggcgctccgctgtacttcaaccgtccgaagggctctggcggcaccaacccgcagttcgccgagcagtcccagctgggtgacgccggtgacgacatgtggaagaacaagtccgtcgcggcagtcaaccacttccgtaacgccatggatggcaagggcgagaacctgcagaactgcggcgacaagtcctgcctgatgattgagcgctccacgtctgatggcattcagaacgatggtgtggtcattgccaacatgggtggcgacaagagcctttccggcatggaaaccacacttgacgatggcacctacccggatgaggtcaatggcggccagcttgtggtctccaaccataagatcgtttccggtaccgccaagggcggcgcggtcagcgtcttctacgtgaagggcgaatccgatccgaacgtgtccgtggaagcggcttccaaggaattctcctccgacaatgtcaaggtcacgttgcgcgcgcaggatgccgacaatctgaagtacaccaccaccgagggcgagagcggctccttcactgacggaaaggtcatttccgttggtaaaactctttccatcggcgagaccgctaccgtcaaggtgaccggcaccgccgccaaggatggcaagaaggttaagaagggtcaggcgctgagcgcttccgtgaccgtgaagaaggtggaggtcccgaagcagaaccttgccgcgcagtacagtaccaacaaggtgggcatgggcgtcaagaagaccatcaacttcaacgccgggaaggatgcgagcatcgctgactgggacagctccatgctgatcgcgcagggcgccgccaacgacgacccgcgcgtgtaccgcccgaattccatgtatgaggttccgatcgatctgtatgcgttgtatggcgcctacgatgacgacaacctgtacctcatgtgggaaatgactaacgtgcaggatgtcgtcgacactggcgacgactaccccctgagccaaggccacctgtggcagacccagaacctgccgttccacatcgccatcgacaccaaggatgacagcacctgcatcggcaacaacggcggtctgcagaccggcggttccctgtgggcatccaacatcacttggggtggcgagcagaagctcaataacgtggtgaccatttccaccaacggttccaacgggccgtggatttacaagggcgacgagagcggtctgaactccaaggctgcgtatggtccggctgctaacgccgccaccaacaccaagaagtcgaacatcaagttcggctatggcaatggcattctaagcaaggatgtcatcggcatcgacggtggctggggtgaaaacaacggtcgtttcatcggcgatatgaaggccgagaaccagaacaaggccaagtgggtcaacttcaacgagaagggccacaattccgctcagatggatgatcactacgagatcgccatcccgctggaagagatcggcaccaccgctgaccgcattgcctcgagcggcatcggcatcgaactggcagccaccttcggtctgtccgccatggattccctgccgtacgatctggcaatgaacgacaatgccgacctgccggacaccggttctcaggtgaacaactccttcgagaagtccgatgacgacatgttcagcgtgaagatggccaacatcggcggcgaagagcctccggtcgaaaccaagtctgtgaggattgatcagtcggattacagcgtggacctgtccaatggcgtggccacgaagcagttgaccgccacgaccgatccgaagggcgcgtccgtgagctggagctcgtccgacaaggacgtggcgaccgtcagcccgaagggcgtggtcaccccgaggaaggccggaacggccacgatcaccgcgaagtccgggaccaagacctcgacgatcaccgtgaccgtgaccggtgagcttcctccggacccggtcgcgaagaacaccgtctacgcttcgaagccgtccggctggggcaagatctacgcgtacgtgtacaccggcgacggcgcgaccgcggtgaacaacgcggcctggccgggcgtggagatggccgccccgagcgcgaccgacggctgcggcaagaccggcctgtacaagtacgtcgtgccggacaacctcgcgtccggcgcgaaggtgatcttcaacgacggcggcagccagcagtatccgggatcccgccagccgggcctagactacaacggcggcatcgtgaagtgggacggctcctccgcggccctgggcgcggtcgagtgcgagaccaccatcccggtcacgtccgtctcgatctcgggtgacggcgtgaaggacggcaagctgagcctgaaggcgggcgcgagcgtgcaattgaccgcgacggtcaggcccgacaacgcgacggaccggaaggtctcgtggacgagctcggacagctcggtcgcgaacgtgatgggcacgggcgtggtcacggccggctcgaaggccggcaccgcgaccatcaaggccaccgcgggcggcaagtccgcgtccgtcacggtgacggtctccggcccgcaggatccgtacgcgcaggtggacgcgttggcgaaggcccacgcgtcggatctggcggacggcgagtacgtggtgtctaccgcgttgaaggacggcctggtcctggacgtggcgggcggttcgaagtcagacaaggcgaacgtgcaggtgtggtcgtcgaacggctccacctcgcagaggtgggtcgtgtcccatgactcgaagggctatgtgacgctgaaggccgtgaggtcgggcaaggtcctggacgtggcgggcggttcgaagaagcctggcgcgaacgcgcagcagtacgcgtcgaacggctcgcgttcccagaagtgggtcgcggtgagggacggctcctcgtacaggctggtgtccgcgttggcggatggcctggatctggacgtggccggcgccctaaacccgaaaaatcatcgtgactaaacccgcaacaactaattgaacacaaacagggcggcaccttcgagagcacgttgcgcatgaagtgcaccatgcaccgctggtacttcgcccggggaagcatcgagttcaccgtggagacgagtcccgcgcaccggtcgccgaccacgaggcgcacgcccttcaaaccgcgttcgatcatgcttcgtatgaactgctcccagctggcagcgtcctccctcatgccctccgtcacgccgatgacctcgcggtggccctccgcgttgacgccgatggcgacgaggacgctgacgttctccacgcttccgccccaggagcgcttgtgccacacgccgtccatgaacacgtacgggtattcggattccaacggcctcgtgcgccactggtcgatctccccgtagatccttttgagcttgtcgctcaatgtctgcgagggcatgcggtctccccacagcaattggctgatgtcgtcgacctggcgggtgctcacgcccgccaggtacatgtcgatcagggattcctcgacgctctgctcgcgccgccggtagcgttcgatcaccgcggactcgaacagggcgcccttgagtttcggcaccttcagctcgagcctgccggccttggcggtgagcttgcgttcgtagtggccggccctgtacgccttccgtcccccgctgcgctcgtatctggcggccccggtgatctcgtcggcctcggcgtcgagcatcgcgttgaggatctgcgtcatcttctcggtgatcagccggtcgagcctggtctcgagcaggttctggtcgatctgtatgatgttctcgggcatggttccgtctcctggcttccaatcgcggttttttgttttggcgaatgaaaatcgtacacaggacgcgggccatgccctcttacgtcagggccggaatccgaaagtgcgcaagaattcgggcgttatccatggacagaccgaaaacgacattgttagaaatatgaagcaaattttccaaaaacttggagacgaatatctgaaattcattaaccctaatagcaaatgcatcaaccttccaaacactatagaaaatcgacaaatcatcaagaccctacgcaattggaagccggaactcatatcgcagactgaagaaatcaatgagggagattcaatcaaaattaaacgagaccagaagctctggaatggattcttcaagcagggtgaataatcttgcaacccttagcgtataacgaagatggatggtgggttgggtggttagcagataaatcatctgttaaccacccaacccaccactttcagtcgtctatctcaatcgcatgaatcgtgacttcgtcattttccaaggcattggccttcttgaattccgggcgtagttccataccatcctggtcgaactcaccgttcaagttgcgtaccagcgtatcggccaatcggccacccatgggtttgaacgtcgcataggttatcgccccggaaatggcgccgccgacaacgggcacaaccttggcaacggccttcccgaccgattccttcaccacctgtttgccgaccagtgcgccgattttcttgagcagtggataccaggccgttttcatcagagcctgctgagcgaccttcttgcccatattcttgccgacttccctggcgacttttcctatcagcatcgccgcacccgacgcaccgaacattacgcccaaatagacgagaatgcgcactttagcatcttcgctcagctccgactcgtcggataacagatcatcctcaccaaaaagataggcgattttctgcgccaggttgatcgcaacaccaaaatattgagccacgtcagcgcttccggctgcaacggccatagggccgccagggattcctgccacgaaggcggcgagagtggtctgattcgtcgacttcttaatcaccccatccgcttttcttcgcaacgactccgccgtatatacatgctgtgggccatgctccagaatctcatcgagatattccgaattgacgaattgctgtcgcaggaacgcttccctatcaactctaataaccggaagcttcgcaacgcttccaatcatatttatcgccacatcgtaaagctcttcgtcggttttcttagccatgttctctccactccgataagacgcatcgtgcttaatgcccatggtatctgctcctttatttgttcgatggataacatgcgggcaatccacattcaccatgggccatgttttctccgcgagcgcgacgggctttcaacagataggatctgcttccaggtcagcaattcgtcagaatgcgtccgcgcgccttcacacactctcagcactctcatgcatctacatctcaattacatactttgtcactcatgcggcatgttcaatcgccaaagaatgtacagccttttatatcagtgcccatccaaggctacgtttacgtcctgaaatacggtgggcctccttttctatctcattgctgctacgaatagcagcaacagcttccaagcctcttagcaatgctcaaatccagggtctcttccttttgccaagccacataggcatatataaatcaacattccgccttctctgaactacactgttcctagaagagtttcagtgttgaaaggggtaaccgatgacacgcaaaggtgggtttctgaaggggatcgtcgcatcggcggcgacctatgccgtcaaaacggcggtcgacattgcggccaatccggaaaacatgcagaaggtggcgcagcttgtcagcgaacaacaggtaggcagcaagcttaagcaggccgctgcgaacatgcatctgccggccgcgcttagcccatccgcaagagtcgccaagcagcttgacgccattgaggagacactggagcaatacgccgaccgatttcccgtaaacgcaccagtcgaacgatggaagagtaccctgcaaagccttcgtcttatggacgtcatgaacagatccacaaccggcagcgagcataagaaccgcttagaaaagctccagacgcagaccgaagccctgttcaacgagatcttccaggctctcgactcgggcgatgcccagatcgaagactgaccacttccccaccgctttcatacctgtcccccgccactcccaagcgcaccgacgcgtctgccggtcgtatactgctaccaagtggatttgaggggaataaccatgatcgacgacgattccaacgaactcatcccattcgaaggcggagacggtgatgccgatgccagcaccgggaacaacaatccagacgacacgcaaagcgtcaccatcatccaagacgaacaaggcatcgtcttcctcggcgacgccgggaccatagatctctggctcaaggacgaaggcttcgattccaaggctttcacggccaaagtcatacagaccgtctcgtcggccagcaaaggcgcacaggcagccggcaacgccatggccgaaagcggacgttgggtaaaactcaccaaagaatcggctgagctggtcgccaaatacggcaagaactgtaagaagggaccgttccaagccggtgttgtacggcaaccgaacgggcgcatcatcaaacatttgaaatttacccagcccggacagctcaaccccgctttactcaccggtgtcagcggcgtcatggcacagatggcactggaacaagccgtctccgagatcaccgattacctgaaggaaatcgatgcgaagctcgatgatctgctacgcgatcagaaggatcagaccgtcagcaagctcgccgggatatcccgcatgatcgacgagaccatgttcatctaccaacaggtcggttcgatcagcgcaaccacatggtctaaggtgtcaggctgcccgcaagacatcgccaccatccaagcgtacgcgatcgccaaaatcaagagcctcaccgagaaggctgaacgcgagcaggatcccaagcaggttcgcccgctgacccagcagattcgtcaggagatccaccagtggctgggcatgctcgcatccgcggtcaagatgcaggatcaggtctcctgcatcgagctcgcgcgcgtatgccaagaggagcctgaacagctcgaagcatacaagaagggcatcgtacttgccaggaacaagcgcctcgaagaaatcgagcaatcgctcaacgcattgggcaagcagctggaggagaaagcgaaaaccgtgggcggacaagtgctactgaacccttacagttcacctcatgccattgccaacatcgaaagtatcgccagcgatctcaatgcattcgccagcacattgcaacttgagcacattcatctgcacgtcgaagacggtcccacctggatcgaagccgcgggcaaagccgtagacgacaccggcaaggccttgcagaatgccaggcagcagaccgcacacgccgtccaagacgtcggcaatgcgatagcgaatggcgctcagagcaccggtgccgccgttgccaagggaatgcaggacgccggaaaccaggccgcgcacatcgcgcaggatgcgggcgacgccattgcgaaaggtgctcaggacgcaggcgccgggatagccgacggagtgcagcagcttggcaaaggaatagcagacggattgaaacagctcccggagatcaaactgcccaagttcgggtggggcaagaaataggttggagaatcacggcgtgagctaggagtatgtccgacttaagagacatgtttccagttcaccttttaatgttctacatgcccttcagtcagtagcttcgttctttgttatccgtagtcgtcctcatcgacacatcatgagcgaaatccgaagcctcccgctcattctcgaacggctctacgacccggcgtgatgactgcaatcgcgcatttagtccttttcaatgcgataatctccaagaaaacgtccacaaccccaatgctcagtagtggtcgcgcacggacaggatgcacaggtcaccaccatcgaccatgtacaccaaacggttcgcggaatcgatgcgccggctccacgcgccctgcaattcccatttgagcggctcaggcttaccgaggcccgtgaacggggaacacatcgtatcacgtatcaacacgttgacgcgtctgagagtcttcttgctctgggtctgccaatacagatactcgtcccacgcatcctcggtccaacgcagcaccgctcactccccgaccagatcgtgcgtggcggtaccaccggaacgcacctgggccattccacggcggaccttgtcgaacaatccgggattctgatagacgcgcagcgtttccatgagcgactcgtaatcgtcggcactcatcaccaccacgttgtcgtgtgggtccttgttggtgaccagaagcatgtctgcatcatcattcacgcgacgcagatacgatttcagatccttacggaaattggtgtacgcaaccgccgtgaccatggcaatctcctcttcaatccgacaacatatgtacagaaaacggtacagcaaaagccgaggagactcaatcccaagattcgccacggtaggcgttcgccatcccttcacagccccacgtgtgccgcatgatcgcgaaccgtgccctcctcatccagactgacagacgggaaaccactcgaatcatcaagaaagtcacagatcagccgccactggcgccggcttatgccaatacgctcgtccggcctcaccatgagcaccggtgccgcaggctccagcgactcgatctgcgttttcgacgtggaataacactcctcgtcatcaatccagacaatcggcaacggctcctcctgccgtcgttcgaaccgaacgcgcgacataatctccgcaagcttgcccgtcaaccttctctcattggtgaccggatcataccagataacagtccgttcaaccccgggatcccagccaagcatggggtcaagcacccttgagcaatacggctgccatgtggtcagccagttcaattcggcactgccggaaagggccagttcatgcatcatgccggcaagctcgcgtgaccagtgcacgcggaaccgcccgcgccccgtacgcacctgctcgttaccggtcagcggaaacgcacgcgtggaatcgtacagttccttacgtgggtcgccttccttcagccattgcgtatggccgacccctccccgccgaagcaccttgtcatcggggaacgcgttcagcacaccgtcaaaatccgtgtagatcaccgcccgaaccattacgcctcctggtaagccctaatcctgcagcgtcctgtaattattcactactatctaccggacaaatcaagccggcctattttcgctagttgctttatttgtggcagccgaacgccgaaacccgaagtatgagcgttggaattccaacgctcatactcgccataatcgccaaacagtgccacaaacaagccaacaagcattttggggaaggcttttcgcgtaatgttgcgctctatcattgataaaggcatccagcaatcgcataccgtaaggaaccacatgcgctatttcacttcggacacgcatttcggccaccctctggtcaccgcactgcgcggattcctgaacaatggcgggctccgcgccgaataccgtgatgtctggcaggcgcaggggcgtgccgccgcgcacacgtggatcaaacaatatgtgcgcgacaatcagacgtcgttcaaagcaatctgcgacatcacacgccatgagaacaccatcatcggcaacatcaacgagaccgtcgggcgtgatgacgagctatggattctcggcgatctctcctaccgttgcaccgtcgagcacacgctcgactgtctacgccgcatcaactgccgccatctgcacctgatcatcggcaaccacgaccgcaacttccgtctccgctccaatgacgcgctatacgagaacgtgttcgagaccatcgacgactaccgtgagatcgacatggagcttcccgttctcgacggaaccggcaagccgacggccgcaaccacacggcagaccataggcatgagccactttcccagactctcggcattgaccgaagaacacggcaactggccggaaaactggaacaagttcgccgatgtggcaccgaccaccgaaggttggctgctctatggtcacacgcatcaaggcattcccgacggcaccgatccgctcagcgtgaacgtggggctcgacgcatgggatttcaagccagtcagcgagcagcagctcctcgcctggttcacattccggcacgccgaccaatcaaagtaaattcccccgagcatgcgtcatcgtccggaggcgaagcgggtgaggactcccgacttggccaaggctcggtagaggacccacgaaccgaacccggcgaatacgaccgcgctcagcaactcgcatgccgtgccgataaggccgcgcgggctgaagaacgagaacgcctggtagtagaagaacagcagatagaagttgtagacgatgccgaccgccagtgccgccaacagtgtgacgccaagcgtccaacggcggtagcggaacagtgcgaacaccgtttcggcggcgagcgcctgcacgagcgcgatcactaccagactcacactgtatttcgtgccgagcaccacttccacgaacgaggcgactaacagcacgtaggccgacgcgcccggtttgcgtacgatcagcaagcccagtgtggcggggaaatagaacaatgcgtgcagcagtgccgcggagcctggaagtatcagagtcagtaaaggaaacaagccataggacatgccatcgaacacccagaacatcacgccggacattacgccgacggccgctccgacggcgatgtcgacgacacgccatttcagggatctgcgtgtttcctccgttgtttgcggagcatgcttcagcatcgggatgcgtggtttttgggtaatcgtttcagaggatggctctgccatgatgaatccttgccttggttgacgccgcgcaccgtgagttggagatcgcggcggtcgccgtgggccgttcctcgacctgcgcggcccgggcaggagcgacgcgcgccattatacggacgccatgttcccatgtccgccagcgtttcgcatatgaaacgcatcagcagcatacacgtcacatttgcgaaagaatcgtctacatcgtccgcatcgcaacaatccgcaaccccattccgcttacgcttgaccatggatttcaagcggcgtataccaccacacgataagaggttggcatgaagacgatggcacggcaaataggaaccgttctgtgcatggcgctggctttgctgtcggcgttctacgcgttcgccgtgatgaagacacattcgggtaccggcttctggaaggtctggctggtcatcgccgccgttttcgccctcctcgcggttggaatcgccgccaattggtgggtggcgctcccccgcatcatacgaggggtcatcatcgccgtggtgtgcatcggcatcgccatattcggcacggtggaggggtgcatcatcagcaacatgcatgcgcggggcgaccagcatctcgattatgtggtggtgctcggcgcgcaggtgcgcaagtccggccccagcaaggccttgcggtatcgtctggacacggcggccgattatctgcggaacagtccggataccatctgcatcgtctccggcggcaagggcgcgaacgagccattccccgaggcacagggcatggccgattatctgaaggcacatggcattgaggaaggccgcatccttcaggaatccaagtcgaaaaccacccaggagaatatcgtcaacagcaagaagctcattgccggagacaacgcgtccgtcggcatcatcaccaatgacttccacatgttccgcgcattgcagatcgcgcatgacaatggacttgacgaagcccaaggcatcgcggccggttcaccgcccgatatgctggtgaacaacatggtccgcgaattcttcgccgaaatcaaattcctgctgtcctagttcctgcaagttccgagcttggatattagaaatcgcttcccccgctggaccaatgtccgaaggtcagctggcgtgcgccgcggcgtgcgtaccacgcggcagccattgccctttcggcaatgcggcgaatgtgggccactgttccgcggcatccgcggccgattcgagacgacgctggaagccgggccaattcggatcggcttccagcagccgtccgagcagcagcgctgtggcatgcgcgtcgctcaacgcgctgtgcgcatcctcattggcgatgccgaagtagtcgcagcagtcggaaagcttgccgcgaccaatcagtgaccgcgacagtttcatcgtgcacagcatagtgctctgatgaacaggtatggaggcgcccatgcgcgagtattcggcgagcaggaaccgcgagtcgaacgacacgttgtgggccacgaacacgcggccggcaagcaggtcacgcagttcatgtgcgatgccttcgaaatccggcgcgtgcagcagatcgcgcgcggtgatatggtgcacccaggaggcaccgacactgcgatccacatgaatcagcgtctcatgctcgtcttcgagcgtgccgtccggagccacgtgcaccaagccgatctcaatggcccgatcgcctttcgccggactcaatcccgtggtttcgaaatcaaccaccgcgaatccctgattcattgttcctccagtcacacactgtattccagtgtaaagcaaggcaaaggaatcatagaaaaaggctggaacccttaggattccagcctttatcgcatgtgctgcgtcaatacaacgcccacaggcggccaatcggtctcacttctcgtcggaagcgagctcgtcagccacggcggcggcagcggaagcagcctcgacgctctcggactcttcgtcttcagctgcggaaccgaggaaggcgctcaggtccagggtctcgccctcggacttgaaggtcacggcgcgcatgccggagagcaggcccttggagcggccgacttcctgcacagcggaaccgatctggccgttgcggatgatggcctggatgaaggcattcggatccatgccgtactgctgggcgatggaggcgaggaagttgaagacctcaccctgggagaccttgacgtccatggtctcggcgagcacgtcgagcaccatctggtcgcgcagttccttctccacggtttcttcggcttcggccttctgctccttggtggccttggacggatccgcggtcacgttcttgagctgctgctcgaccatttcggccttgacgcccttcggcaccggaatctcgaggccatcctcgagcttggcgatgaacgcgtcacgagcggcggtggcctgacggccttcggcgtcctgagcggcgaccttcttcaggtcttccttcagctcgtcgagggtgtcgaactcggatgcttcggaagcgaagtcgtcatcgagttccggcagttcctcggccttgacggaattgaccttgaccttgatcagggccttctcgccttcgtgcttgccggcctcgagagtgccttcgaagctggtttcctcaccggcggacaggccttcgagggcctcatccaggccgtcgagcatggtggcggagccgagctcgtagctcacgccctcctgggagtcgacggtttcgccgtcgatttcggcgttgaggtcgatgttggcgtagtcacccttggcggccggacggtcgacgctcacgagggtgccgaaacgctggcgcagggcttccagacggttgttgatgtcctcatcggtgacctcggccttggcgacctcgatctccatgccgtcaagagccggcagttcgatgtccgggcgacgctcgacggtggcgacgaacttcagcttggtctcatccttggcggattccggcacgtcctgaacgtcgatctccggctgggccatcgggtggatcttcttggtttcgagagccttggaatacagctccggcacgccgttgttcacagcttcgccggcgacggcaccgaagccgatacgctggtcgatgatcttgccgggcacgtggcccttacggaagccaggcacgttgacctgctttgcgatttccttgcgagcctcgtcgagatacgggttgaactcctccgggtcgacggtgacggtgagcttcaccttggtcggctcaagattcctgacgctgattttcacgcttgcgctcctgaaaaatacggttcttcatatttctgccgttaggcaacctctacataatagcgcgacttacggactctgcaactagggagacctgccaatcgcgtgcgccctgttcgccgaggaatcgcgcgacgtcacgcttacgaggttcgtccgtccagcacaggttacgcaaatactgcggtttgatgacgatttccacaggcgtgcgcgtgtcctccgctatctgggagaccgccttgcgcaccctgttgagcacttgcagacgttccggataccgttccttccacacgcgaatcgatttgggagccgaagcggactgcgattcatgacgccgcgcggcgccgccgtccacgtccggccattcgcttggcggcagggcgagcgcgtcctggatgatgttcttccacatgctcggtttgattttgcgttgaatcggcgcgtaccgttcgaacatcttgtcctgttcggaatcggtatggatgcgcacgcgttcgttgatggagcgaatcgaacggaattgcgcagcgttgcgtggtttgcgtttcgccacttcgatgatggagctgtcggacagtagcagggtcggcgcgatgtcgtattcgcgcgcgagttcgtcgcggcgggtccatagcgcgcggacgatggccagcgcctgccggtcacgcatgacttcagtgatgtgtgagacatgcatccagggaatcggatgctccttgcgtggtcccagaccttctttgagcgcgtaatcgaactcttcctgggcccattccatcttgccttggcgtttgagttcggcgcgcatcttcgtttcaagctcgatgagcagttcgacgtccaacgccgcgtaatttcgccagtcgcggggcaacggacgatacgaccagtcagccgcggaatgttctttggcaagggtcagtccaagaaagtgctcggtgacggcggcaagtccgaatcgtttcaatcccagcagacgcgcggcgatttccgtgtcgaacagccgttgcggttccatgccgagttcggcgaatcccggaagatcctgcagggaatcatgcagaatccataccgcatctccgacggcacggttgaaatcgttccaatccgccccggccgcggcgagcgcctgcggatcgagcaggccgatgccggctccgtcgcgtttgaactgcaccaaccagtcctcatgcccataccggaagccggatgcgcgttccgcgtccgcggcaagggagccatgtgaggaagccagctcactgcaatagtcacggaatgccggcaacgtgtcgatcacgttgggcacgccttcgcgcggttccgccagcagcttcggctcgtcagtcaacggggttttcctcctcggattgcgtcatggaccggaggaacgacgcccactgtccgacttgggagccggcgtcaaggcctccatcggcatagtctagtggagtccaagacacccggatctcgcagcccaccctgggcacatcggggtcatggccgaatgctgtgttttgggtgactgtgacggtgccggatacatgttcggaatcgtttggattgagacgttccatcatcatgtcccagtacatgcccggagtcaggcagtcgtcctccttgtcgggcagtggcagggatgcgaaagccacgcaacgccagtgggagtgccagtcctctcggaatttgagcgagtacaggatcatgatccagccggatgcgtatgtttcatcgcattccaacgcgacgccgatgccgaagttcgccatggaattgggcaccggaatctcacggtatgtcatgcctttcaaacgccgcatacggtccacggaaagcaccgcgttccagacttggtcgggaacgccctgcggtcgcataagcatggtctgtggggcttcgccgcccatatccgctcccttgccatcggcgcgcgccacgttgcgcgcatctcgtggaaaatcaaagatgtctgccatagttcaaggctacgacagagaagggcatttcgtagtatttcgaaccactttgccacgcgtcgaatgtgaagatttttcagcgtatgaataaattggtccatgccatcgattcagtcggcggcatggaccaatatgaggcgttccgcatatccagcgaatatggggaagccattgagaggacgggcgtttagtacacggtgaagccgtgcgactggaactgctcgaccacacgttgtttcattgccgcggacgggcctttctgatcctccaacgggtatgggatgttcagcatgtgccacttcggacggccaagctggtggaagggcaatacgtcgatatgttccaacgcgtcgccgaaggtctcgcagatcttcgccacgttctcgacgttttcttcggaggatgtgaggcccggcacgagcacgaaacgcacccagatcttcttgcctgccttggccagacgctgtccgaagtcgatggtcggctgcaggatgccgccggtcaccttatggtaggtctcctcatcgccggatttgacgtcaagcaggcacaggtcgatgtcatccaccatgtcatcggtgtagctcgcaccgaggaatccggacgtgtcaaggcaggtatgcactcccatctgcttggcggcatggaacacgcgggacacgaaagccggctgcatcatggattcgccgccggagaaagtgatgccgccgccggtggccttgaataaatcggcataccgctcgattttcttgaccatggcttcgtagtagacgggcttgccgtcacgcatcttccaagtatccggattctggcagtactggcagcgcagagggcatccgctcatgaacacggtcattctggtgccaggaccatccacggaagtgttgatgtcccacgagtgcacgaaaccgatatcgccgcttttcaacgccttgatgcggtcgagacggtccaagccgattggcgattcgaatccggacaggcctcccatcagcgtctggttgacgtagtccttggaatccctcagcatgtgtctggtcgtggaacggaaaatatgttcagacatcaatgtcccctttcatctgccatcccaatcatatgggaaaacgatatgggaaaagcgaaagggacgaagccacgagctccgtcccttcgcattaccgtcgtttcatgcgacggctttcatttggctgattgtgccgttcagtcgacgacagcgccctggtggaacgtacgggagatcacgtcgagctgctgttccttggtgagcttgacgaagttcaccgcgtagccggagacgcgcacggtcaggtgcgggtacttctccggatgctcgacggcatcctcgagctgctccttgcgcagcacgttgatgttggcgtggtacaggccgtggccattgccggcgtccaggatgccaacgaggttgccgatacgctcttcctcgtcgcggcccagaccatcaggggtgatggtgttggtcagcgagatgccgtcaagagcgtcgttgtagtcgatcttgccgacggagaacatggacggcagcatgccgtgggagtccatgccgttctccgggttggcgcccggagcgtacggggtgcccttcttgtggccggacgggaaggcgccggtggccttgccgtattccacgttggaggtgatggtcaggatggactgggtcgggacggcgtcgcggtacaccggcagacgcttgacctggcccatgacggtggagacgacccacttggcgatgtcgtcggcacggtcatcatcgttgccgtacagcgggaagtcgccttcggtgcggtagccgacgatcagatcgtcatcggcaccttcgacgtactcgttctcgtggcccggcgtggtcttggcgtccttgttgtagatcgggtagaccttggcgtacttgcatgcggacagggagtcggccgcgatcgacaggccggacatgccgcagccgagggtgcggtacacttccttgtcgtgcagagccatctcgatggactcgtaagcgtacttatcgtgcatgtaatggatgatgttcagagccatcacataggtctcggacagccattcgagggccttctcgtagttggccttgaccttctcgtaatccagcgtgccatcggcttccggcttgatcgggtcgatgacgcccttgtcgatgacctgcatgccggtcatctcgtcgcgtccgccgttgatggcgtacagcagggccttggcggagttcacacgggcggcgaagaactgcatctgcttgcccacgcgcatcggggagacgcagcatgcgatggcggcgtcgtcgccccagtgggagcggatttccttatcggactcgtactggatggccgaggtgtcgatggagattcgggcgcagaagcgcttgtaggcttccggcagcttcggatcccagaagatggtgatgttcggctccgggccaggtccgaggtgctcgagggtcagggtgttgagcagacggaacgaggtcttggtgaccatggtacggccgtcgtcgccgaagccagcgtcggaccaagtcgcccagtacggatcgccggagaagatcgcgtcgtaatccttggtacgcaggaagcgcacgatgcgcagcttcatgaccaggttgtcgatgatctcctgtgcgtcggtctcggtgatcttgccggccttcaggtcgcgctcgaagtagacgtcgaagaaggtggagacacggccgaaggacatggcggcgccgtcctggctcttgacggaggcgaggtagcccatgtaggtccactgcacggcttcctgtgcggtctgtgccgggcgggacaggtcgaggccgtactcgttgccgaggttgatcagctgcttcagggccttgatctgctcgtcatgctcttcgcggaagcggatccagtgctcgatctccggctcggtgaagtcgttgcggtacgggatggagtccttgtcgcgctgcttgaacttgatcagcgtgttcacgccgtacagggccacacgacggtaatcgccgatgatgcggccgcggccgtaggcatccggcagaccggtgaggatcttgttgtggcgagctaccttgatctgcttggtgtagacgccgaagacgccgtcgttgtgggtcttgcggtacttggtgaagatcttcttgatctccggatcgggctccttgccggcttccttgatggcctgctcgaccatacgccagccgccgttcggcatcatggcgcgcttgcacggcacatcggtctgcagaccgacaatcacattgtcgacttccggggaatcgatgtagccggccgggaaggcgtcgatgcccgccggggtgtgggtgtccacgtcgtagacgcgctgcttgcgctccacggacagatagttgtcgtccagatacttccacaggtgcttggtcttgtcggtggcgtcagccaagaaggactcgtcgccctcatatggcgtgtagttcttctggatgaagtcgcggacatcaatgtccttctgccagttgccctcggtgaagccttcccaagccttagcctcaagttcctcctgggagaccgccgttgcatcaactgctgccatttccactccttactgggtgtcggttggcgacgcatcgttacgccgtcgctacttcacgattgtaacggcaatcatctgcgaaaagcctgaaaaccactcccgaaattagtgacataaatcacaatcggtcgtggttttcatatggaattcacttttcggaagatgccgagccgtccgctgaccagcgtttccattcgcggtcctgttcctcccatttgagattgcgttcctgcacgatcttccacgcgtcgagcgcgtcctcacgggttctgtacggccccatgcggtggcttgccggagagatcatgcccaattccggctgctcggtgacggtgttgaaataccactgcttttccatatcggcttccttcggctctcgatgttctacttgcgatcgccgattattcgcggaatgcattggtgaccggcagacggcgatcacgcccaaacgccagcgccgtcaccttcggtcccagcggatactggcgacgcttccattcggcgcggtcgaccaatcgcatgaccgtgtcgacggtcgcctcgtcgaagccgtcggccagcaggtcggcgcggccatgagcatgctcgatgtacatcgccaatacttggtcgagcagcgcgtattccggcagcgaatcggaatccttctgccctgggcgcaattcggcggacggcgccttctcgatcgagttgacggggatcatcacaccatccggcagcggagtgcccgcgctcccctgctcgttgccgacgacatgcagaccgccgatgcccatgccggcggcggcagccttgttgcgccagcgggagatctcccacacgcgggtcttgagcaggtccttgattggcgcatagccgccgaccgcatcgccgtagatcgtggaatagccgcatgccagttcggacttgttgccggtggccacggccagcagtcctttggagttcgagtaggccatgacgatgacgccgcggatgcgcgcctgcaggttctcggcggcgacgccttccagttccagctggttttggaaggagacgaacagcggctcgatgggctggatgtcataatgcgcgccgatattgcgcgccagatcagctgcatcgtccttggatccgtcggacgaatacatgctcggcatggagatgccgtacacgttctcgccgcccaccgcgtcggccgccatggcagccacgagcgcggaatcgatgccgccggacaggcccaggcacacgcccttgaaatggttcttggccatgtaatccttcagacccagcacgcaggcggtgtacacttcctcgtccggatcgggtttggctgcgatcgtaccgaccttctgatgctccgcggacgtgtccaagtcgaagaagctcagatcctccatgaacatcggcgagcactcaagcagggtgccgtcggtgtccacaacgaagctgccgccgtcgaagacgaggtcgtcctggccgcccacttggttcaggtagatcatcggggcgttcacttcggccgcgcggcgcaccgcgaggtcgagacgggtgtcggttttgccttcctcgtatggcgaaccgttcatggtcagcagcaggtcgatgttctccttggcgagttcggccacagggccgccgtcctgccagatgtcctcgcagatggccacgccgatgcgcgcgccgttcacgtcgagcaccatggatttgttgccggggctgaagatgcggaattcgtcgaacacgccgtaattgggcaggaaatgcttgtcgtagccggcccagaccacgccgtcgtgcaggacgacgagtcggttgcgcggtttggaggtttcacggtcggtgcctacagtgccgaccaccacatatagttcgccgagactgtcggatgccagttcggtggcgagccagttggctttgttccatgcggctttgcggaaggtggcacgcagggcgaggtcttcgatggggtatccggtcaatgtcatttccgggaacacgacgacctgcgcgccctgctgagcggcgagatgcgcgtaccgcatgaccttgtcggcgttggaatcaaggtctccgacgcaggtgtcgatttgggcgagtgcgaagcgaatgtctgtcatagctgcctaacttaccgttgatttgttggatatgttgtgttttttacgattatgaaaattacgattacggcgttccgcacgtggcgtcacgacagttcgttgagcaccgtcagcgccgcgttggcgtagaattccacgccggcttgcagcgattcgtcaagaccgacgaaatgcgggctgtgccaatccgggcagccttcctcgccgttggaaccgatgaaggcgaacaccggcatggtgacgggcatgaaatcgcagaagtcctcccccgccatcgacgggtggatgggttcgagctgggcgtaatcgcgcacgttgtcggcgactatcttggaaagttccgtatcggagacgagcggattctggaaatcgtcccaatcgatgtcggcggtgatgccgtaaccggccgcaatggactggacctgttgcttgaagcgtttccccaccagttcaccgtcggacttgtggaagtatcgtacggtgccttggaagctcgccttgtcgggtacgacgttccacacgtggccgccgtgcatctcggtgatggacagcacgagcggatggaacggcgatacgttacggctcacgatggtctgcaatgcgaggaccatcgtggcgagcgcctcgatcgggccggtgcccttgtgcggatagccggcgtgtgtgccggtggcgtgcagggttacatggaatttcacgcagccggccatcatcggttcggggccgacggcgatctgtccgggcgagtagttcgggttgttgtgcgcgccgatggcggctgatacgtcggcgagcagtcccgcgtcgaccatggccttcgcgccgaggccaagttcctcggcgggctggaacagcagtttgatggaccccctgatgcgcttgcggcgcttggcgagccagaacgcggcaccgagcatgtacgacatgtgcaggtcgtggccgcagccgtgcatcacgccgtcgttgacggatgagaacggcagaccggtgtcttcctggatgggcagaccatcgatgtcggcgcgcaatgcgatgcgtggtcccggctggtcgccgcggatcagtccgaccacgccggtttcgagcggattgttgagcacttcgatgtcgtgtgcgcgcagcagcttctcaatgtaggcgctggtctcgtattccttgaagctgcgttcggggtgcgcatgcagatagtgcctgatttcgatgatctccggcgtgatttcgatatgttcgctcatggttgacgattgtaggcacatccggccgtttttcctattttcgtggtcgtgttccgtgccgtgcacgacgttttcgcacatatcctcgtaagctggataccgggtttgacatggtttttcatggaggcagcatgactcaggacatcaagacggcgtttttcgacatcgacggcacgttgacgagtttcgtcacgcatgtggtgccgcagtccaccatcgacgcgttgcatgcattgcagcgcaatggcgtgaaggtgttcatctgttcgggccgcgcaccctcctacatgggcgtggtgcttgataccattcccgtcacgttcgacggcatcgtgggacttaacggccagtattgcaccacgcgcgacggtctcgactaccggcatccgatcgaccaggccgacgtgaagctgatcaccgactggcttgaaacgcatgccgacgtggtcgccaactatgcggaaagcgactacgggtatttcaatcgcacgaacgccgcattggaacgcacgtggaacagtctcggcaagaccgcgccgaaaatcgacgtgcatgatccgcgcgaacgcatcgcaaaccattccacgttccaaatcagcccgtatgtggacgagacgatggaagccgaaatcgccagcatgtgcggcaacgtgcgcggcgtcagatggcatcccgctttcaccgatctgattcccgccgatggaggcaaggcggttggtatgcaggtgatgctggagcatttcggctggacgaaagacaacgcgattgcattcggcgacggcggcaacgatgtggacatgctacgattcgcgggaatcggcgtggcaatgggcaacgccaccgacgagccgaaagcggcggccgattacgtcaccgacagcgtcgacgacgccggcatagccaacgcgcttaagcatttcggcgttatatgatggtgtttccgcaagattatttacgattcacaagtctgtttttcgcatattcctgcggttttcgcgccctttataaataattccgataagcgcgcgacgtgttgccgtcacaggttcctctatattggtcaatcgttggcccgcaaccgcagtaagcgtccgggccgtgtagcgaaattgagagagaggaactcaaccatgcgtaacaagaagattctcggcgcactgctcgccgtcaccacgctcgcgaccttcggcctggcaggctgcggcaattccggttccaacgatgccgcctccaaggaggacgacaagaccatcaccgtggccgcctccccgaccccgcacgcggagatcctgaacaaggcggccaaaccgctcgtcgagaaggacggctacaagctggtcgtcaaggaattcaccgactacgtgcagccgaacaccgccaccgaggatggcgaggttgacgccaactacttccagcacaagccgtacctcgacaacttcaacaaggagaagggcacgcatctggtgtccgtggagggcatccacttcgagccgttcggcctgtacccgggcaagaccaaggagctgaaggatcttcaggacggcgccaccgtggccgtgccgaatgatgccaccaacgaggcccgcgcgcttctgctgctgcaggatgccggcctgatcaagctgaaggatccgaaggacatcaacgccacgccgaaggacatcacctccaatccgaagaacctgaagttcaaggagcttgaggccgccgtcgtgccgaccgtcatcaaggatgtcgacatcgcggccctgaacggcaactacgccatccaggccggcttcgacccgaccaaggacacgctagccaccgagaaggccgacggtctggccgcgaagacctaccagaacatcctcgtggtgaaggaaggcaatgagaacaccgccaagaccaaggagctcaagaaggctttgaagtccgacgaggtgcgtgactacatcaacaagaactacaagggcgctgtcgttccggtcttctaagacccgcttcggcagtaggagttcaatgccgcaggtatactaccctgcggcattcttgttatggaacacgattaggaacaggacattatgacgattcagatcgaccatctgcacaaaagctacggcagtggcgccgaagcgcatgaggtgctgcacgacattaacctgaccatcgattcgggtgaggtcttcggcattctcggctcgtccggcgcgggcaaatcgacattggtgcgttgcatcaacctgctggaacgccccacttccggcaaggtgctcatcgacggacgagacatcaccggcgtgaaaggcaaggagctggcggacgtgcgcgccggaatcggcatgatcttccagaacttcagcctgtttcaacagcgcaccgtgctgcgcaacgtgaccttcccgctggaactcaaccacacgccgaaagccaatcgtgaggaacgtgcgcggtatctgctcgatctggtcggtctggctgaccttgccgaccgctaccccagccagctgtccggcggccagcagcagcgcgtggccatcgcaagggcgttggccaacaatccgtccatcatgctgtgcgatgaggccaccagcgcgctcgactccaccacgacggcgcagatcctcgacctgctgcgtcgcatcaaccgtgaacttaatgtgacgctggtcgtcatcacgcattcgctgtccgtggcacgcaacatctgcgaccgtgtggccatgatagacggaggccgcattgtggaaatgggcgatacggaagcgctgttcgccgatccgcacagtgacattctgaagactttgatcgccgacgcgaaggtgacgaaccatcggcatacgcacgaaacggcggatggcgcgaagaatggggcggccgatgattccgcccagaaagaggtgaagtgagatgggacaggtggtttcgcaattcatcgccgattatggcgaactgctggccgaaggcgtgcgtgacacgatcatcatgactgctgtggcgacgctgctggcatatgtgatcggcctgccgatcggcgtgctgctcatcacttccgcgaagaagggcatccgcccgaacgcgccactcaacaccgtgctcggctggatcgtgaacatcgtgcgttccgtgccgttcatcattctgctggtggccatcatcccgctgacccgactgattgtcggcacctcgctcggcgtgccgggcgccatcgtgccgctggtcatcaccgcggctccgttcgtggcgcgcgtggtggaacagtcgctcgccgaagtggacggcagtctggtggaggccgcgcaaagcttcggtgccagcaacctgcagatcgtgttcaaggtgctgctgttcgaaagcctgccatcgctggtgcgcggtgcggcactgacgttcatcaccctgttcggcttctccgccatggccggtaccgtcggcgcgggcggcctgggcgatatcgccatccgttacggctaccagcgttaccagtacgacgtgatgaccgttgccgtgatcctgtgcgtcattctcgtgcagatcgtgcagaccatcggcgacgtggtgtccgaccatatcgaccatcacgagcgttgagccagcacattcgcgttccttatgaaaagcgggtccaaacgtttgttgtttggacccgcttttcgtacacggaaagagacgctgctcgtagacgattacttgttgagctcggccttgaccagaccggccagcttgccgccatcgatggttttgccggcaagcgcggcacgagcggctttgacgacgcgacccatgtccttggggccggccgggttcacttctgccacggcgtcggcgacggctttggcgtagtcctcgtcgctggcggccgccggcaggaaggtttccaggaaatcggcctcggcggtttcgggagcggccttgtccgccagtcccttgtcttcgtacagtttggcggtctcacgacgggtcttgacgcccttctggatgaccttgagcacttcctcgtcggtcgctccgtgaccgttggcgatctccaggttctggatgtccgccaacgtcaggttgatcgggttgagcttggccttgtccttggccttcatcgcggcgatcttagctttcttcagcgcgtccttcatcgacatgttcgttcctcttttcttgaccgttcgaacaccgtcttaatactacgcgtctaccaatccgccgtcctgtatccgtgccgtcggcatccacgccggtctcaagcccatgagacacttggagccatgactacagttatcatgcgcacctcgcatgatacacgtggccggctgtttttggctttgttccaaggttttcgatttttgggaaacatgccgattacgctcgttctccacgaggcacctacaggaacccaagaataatctcattcttctgtgcatatcagcggcttaccgacgcacacgaaagaagcatacgagtgttcccgcgacctatctcagatggcgaagccgctcgatcagatcgacgagcgtctgttcctcctgttccacgcagtctaggaaaatggagcagaacgaatccggcttgccgtccacctgccatgcctccaggccgcgcgcgtatgcccgacccgcatcgtatttgatggctgcgggacggtatccgttccgtagcagcacgaagttgagcagctggcggccggtccgcccattgccatccatgaacggatggatgttctcgaacatcgcgtggaaaccggcggccctgagcagcggatgcgctgcgcagccatccaacccgtcgatcaaggatcgcaggtcgtcgcggatctccagcgggtccgcggtcttgacacgggtcgcggtggtcctcgccagataaccgtacgggcggaacgtgccgcgggcgaacggttggagatccagcgcggtcacctcatggacacgccgaaccagttcctcgtccagcttccgcccctcctcagcatattcgcgcacgtaggccatgccgtcagcgacccctcgcgctgcgaacacgtatctggccggcgagtccgatgggacgaactcgccctccaataccagcgacgtgtcctccagggtcagtgtggatccctcgatggcgttcgagttgtaggtgtagcgcaccagccagtcgcggtcgtaatccgacaatgccatctcctcgacgccatccagaggctccaacgcgcgggcccggcccttcaacgcgtcaatcctccgcagacattcggcggttcccggctcgcgctcaaggccgagcagttcctcgggcaatgcccgtatgcgctgcgacagctcaggattaggcatcatgctcctcttttcgtgttccggttgcaaagtccattattccagtagtgattcgttgcgctagcggtccagatgacggctcaacgcatccggtccggttccgacgcttctggcatccccgtcccgttgtccaaggttcttccgcaacgtctcgccaaacctgtccatcaaatccgttttattgcggatcgggccagaaacacgaaggacctcaccttccctgatcctgcggagcatcccgatacgctttaccaactgtacccggatggcatcgaggcgttcgggcgcgaacatgcgcatgcgcgacaactcatgcgccacctcgtcgggccagtccgacagagcatccagattgaaccggccccaatcctccaccagtttgagctgccgcaaggccgaggggcgtccggtcgccgaatagaacggcttggcgaaccagtctcggccgtccacatcgagctcgccgctccacaggctcgcgccggtgtcgtagatcggagccgggcggaccgcaagggtctcgatgttccggatcagaccgaagttgttgtaatgcctatctgtattgcgcatgaggtagtcgaccacgagccaatcgtccgtggcgtcacgaaccgcccgttcgtctgcgccgaagccgacggcggcgcggatccactggtcatgcgagttgaggccgttgacggccttgacggattggagcacctgccaggcggagaccagctcctcatgattggagagcatgtccgcgcatgtggacaccagacggttgccgttgcgcgccagggaataccggacggccggaacgcccaatcgcatgcagagcctcgaggcgatgacctcgttcatgggctcctggccagtacggcccgacttgacgagcagtctcctgccggtggccctgtcgattgtccagcgtttgggaagatcgccgccagtggacacgtcgggggcgttgaggctgatgtcatgggacgacgagtacgaggtgagcaggatctcgcccagcgcctcgtcgaagggattgtcgaagaagttgacgtccttccattcggccgggtcatcctcgcgtctgacccagtactggtccgacaggctcaaaccgtaggtccggtcgagcagctccccggtcgatgccgcgccaagcgattcgagcacgcggcggatgccgtcgcgggtggaggggatggcgcgggacctccaccattcgtcgatcctcttggcatacagcgcgctcttgccgtgcgtggtgaactccaggggcagacgatcatggtcaaggacctcgccagaggagcacgcgcgaccggactcgggatcgtattcgaacgcaagaaccggatggtccccgcacataatcagcttgcgtggcatgattccgctcccttcaaacttggtctttaaagattctacaggcacgaattacgcgcgagacggcgtaccgtttcatgacgcgatgcatggatatgggccacttccgcaaatcgcaagcctcggcgatgacgccgacaactgatacggtaggcatattggtttcccaaaggtaaagaggcatgaccatgggattgttcgacttcgctaagaactcttcgggtgacgtgccgtccggcttcggcggtcggggcgatatcgccaaccatcttttcaacgaccgatgaaaaggctccggttgaaggctatggcatgatgacacgagcgtggggacatttatgaccgaaggatactcgcataaagcggcacacatcatcgagcacatcgttcttgcgatcgcgctggtctgggccggcggctgcaccctcatatggacgcaaatagacatgccccacagcatcgtgaatgcgaaatccgctgacggcacctgcgaagtgaccatcagcgaactcggctcgcccatattcttcggcccaagcagcatcacggtcaaagtctcttgggacaccgatcccagtgttatcggttccgagaacgtcacggaaatcaaaacggatctgcacaacgacggcaaatcattaggctcgggcaacttcaccgtcacctggcacggcaacatcccgaccgtcaccacccatggcgaggaacagccggaccaaagctacacattcaactggaaataaccgctccgaacatcatgtctctcccgagagtagtcctcacaaccgggcaggtcccacaaggagcatagctcatgcacccaccggccggtctcaagcccatgagacacttaagaccatgactaccatcatcatgcgcacctcgcatgataactgtgatcgactgttttcggctttattccaaggttttctgtccttgggaaacctgtcggtcacgctcattttccacgaggcacctacaggcacccgaaaataatccgggaacactccaccgttctgtcggcgctcagcgtcttcgtcgaccggcatggaaaagaacaatacaccctgtggtttcatgatgttcagcatgggtgacgcccaaaagcattcgtccagcagcacgcctccgcgtcggacaacgggcagaacgatacgcgtcccgcgcaaccgtcccggccgtcacaatggcatcccgattcattcctgcgctatccccacatacctcgccgccgcgccgatcgcgttcaccctcgacgaatatgaggccctgaattccgtcagcaaccggacggccttcaccttgaactcgcccgcgcatcaagtgccctttgccataatcccatcatctcccatcgagctaggggaatgcggaacaaaaaatcagttcatatcactttttctgttccttgaactgagcctggtctctccagcaagtcctactacaataggactcattcctccgcagttcgagaatcgagtcaatatgcgccgaatttgccacattcttgtaggtctcctagtgtgtgccggactcctacgcacagtaagcggctttatttttgactacctacatccagaatacgtgtccagctttccttcatacctttattttttacgagcagttcccttccttatcactgctggtgccgtcgaaactattttattcgtgataaaaaggagaaataaatgaagaaactcaagcaaattgccgctactctagtatctgtaatattggctggaactgtgacagtaaatgcgtcggcagcagaatctatggagactccctataggagtcctaccctatctagctttccgtctaatgcttctctggaagatcttgagaaaacctcagataacgaagatctgagaattatctcatctccttctcggggcgctaattacaaaacgcgcgctgcagaggctgtagctttactgcggatttattccactacaggatctggctcatcatctagtttcacgaatctcggtcattcttggcttatgatcacaaacctgtctggttctacggtaaacattgctgggattaacgttgctgatggtaaatctataacagcaagcacttgggatgaatctgtagatgtcagtagagaacataagggtctgtggctcaatcttgattcgaagcttaattccaatggtattaatcttcagaatgtttccattcaattacccttaaggcaaattgatttaaatacagtaaatactaatattaaaaataacgataaatggggttatcttaccaactgttctactttcgcttcaaaaatttggaattcaattgccagtagcagcagtaaagttgacgctggggccatcaatacaccagccagtctagcaaaaaatattacaaaagttggtgaggcagaatcatacacgttgttaaaatacaatacttcttcaccgcattacgattccgtatattatggttatccgcccataaagagtaataacaataattagataaccaaatctgcctggtaaatccagactagttttatctagaatgagccgcaagtttggcatagcgcttgcggctcatacgcacgatagcaagagccgcagcattcccacccggtctcaagcccatgagacacttaggaccatgactaccattatcatgcgcacctccgaaggtgacatcaaaatcaacctgttcgacgacgaaaccccggaaaccgtggccaatttcctcggccttgccaccggcgagaaggaatggatcgatccgatgaccggccagccttcccatgagccgttctacaacggtctaaccttccaccgcatcatcaaggatttcatgattcagggtggctgcccgctgggcaacggcaccggcggcccgggctacgacttcgacgatgaaattgttcctgatctgaagttcgaccacccgtacctgctggccatggcgaacgccggcctgcgtcgtggcatggacggcaagatccacggcaccaacggttcccagttcttcatcaccaccgtgccgaccccgtggctcgacggccaccacaccatcttcggcgaggttgcggatgacgattccaaggcagtggtcgacaagctcgaagccgtgaacaccgatcgcatggaccgtccgaccgagccggtcggcatcgtgtccgtggaagtgctcaagtaagcgtttcccgcacagccgtacaatatagggaagcccctcgattgaggggctttcttcattttatttatagaggcgtttgcttgcaatcaccggcttatgtgattcgtcaacatcacattttgcgcagtcgcggctccgcggaatccttcgcgccggtgatgcggtacacgtcgaacacgccttcgattttacgcacggcggcgagcagagtgttcagatgctgcggatcggccatttcgaagctgaattggctggtggccacgcggtcggtgccggtggaaatcgagccggagataatgttcacgccgtggtcggacagcacgcgtgtcacatcgctcagcagatgcggacggtcaagcgcctcgacctggatcttgaccatgaacacgcccttggtgctggtccactgcacatccaccacacgttcgggctggcgtttctccagttcgagcatgttctggcagtccacgcgatgcacggacacgccttggttgcgggtgatgaagccgatgatcttgtctccaggaaccggcatgcagcatcgggccagcttgacccagatgtcccccacgcccttgacggagatacccaacgagctggtggtcttcttggtacgctccacctgcttgagcggcaacgcctcctgctcgacttcctcatccacctcgtcgctgcccgcgtcacggaccagatgcgagatgacgttctgcgtggagatctggccatcaccaatcgccacgaacacggcttccgcgttggcaaggttcaactcgtcggcgacgcccaccaatgcttccggagtcagcagcgtggtgattggcaggttgcgcttgcgcatggcgcgcgtcagctcgtcacggccttcctcgacggcttcggtacggcgttccttgctgaaccattgacgaatcttgttgcgtgccttcgggctcttggcgaagctcagccaatcacgcgacggacctgcggattcggacttggatgtcaatatttcaacggtatcgccattctcgagcttggtatcaagcggcaccaatcgtccgttcacgcgcgcacccatggtacggtgaccgacttcggtgtgcaccgcataagcgaaatcaatcggagtggcttcggcgggaagcgagacgatcttgcctttcggcgtgaacacgtagacctctgccgcgcccaaatcctctttgagggagccaaggaattcgtcggaatccggcgtttcgctcgtccagtcggcaagttgctgaatccatttgaggttgtcggcctcgctcagctcctggttttcgccacgcttgcggtcggacttgtcaggcgagctcaacgcgcgtccggcttggccgttctccttgtacttccaatgcgcagcgatgccgaattccgcgcggcggtgcatgtcccacgtgcggatctgaatctccaccggcttgccgccgggaccgaccaccgtggtgtgcaggctctggtacatgttgagcttcggcatggcgatatagtctttgaaacggccgggaacagggttccaccgcgcatgcacggcacccaacgccgcatagcagtcctgaatcgtgtcgacgatgatacgcacgcccaccaaatcataaatgttggcgaaatcgtgcccgcgcacgatcatcttctggtaaatggagaagtagtccttcggacggcccgtcacataggctttgatgtgctgttcgtcgagatcctcattgatttcggcgagaatctgcttcaggtacacgtcgcgttgtccggcgcgacgggccaccaataccacaatctcgttgtagatcttcggatacagaaccttgaagctgagttcttccaactcggttttgatggcgttcatgccaagacggttggcgagcggcgcatacacatccagcgtttcacgtgcctttttctgcgcattcgactgcttgacgtaacgccatgtacgggcgttgtgcacacggtcggcgagcttgaccaccagcacgcgcacgtcgcggctcatcgccaccaccattttgcggatggtctcggcctgggcggaatcgccgtattccattttggaaagcttcgtgacgccgtccaccaggccggtcaccgtgtcgccgaattcggcgcggcattcgtcgagcgtgtagtcggtgtcctccactgtgtcgtgcagaaggcccgctgccacaaccagcggccccatgccaagatcggcgaggatctgcgccactgcaagcggatggatgatgtacggctcgccggatttacgccgttgcgacgaatgctggttgacggcgcgccggtaggctctcgcgagaatgctcatgtcctcgtcgggatggtggtattcgcacatcttgaggattggttcaagcgggtcaagcggattcgtgctgatctcgcagcccaacattctggccgaacgaacctcatgatccatgtcgctcatttcgctcctcctcgcttggaatgtaccctatagtacccgcgcatcaccatatgacggatgtatccggccgcgtgttgcacggccggatacatcctcggtctttgtgtattgcagtcccgtcaggacgcaacgccggttgatccgaagccacgttccgcgcggtcggatccgggcagggtctgcgcctcgatgaattttgcctcgacgtagcgttggatgaccagctgtgcgatgcggtcgcccggatggaacgtcacggcgcgttccggatcgaggttgatcaacggcaccttgatttcgccacggtacccagcgtcgatggttcccggcgcgttaagcaccgtgacgccctgcttgacggcgagtcccgaacgcggatgcaccagcgccacatagccggcaggcaatgcgattgccactcccgtgggcaccagcgcccgctggaacggcttcaacgtcacttcttcggtggtgcgcagatcggcaccggcatctccggcatgggcgtaatgcagctgagccggctgcccgggatccagcgactttaccagaacctcgacgttttccggctcgttgtatgcctcgtcgaacgccatcaggccgcacactccttgcataccggctgtccgtcgtcggtagtgtaggcaagctggctgcgatgcttcaccaggaagcattcggagcagatgaactcgtcgccctgcatcggaatgacggtcaccgaagcgtcctcattgctcaaatcggcgcccggcagctcgtagtcttcggcaatggcgttctcgtcatcgtccatatcgttggaattgttctgagaacccttgctcaaagcctggagcgactcctcgtcctcgtctttgttgcgcggggaatcataatcctgtgccatcgagattcctttcgtcatctatggtgcttatgcgccatagaatacatgacttttcccccgctaggatacacgaattgaaatactcgtaaaatccgacacgtggggcacaatagaattaatagaaaaatctaagggaaagtggtgtgttgtgcctgagaatgcgctcgaagatgcacggttcgatcatgtgagtgaaaccggtgagctcgtctttgtttcaggtgccggcaaattcgccgtcaaggtcgatgaagcgcttgaaagagccattttggaggcaaaacagattcgcaccgaaacccaagaggagcgtcagcagcaagcgccttccacgctgccgatctcccaaatccaatccttgattcgagccggagccaatccgacccgcgtggcggagcgatattcgttgagcgaagcgcttgttcggcgtttctcggcggcggtggaaaccgaaaagcaatatgcgatcgaacagttcctggcggttcccgcgccgaaggaaagccgtgtgcgcacgctttccgaactgatcgaacgcactttcgccgcagcccacgtacggttggaggatgtgcggtggaaggccaccagacgcggtttggaaccgtggaagattaccgcggagttcgattccgcaggtcatgccgcccgtgcggaatggtcttggaacatgcatgacaacgcggtcaactgtctgaacgcaacggcacgcaagctcatcggcgagcaagacacgcctacggaaggacacgccgagaagcaggtcgaccagaattttctcgcatcattgaatttgccgggcgattccgcacgttccgcacgtatcgaacagacggtgtccgcttggaatgctccggaaccggttgcaccacaagccacgaatatcaagaccaccgttgagactcagtcatcggcgaccgttccgctgccgaaccgtccggaaatcgcgacgacgcagtcccccgccccttcaacgacggaacctgcccaaaactcgcaaaacacgcaatccgccggcgagcagcagtccgataagtccaagacggcatcatccgatcctcatagtcagagcaccaccaaatcgaagcgccgtgcaggacgctccgcagtgccgagttgggatgaaattctgttcggtgactgattaacgttccctaacatcccacggcaacatccgttcagacgttcggatcattcgatcaagccacgtcaatcaggcatggaatatcagattccatgtaggtcagcgacccgtgcacgctgggcagatgcatcgccttctccgcctgtgtgcgggaatcgacaatggtggtagagcccgcagcggagacgaccacatcgccgatcatcgacttgacgcgttcatcgactggtccgtagacgccttcctcgattgcctgccggcgggtgcgcacctgggcgcgctcccccagcacgtcacgccaacgagcggcgatgtcctccggattctcgccatcctcgccataaagcatgacacagcgtggttcgccgccgacattcgcgacgccccacatcagctggggttcggacgctatgtcgatgcaggcttccgggtcggcggttatcatgccatgatccgccacgatgacgatcagcgtgttcttcggcacacttcgacgcagcaaagacaactgggcgtcgatacgctcatatgtgccgatccacttgtcggagtcccagccgtaattgtgtccgatcttgtccgcgtcgcgcaggtacacgtatgtcagtccgggcgtgttcgccgctttcgccgcggtcatgatacgtcggcgtggatcgtcattggagatgtagtcgctgccacgtaacgccgcctgagtcaacgcggagaacgcgaatttcggcagtcccgaactggtgacgcgaacgtcctgttccgccaatcgttcgaatatggtcggctgctgttgcagtttcagcggtgcgggcgcgtttttgaaagagatgagctggcagatttcgccattgtcgggattgagctgcgtatatcccgtcatgccggttaatccggggcatgtgccggtgccgaacgtggacattgcggccacggtggtgctgggcatgcatgtggcgattggccgctggttaacgccatccgccatcagcgaccgtagatagggtgaatgccccaatctcatattgatgttccaatatccgagaccgtccaccaggaccacgactgccgaacgcgcgtccggcaggccaagtgcctcttggagtcgtttcggatcggcatggatggccgttggaatcggatgcccgatggcgctggaaatggcgggaagtaccgaggataggtggagagcaccgccgcggccgccctcatccggcagttcgtcgccatatcgtgccggactggtcatggctagcagctggtcgatttcgggcacttcaacactcatggttcccattcaagcaccgcggcagtaccagctggtaatattgctaggttgattaccataacctttccgtgaggagaaccaccgcatggtgtcgcaccgcaaaccggcaaaaccagcctttgacccgcgtacggtcaaggagaacatcgtcgaaacgccgttgaacgaggaaatgagcaagtcgttcctcgaatacgcgtattcggtgatttacgcccgagcgctgcctgatgccagggacggtctcaagccggtgcaacgacgcatcatctatcagatgggtcagatgagcctcaatccggaccggccgtatatgaagtcggcgcgtgtggttggcgaagtgatgggcaagctccatccgcatggcgattccgcgatttacgaggcgatggtacgtttggcgcagccgttcgcgatgcggctgccattggtggacggtcacggcaatttcggttctctcgatgatggtcctgctgcttctcgttataccgaggctcgtatggcgccggccgcgttgggcatgaatgccgatatcgccgaaaataccgtcgatttcacgccgaattacgataacaagcttcaggagccgactgtgctgcctgccgcgattccgaacctgctggtcaatggtggttccggcattgccgtcggcatggccacgaatatggccacgcacaatcttggcgaggtggtggctgcggccaagcatcttatgcgccatcccgacgcgacgttagaggagttgatgcgctacgtgccgggtccggattggccgggcggcggcgtgattgtgggccgcaagggcatccgcgaggcgtacgagacgggtcgtggcgcgttgaccacgcgttccgtgacgcatatcgaaaacgtgacggctcgcaaaaaggccatcgtcgtgacggaactgccgttcatggtgggtccggaacgtgtgttggaacgtatttccgaaggtgtgaagaaccgtaagctggacggcatttccggtgccatcgatttgactgaccggcataacggcacgcgcctcgtcatcgaaatcaaaaccgggttcgatccgaacgcggtgttggcgcagctgttcaagcacacgccgttgcaggacaatttcaccatcaacaatgtggcgttggtcaatggccgtccgcacaccatgggattgaaggaaatgcttcaggtgtgggtggaccatcgtcgtgtggtgatccgccgacgcagtgaattccgcaggaagaaggcgcttgagcggctgcacttggtggagggcttgctgctcgccatggtggacatcgatgaagtcattcaggtgattcgctcttctgatgatgccgaggccgcgaaaacaaagcttatcgccgtattcgatctggacgagattcaggcacagtacattcttgacttgcggctgcgccgtctgaccaagatgagtcgtatcgagcttgaggcggaacgcgacgatctgaagcggcgtatcgaagagcttgaacgcattcttgcttccgatgaggcgcttgacggcgtggtcattgacgaaatggatgacgccgtggccaaatacggcactccccggcgcacggtgctgctggatgaggatgaggaaggcaatttgacgcctgttgtggcgcatggcgatgatggcgtctctgcaaacgcgatggctgccgcgcgcgccgccgcgaccgtatcctccgcagcagccgatgtcgccgcagccgcaaaggccgcaaagaagaccggcgatgagaatgccaccgcatcggctctgcagattgatgacgagccgtgcgcggtgatgctgtccgccacgggcctgatcgcacgcacttccgaggatgcggtggaacgttgggagaatcgttcggcttccgacggacgtgccaaggatgatcagatcgtttcgatgttccgcacgtccacacgttcctcatacggcttggttacttcagcgggtcgtctggtgctggcccatgtggtcgaattgccgaaggtttccgcggatgggccgctcagtgtcacgggtggtgtgaaggccgaggaactgctgggcatgacggagaacaccgatccgatccgcggcgaacgggtgattgctgcgattgatatgccttccacggatgacggcggtcagcttgttcctttggcgttgggcacccgcaacggcgtggtcaagcgttggaaccgtgaatctccgaccacaatggattcgtggagcgtcatcgatttgaaggatgatgacgaagtgcttgccgctgccgaagcccgtgatgaggatcgtctggtgtttgtgtccaccgattcctcgttgttgacgttcgaagcgaagaatgtgcgtccgcagggccgtaccgctggcggcatggcgggcattcgtctggctgaggggtgttcggtggccgcgttcgcggtggtgcctgatggcaaggtgacatggaattacgaagaaggcgagaatggactgttctctgcttccggagccgtggtgttgacggttgccggcgattccgaagcgttgcctggcactgaaaacggtgccgcgaaggtcacgccgttggagatgtatccgacgaagggccgtggtacgggtggcgtgcgttcgcagcgattcctcaaggggcaggatacgttgattctcgcgttcgtgggcgcgtatccgttgcatgcttccacgcaaagtggcgctcctgtggaattgccgaagcctgatatgcgacgcgatggttccggtacggatctgtcggcgccgattgcggtggtcggctgattcgacgaaatcgattggcggggctctggactggttcttcttccggttcagggccttcccgttttgcgcacttgggccgccaggttgaatgagcaggctgggtgaaagtgcctccggcttggttcagccatatagcttcatgccttgtgggctgtccacgaacccggcagcatgcagcaaacgtctgtattcgttgcgttccttcaatgattcaccgttcatttcggcgaagctgacgctgcccttggactgatgctgcaatgcataggcaagttccgtacatgccggctgcaatattcgctcgtcatcggtgaagctgacgattctgtggcttttcggcacggcaaacagcaccggcatgccgtggtcgagcacgatgaccgattccgctctgcgcgccggtttcatatggtgttgttcgggccatgtgatcgcggagcctgtcaggttggccgggtcggtcacgtcgagcgccacgcaggattggctgcgcgcctcgtcgtcgccgcgcaaggcgtccactgtgtcacgtccggcgaattggaccgctccgaatcctttgacgaacatgcctctgaccagattgccgtgttcctccatacgtttgagtaccgggtatagtccggagaatccgcctgcgacctgctccttgtcgattagcggagcggcgatcacgccatatcggtcgagcagcgattcgatcaatgcgatgtcgtattcctcgatgccggctgttggtttgccggcggtatcgttcgcttgatccggtatcgccattggactggtccgggacgagtcgaccgcggaccataatccaccgagcgtcgccggtgtcgaggcgtggatccgtacgcgtctgcgtgcggcagtgcgtggcgcgcgcactgaaaccgtgccttgagtcaaggcccgaacgggagcgaatgaactgttcgtcactttgccttgccataccaaggaccacaaggcttcctcgaactggctttcgccccatgcgggaaggatgatttcccctgtttcaggattcacgttgacttccgcatgttcctgccagatggctttggcggctgtggaaagctgccgcgcatggaaggctcccccattcgataatacggcaagtatcgtctccggcacggtcatggttccggcactataggcattgttctgcgattgttcgccgggtttcgtcagcagccgtgaatcagctggatggaatgcgatgccgccggcttccttggcgttggaaccattgattttggagccgacccataccacgtctccggatgcgagcaattcgtccaacatactcggttggtagtcgcgaacgcgtgcggggaagaccgaggattcccaaacggaggcgttgaggtatatgccttcaagctgttcgatcacacgcatcagcccgtcgacgctttcatatcgggcgccacccacaggtccgacaccttgtctgtccaacaggaacgcctgatagacggccggttccaccggcttgatggctttgcgtgccttggcaagcgaaagcgcgcggatacgccgaaacacgtctttgtggagccattgctggggcgtttgccgaggtgaccgttccgatgctgaatcatcggaaccattggcgtccgctccggccgcatcatcgacgaaatggcctttcagcagttcgcctttggcatgtaattcatccaacatgcgtacgccttggacagcgtccaatcccagttcggcgatcatctgatccgcggtgaatgggccatgcgttttgacatatcgcgccacacggccggcaatgtcggtctcgtccaaatcgttccagaacgtccgtccggcaagctccttcccaacctgcgcgatgacgtcggcatccaacagcgaagccatgtccgtggctcccagaagacgttccagcacttccgggtccatggacagcagttgcgtgctgcgttcggcttgcggcacgtcgtattggtacatgaccgcgcccacgtatccgaacagcatgttttccgcgaacggcgacggcgtttccgtgacggtctcgctcaaagagatgacgccggagcgtaatccggacatcacatgtttcagcgcgggcagatcgtacacgtcctgtaggcattcgcgtgcggtttccaacagcaacgggaagttcttccgagttcgggcggcgttgagcagttgcgccgcgcgcagccgctgctgccataaggggacgcgtctgccggggttggcgcgtggcaggaacagcgatcgcgccgcgcattctcggaatcgtgcggcatacagcacgctttcgccgacttgcgtttcgatgatgcgttgcagctcttccgtgtcgaacagcagcagctcgcggatcggcaggttgccgtcgccgtccgggaggcggatgatgatgccgtcgtcggccgcgtatacctgcccatcgaacccgtatcgttgtttgatacgtgtggtgatggccatggcccatggttcgtgcacgcgtctgccgtatggcgagtggacgatcacacgccaatcgccttcttcatcctggcagcgttcgacgaccagctcacggtcgttgggaatcgttcccgtggcggcgcgctgttcggcaagcaggtcggcaagattgccgatggcgttgtcgtccaatccgtcacgacgtagacgtgcgattgttgtcgtgtcgaatcggctggtcttgtctcctgcgatgccgtccgagacttccgcgcgtagtccttgcgccatatcgcgtatgaatcggccttgggaccgtccgaatgccgcgtcccgcccgtcgccttcgccatgccagaacggcagtcgggcggtacgccctggagcaggaaccaccaccacacggtcccgggtgatttcctggatctgccaggtcgatgtgccgagggtgatgacgtctccaacccgggattcgtacaccatttcctcatccagctcccccactttgcgtgggcccggtccggagccttcttcgggaagcaccacggtgtaggttcctcggtcgggtatggtgcctccgctggtcacggccagtcgttgagcgccagggcgcgcggagatgagacccgcctcttcgttgtattgcaatggaggtcggaaggcggagaaatcctcgccgttgtaggcaccggtcatcatgcccatcacagcatcgaacatggttctgtcgagatcttcgaatggcgcggccttgcgcacggtcacgtaccagtcgtctggtttcagatcatccatcgccgcggcggcgacggtttgctgggcaagcacgtccaagggggtgcatggaatggtcagtgtttcgatgtctccggagcgcatgcattcgatgcttgcggccgtgccgatgatttgctctcgtgtaatcgggtagaacagtgcatgcgagactcccccgaccttgtggtcggcgcgccccacccgctgcaatcccgaggacacggacaatggcggtgcgatctggatgaccagatccactgaacccatgtcgatgccgagttcaaggctcgatgtggcgaccacgcaacgcaattggccgcgtttgagctgctcttcgatctgtttgcgccggtctttggaaacggaaccatgatgcgccatggcgatcgcgtcggcgtccgcatgcgaggagaccagcatggtggtggatccgaccacggaatcgtagtgtttggcgaagccttcacggccttccggggagcccagatccggatacggctgggtggaatcactggctgtggactccggctgggatgcgttgtccgacacactcaagtccgttcggccaagcctacggtcggacagcgcatcccgccctgcgtccgctttgacggcggtttcagacccagttttccgggatgtgcgcaattgcgcatacaggtcgttgagccgtgcggtgagtttttccgcaaggccacgggagttgacgaacacgagggtggtgtggtgtttcagcacttcgtcaagcacgctgcgttcgatggccggccataccgaacctccggtcgaaacccgtgaggtatgttcatctcccccgaccgaagtcagtcctttacgttccgccaatgcctccatggcaggacccaccccggaaatatgcgtggtatggcggttcggaagtttcacggcgcctgccctccgccctgcgtcgtcggagacgggatcgcgcatggccgaaagcggttccaccactttcagatccatgtcggggtgcgattcgggtctgatgacgcgtaccggccgcgtgccgccaaggaaacgtgcggcttcggccggcggttccacagtggcggaaagcccgatgcgttggacagaccggccggcaaggctttccaatcgttccaagctcagcgccaggtgcgcgccacgtttggagcccgcgatggcgtgcacttcatccacgataacggtatcaacggcggaaagtatccgtcgcgccttggaggtgagcagcaggaacagcgattctggcgtggttacgaggatatccggcggatggctgacgattctgcgccgttcctgcggcgtggtgtcgccgcttcgtatgcccacgctgactttcggcgatggcaatcccatcgcctcgcactgtccggcgatgccagccaatggcgcttggaggttcttggccacatccacgcccagagccttcaatggcgaaatatacaggaccttgacgccgcggacgggtttacgtttcttggcattgcaatcggattcagccgtgccgtccccaccgccggacgtccgcaataagtcatcgccctccttcgtcatcagacggtcgattgcggaaaggaaggcgcacaatgtcttgccggagccggtgggcgccaccaccaacacgttctcgccggagcagatggccggccatgccaaacgttgcgcctccgtcggagcattgaacgcatgcttgaaccaggcattggtagcctccgagaacaagtccatgcattcgtacatacgttcgattatggcatcgccttcagacatcatccacaaccggcggaaagctcgtcatccaccgtcgtcggctcattcgagcacaccgcccggctgacacattcgagcgtctcacatatggcgtcgtcaggcggccgcacggtcgccgcacttgcggcgcaaagtctcatgcatggcgaccatcagcgccaggaacaccaccagatagaacgggaacaggttgaccgaaacatgttgcgcgatcagcccgaacagcggcggcatgcacatcgatcccacataggcgcaagccatctgcatgccgacgatggcctgcgatttgtcctcgccgaaataagcaggagtggaatggatgacgcacggatagatcggcgcgcagcccaaaccgatgaccattagtcccgcgatggtgccgatattgtgcagcaacggcaggagcatgatgacgatgccggtcagcaccaacgcctggccaagacgaatcatggccggatcgttcagtttcatggtcaggaaaccgctggcgagacgtccgacggtgatgccgatgcaaaacaggcttccccacatggccgccgtggtcttgtcgatgcccttgccaagcgccatatagctgctggcccacaacatggcggtcgattcgagcgcggaatagcagaagaacatcacgaggatctcgcgggcgccacggatggcgagcacaccgcgaataccaagcggcttgcgccggtcagccgtttccccttccgattgctcggactgcgcggattgcacggaagaggtttcactcgtccgctgcggttcgacggtcttacgcgccttccacaacggcaggctcagcaccagcaccgcggtgagcacgacctgcagaatggagatggtccggtagccccacgcccaaccatggccggcacccaatgcgcttgccatgatgtacgggccaagcagagtgcccaagccccacatggcgtgcagccagctcatgtgacggctttcgtagtggattgccacatagttgttgagcgccgcatcgacgccgcccgcgcccaagccgtacggaatggcgaagagcagcagcatccagtaattcggcgagatggagaagccgaacaatgcgaacgccgtcaacgcaacggacactgccgtgaccttgcctgcaccgaaccgcaaggtcatgcggtcggatagcagcgcggacacgatggtgccggcggaaatcgtcatggaaatgccacccgcccaggaaatcggcgcatgcaggtcgccgctcatcgtcggccatgcggcgccgagcaccgcgtccggcagacccagactgatgaaggcgatgtaaatcacggcgagcagcaaattggccacagtcagctccttgtatgttttatgtttgcggcaataaaatcacgaaaatactccgctattttatccaaagttacctaccaaacggtattttgtatcttgcactatcgaccgacgtttttgcattatcgtgcatacacgaaaagcgggtctccgccgtaacgcaaggcccgccaatcgcaatcgccatgcaatatcaggtgtcgatcttggaacggtcgaaatcgtcggcgttctccacgatgaacgccttgcgcggcggcacgtcatcacccatgagcaggctgaagatgtggctggcctgttcggcgtcctccatgcggatacggcgcagcatgcgggtgcgcggatccatggtggtatcggccagctggtcggcgtccatctcacccaaacccttgtaacgctggatgtcctcgttgtagccgatgtgctttttatcaagctcggcgagtttgcctgccaactcatcatcggaatacgtgtagatgtactcgcccttatgcgtacccgtcaacgcgatacgatgcagcggcggcactgcggcatacacatgaccgtattcgataagcggccgcatgtaccggtagaacagcgtcagcagcaggatgcggatgtgcgcgccgtcgacatcggcatcggtcatcatgatgatcttgttgtatcgggcctgttcgatgtcgaagcttgcgccggatcctgcgccgaccacctggatgatggctgcgcattccttgttggacagcatctgcgcgagcgatgccttctgcacgttgaggattttgcctcgaatcggcagcaacgcttggaaaccggaattacgggcggccttggctgtgcccaatgcggaatcaccctcgacgatgaacagttcggccacatcgtcattgccgggctggcagtcggacagtttcggcggcatggacgcggattcaagcgcgttcttacggcgtgtgacttccttggtcttgcgcgcctgcacgcgggcatgcatttcgccgacgattttctccagcacgcggccggactgttccttgtaaccgcgtttggagccggtaatcatctcaccgaactgcttatcggtcattctggagacgatcggcttgacttgcgcagtgccgagcacgtccttggtctggccttggaactgcggttcggcgatgcggacggtgacaacggccaccagaccggcgagaatgtcgtcacgttccaccttcatatgggaatccttgagattcaccttgagtttgcgcgcgttgtcctcgatggccttgcgcacctgcttggtgatgccttggaggaagccgtccacgtgcatgccgccgccgggcgtctccaccacgttgacgaagctgcgcatggtggtgtcgtagccgttggtccatcgcatggcgatatcgactgcgcaatcacgcgtcaccttctgcgcatgcagttcaccatcgtctccgaccgcctgcgtttcttcaacatacgtgtcctcgccggcgatgcgccaaatatcggagaccgcttcgcctttggacaggaagtcgacgaaatccttcacgcctccggtatggcagaattcttcgacgcgcgcatgcggatatttcggctgcacgggctgggaaacggtttcctgcgattgcgtggcagcatcgttttcttgcgattcggctgactcatcagcttcggctgaatcctcctgcagtatgtcggcagaggttccgatatcatccgtttcagcggacgtgttctcttccgtcacctgttcgatgacattgtcatcgacttccagcatttcgtcaatggactcgtcgccggtttcgggaatgttctcgtcgatgacggtgattttcagccctggcaccaggaaactggtctgccgtacacggtcgatgagctggtcatagctgaatttagcggtgtcgttgaaaatctccggatccgcccaatagcggatgcgggtacccgtggtcttcggactgactttgccgatgatctcaagttcggtgggacgattcttgcgcgtcttcttgaatggcgaatcgggagacgggtgttccggatcaacgtcggaatacactccggggtggccctgatggaaagccatgtggtgggttttgccgtcacgatccacttccacgtcgagacgggagctcaatgcgttcacaacggatgagccgacaccatgcagaccgccggaagcgccatacgaggaattgccgaatttggcgccggcatgcagcttggtcagcaccacttccacgccggtgagcttggttttcggctccacgtccaccggaatgcctcggccattgtccgccacttcaacggaaccatcgtcatgcaaggtcacgatgatgtggttgcaggctcccgcaagagcctcatcgacggcattgtcgatgatctcccacaggcagtgcatcaggccctggctgtcggtcgtgccgatgtacatgcccggacgtttgcgcaccgcatccaagccttcgagcacggtaagactctcagcaccgtaattatccttagccatgttccctttcaattgtcgccttacaagacatgaagtcgagaaaccctgcgttcatgccggtttctcgacttcatttactcgcgtctgattactatcactggtccaggaagtcgcgcagcgtctgcgaacgggacggatggcgcagcttggacatggtcttcgattcgatttggcggatacgttcgcgcgtcacgccatacacacgtccgatatcatccagcgtcttcggctggccgtcctccaaaccgtagcgcatcttgatgacgccagcttcacgcggagacagcgtttcaagcacctgcttgaactgctcctgcaacagcgagaaggcgacggcatcggacggtgcgatggcgtcggtgtcttcgatcagatcaccgaactcggaatcgccatcctcgcccagcggcgtgtgcagggaaatcggctcacgcccgtacttctgcacttcctgcaccttctcgaccggcatgtcgagctcgcgggccagttcgtccggcgtaggttcgcggccgaggtcctgaagcatctggcgctgcacgcgggacagcttgttgatgacttccaccatatgcacaggcacacgaatggtgcgggcctgatcagccatggcacgggtgatggcctggcgaatccaccatgtggcgtacgtggagaacttgaagcccttcttccagtcgaacttctctacggcacgaatcagaccaagattgccttcctgaatcaaatcgaggaacagcatgccacggcccgtatagcgcttggcaagagagaccacgagtcgaaggttggcttccagcagatggtccttggcgcgcttgccgtcgttcgcggcccacttcagttcacgccggcgcttgaaatccatcttgtcggattccgtgtccagcagatgttgggcgtacagaccggcctcgatgcgttcggacaggtcgacttcctgttcggcgttcagcaggttcactcggccgatctgcttcaggtaatccttgaccggatctgcggtggcgccggctgcgatcacacgacgcttcggattgccggacggcgtcagattgtcgtcgtcatcatcgtcacgcaccacgaaagcgcctttttccttgggctcttccggctttttgcgcttgtcttcgtcatcgtcttccagttcggaatcgtcatcctcgtcgatattgtcctcgtcgaggtcgtcatcctccccttcgtcgtccacgtcatcaaggtcatcgtcgaaatcatcaagatcggcatcctcgacgggatcgtcttcaggagcgtcctgctcgatcaggttctcttcttcttccgctttcttgcttttcttggcggcggaggtcttcttcgcggccgtcttgcgcgacgtcttcgtagcggtctttgaggactcgctcttcttggcagcaggcttgcgcgtggaggccttttttccggaggtggtcttttcggtcagatcagtctgttccgtatttaccgtcgtttccttggtggccaaacttatcctcctattgatcccgccggaagcgtataccatatggacccacttctggcaagggcaaatcgtcaactatgtgagttaaccatcttgcgaggacgattattcccgcgtgttgagctcaccatgcgcaagtaccgcttcctttcggcgtgttgctctatgtctcttcggcccatgccggtccgatatgacgatgcgccgcggagcagatgatcgccgcgagcgaacaattctcatccaacgcgagcgcacgcatcgcgcacagcatggcgcgctcatcgcccatccaccacagcacataactgatgatggccaatggctgcacatgataccgttcggggaccatcccgatgatgtcgaacatcatgttgacgccgttgtcgcaacgtttcgtgtcgggttttcttgatgcgtcacggaacgatccgttgagggattcctccagatgacgcgtgttgccgggaagtgtcggattggccatgaatcccatgagaaagtcacgtgacgaacgtcgttcatccacgatgatggagaccagcagcgcgtcacgcaccgccatggtctgctgcatggcgatggcaagtgctcccgcaccgtttctggacagtctgcattctggcgatgaatcgtcacctcccgacgattcatcggccagctcatccatccattccgagaatggctcctgcaggaaatcgcgtatgctctccgccatgcccagcgatttgcaatcctccaccaattggtcttcaagccgttccatctcggcttcgcatatcggcatgggctcgtcgatcgtcttcatgtctcgtcctccttggcgtatcggagcggtcgcttgatgcaggccgctttgttggaactatgcatcatccggcaatgcaatgaggcgtttcggcacccctgtggtcggagaacgtgaagctcggcgtgtcacgaaacgtccggcaccgtctcacccgctgcaatcattatgttttcctcttgtcgaatgtgtgtggataaccttgacccatgactagctctcccgatttggaacagattgaaacgcgcacgctctcgctggtaagggatttttcgttcctgcatgcggacgatccggtggcgaattcctgcaaagccgtcgctgatgcggtggcgcagcaggcggtcacgtcaagtgagggcggcaaacgtctgcgggcgttgctgacgttggatgcgttccgtgcgttcgcgccgcaggatgtggcggaacgtgatatggatgcggtgttggatctggcatgcgcgatcgaagtgtttcagaccggcgcgttggtgcatgacgacatcatcgacgattccgatctgcgccgtggcaagccgtccgctcatcgtgcgcttgccacggatacccatagtgatgccatcggccatggtttgggcatcatgttgggtgatatgctggccaccgcgagcgtggatatcgccaataaagcggcttgccggcttggctccgggtcttccgtggtgtcggccttcctgaatatgcaccgtgaagtggaaatcggccaagtactcgatttggccgtggaactcaatacgttagacgatcctgaagagctggcgtcggcctctttgaatgtcttccgttggaagaccgccagttataccactatcgcacctttggaattcggtatgcttgccgccggcctcgcccctgcggacgcgcgcaggctcgcactggcgattggattgcctcttggtttggcgttccagctcgcggatgatcttctggacgtcatcgggtcgagccgcaataccggcaaaccggtgggcggtgatatccgtgaaggcaaacgcacggtgttgctggccgatgcgattgaggctgccggcgatgtcgaacgacgtgaactcatcgacatgtgggaagccgaatcacgtgacgaggcacatgttaggcgtgccatcgcattgttcgagtccactggtgccatcgcacgttccaaggaacggatcgccggtctgtggctcgagtcgaaggccgccatcgagacgcttgaactatcgcaggatcgcaaagacacgcttaccgaagcatgcgcacgtttcgtaccgattgtgcgggaacagggctgatgccaccgcactgtgaaagacccgtgttcatcgcatcttccgcaaaccattccttgtagactacaagtgaacacatctttgtcgcgaaacgttttttgaagaaggaatcgtaccgattagccatgagtgaagcccagcatgcccccgaaggccaggtcatcgaaggccggtaccgagtcgtcagcagaatcgccgatggcggcatggccacggtgtatcaagctgttgacgagcgtctgggacgtaccgtcgccattaagatcatgcacacgcagctggcacagggcccacaacgcgaccagttcgtggaacgtttccatcgcgaggcccgttccgcagcagcaatagccaatccccatatcgtgcaggtgtatgacaccggtgagttcgatggactggattttcttgtcatggagtacgtgcatggcgtgaacctgcggtacgaaatgaaccagcaagtcacgttcagcgttcgtgagacgctacgcatagtcggtgagacgttggacggcttggcttcggcgcatcgcgcaggcgtggtgcaccgcgatatcaaaccggagaatattctgctcaatgaccgaggacatgtgcagatcaccgatttcggcctggccaaggcggtgtcgcaggccacgctgtcctccaccggcatgctgctgggcacggccgcctatctggcgccagaaatgattcagcacaatcaggcaacgccgcagggagacctgtattccgtaggcatcatggcttgggagatgctggccggcaaggtgccgttcaccgcggacaatccggtgacgctggtgttcaagcacgtgcatgaggatgtgccggatatcacgaccgcttgtccgggcatcaatgcaggcgtggccgcattcctcgcccgtcttacggcgcgcgcggtcgaggaccgtccccaggatgcgtccgtggcattcgacgaattgcagcagttgcaatcgaacctcaccatcgacgactggcaataccgtctgtcagccgtttccccggccgcaaacgatgccgccgacaccatgcccggcgatggcacccggcagatgccgctaccgcccgctcccccagcaccgcctgtgcgtcagaacgacgatcgtacacgacagttcaatccggaaaacccgaacaaaaccaccgtcatgccggcgcagcaggcagatccggaggcaaccacccgcttggctttggaaaagaacgacgtccccgccaacaacgttccagcttccccctcgaacggtccggtcagtggtggacagccgaaacgcagtggcaagcgtgcacctgtcatcatcgccgtcgtagcagccatcgtgcttgcctgcgcaggcggtggaggctatgcctggtggtatttccgaggaccgggcagctactggaccatgcctcagccggcagatctcacatgttccgattcggagccctgccgtatttccaacatcaaatggaacgcctatgaggaactgctgaaattctccaacatcgagtacgaagagaccgaggcgttcagtgattccgtcaaggctggcaatgtcatctccaccgacccggagaatgtcggttcgcatgtgagcaaacgtcatcatcagaaggtcaaggtggtagtgtccaagggtattaagcagggcactgttcccacagacattctcgatgccaccagtgcgaacggcaaggatccgatcaacgcgttgaagcgtgccggcttcgacaacatcgaacagactccggccaatgatgacgcgtattccatggacgtacctcagggcgcgttgcttgatttaagcgtggatcccggcgcgactctgccccataacgcgaagattaccgtcacgctgtcccaaggaccgaaaccggttaccatgccggacgtcgtgggcaaatcgaaggatgaggcgcagcagacgcttgatgcgctcaagctcaccgtcaactggaccgagcaattcgatgacaagattccgcaaggacaggtgatttccgcttccgcgaagaccggagacgagttgcactggggcgatagcgtcaatgcggtggtgtcgaagggaccggaaaccgtaacgctgccgaattatgtcggacagaaagccgccgctgccaaagccgcattggagaagctgggattcagtgtgaagatcagctcgcaactgacacttgactccagtcaagacaagaaggtcgcttcgcaggatccggtaggaggcaccgaggtgcgactgcgtcaggaggatggcacgccgaataccgtcaccttgaaaatgtattcgtcgctgttcgactgattatcctgattccaaaccaatcaggggtgtctgttccgaaaacattcttcggaacagacacccctgattggtttggaatgaacctcgctgaaaacttatgccttcttggcagcggattcggcttgtgcctgcgcttcggcctcctgctgggctttgagctcggccttgaccttctgcgcgtattcgtcgacgtattcctgtccgctcatcttctggatctcacgggtcacgcggtcggtaagcgaacgcaaatcatcgtgggtaatctggtcggcggatttcttctcgacttcaatcggcttgccgtaaatcaccttggacttgcctttgttcggaatgacctgtcctggcttctgcagttcacgcgaaccgatgatggcggccggaataatggggcaaccggtttcgaatgccagacgcgccgcgccggtgtgtcctttgtaaagacgtccatcggggctgcgagtaccttcgatgtgaatgccgaacagatgtccgtcctcgatgatctcacgggcgtggttcagtgcgccaagtgatttggaaccgccggaacggtccacggggaacacgccgactgacgtgaaccaccatttcttgaatttgcctttgatgcctttgccttcgaaatattcggccttgcccatgaaatgaatcatgcgcgggcaggtcaacggcagcaacgcatcgtcgatgacggcaagatggttggctgcgataatggcgccaccttcgtgcggaatgttctcaagtccttgcgcggtcggtcccaaacggtggatggcgataggtcccaagcctttaacgaaaaaccaatagagcattcttcacaatcctcccggcggattggcgtccgcccgattagagtataagtatgactgacctcaacaatagcaatgacgatgaagaacgcccaaatgacgcgtcgcatggtggcggctctccaatggacgacttggatgcggcttgggccgagtttgcggattcgcatgctgacgatttgaaggccgtggaacgttcgcgtagtgcgaaacgtttcgagaagcatgcgcaacgtcgggaaaaagaggctttgctgtccatcgatgacttggatcagggcacgttcaccaatgatgcgccggcgaatggtcgtgggccgcgcgatttcactggttcgagctggcttgacacggatcgggtcatggaccgttacggtgacgacttcgtgccgccgaatcctgaaatcggccatgtgaaactgtcaaaactggtgttctggatattgctggtggccggcgtcatcggcattatcgcttccgtgttcgttccggcgttggcttcgattcttggttcgattttcggtttgtgtgcgctggtcggcgccgctggcctcatcgtgcagcataaagggcatcgtgaaacgcgtaccgacgaattcgatgatggagcacgcgtctgacgattctttggcgacaaactgaatacatccatctatgtgaaggccccggcggttattgaactgcgccccgtttgttggacgttgttaattgggatacagggtcagaccgcgagggacatgctccggaactcctccggggtgcgtccctcgagtcgtatctggcgtcgtctggtgttccaatggatgatgtaggcgtccagctcgcgtttgaactgttcgtacgagtcgaacacacggccgcggtagaactcgtccttcaagtggccgaagacctgctcggccgccgcgttgtccaggcagttgcccttgcggctcatggactggcggatgccgaggcgttcgagctcgtcccgccaccattggtgctggtactgccatcccatatctcccgtaccatcggctccacgtccggcctggacacgtgcgccgggcgcgacaggtggtggtagtacgtggatttcggcaacccggctatcctcaggaggtggccgagccggtgtccccgccctgcgagcagtcggacgacggcgcttcgctcgcgccgcgtgacttggacgcccgcagggcccggagtttttccaggtacgcgaccttcgccttcaggtacgcgacctgttcggcgagctcctgctcgcgcgtcggttcgggcttcggtttggatttcgcgcctttcggcctgcccttgggtttcggcctgagcgcctccggacctccggaccggtagtcgcggcaccagcgctccagggacgcgatgctcgcgatcccgtgcctggccatggcctccgtcttggtcagaccgttctcgacgtggtcgcgcgccgcggcgaccttcgtctcccagtcgtagcgtctgctgccgccgcctcccatgaccgcctcctcgccgttgaacctgtacagcctgatccagtttctcgcggtatacaccggtatggcaagccttctgacgagcgcgtccttgccggctccggacttgatgagctccagcgcctcgcgccggaacccgtcgtcgtaacgtctccttcgatcctcacgcatacgaaagaaccgcacctccgatcatcgaatctgaatttcttcagtccaacaatcggagtgcggttcatatttacgccggggccttcacatacacatacgttgtcagcgttttcaggctttcttcgcagcttgggcggtggcgatccacttgtcaagcagcgccgtggccttgccggagtcgacggtctgctccgcgatggcgtaggcggctttgaaccggtcagccaagcttgcgtcgcccggcaccaaatgaccgtcggcgacgattgcggaagcggcgttcagcagcgcggtggtacggaacgacacatccttgcctgcgaagaagtctcgtgccagctgcgcgttgagcgtcggttcgccacccttcagatctgcgatggtgactttggcgaggccgagttcgacggtcggatcgaatttgttttcggtaaccttgccgtccttgaattcccaaatggagaccggaccggtcggtgccatctcgtcaaggccctcatgggaagtgtagaccatgccgatctggccgttcgccgcatatacggcggccatgatcgggctcatcttgcgattagcgcagccgacggccatatgcttcgggtttgccgggttggtcagcggaccaagcacgttgaacacgcatggcacgccgagcgcggcgcgaatcggaccgacaaaacgcatggcggggtggaaggtgcgtgcgaaagcgaatgcgatgccgcattcgttgccgacttcgctcacttgttccggagtcaaatccatgggcaggccgagcgcttcgaagcagtcagcagtgccgcacttggatgaggccgcacgattgccgtgcttgacgacttttacgcctgcggccgcggctacgacggcccccatggatgacaggttcacggtggaggctccgtcgccaccggtgccgacgatgtcggtggtttcgccgtcgatgtgcagcggaatggcatgggccaccatggccttcgccgcgccacgcacttcgtcgggggtcagccccaactgctgctgggtggcgagtaccgcgccaacggccgccggatcggcattgccgttcatgaggtcatcgacgaaccactcggattcctcggcgctcaagtggtcccctccgaccagcttggtgaggatcgacttccatgtgatttcggccatgatgccctccttggcgctgtcgcacgcctttattgttgttctgatgccgccaattgtaacgattggacgtttccccacgtccgcacgtccatatcacgaaacggcccatcgaagattcttcaaaaaagaaaacctcccccgattacggtcgggggaggttatgtcatgagcaagtcagcgactcagcgaatcactgctcgttctggccatggcacatcttgtacttacgaccggaaccgcacgggcactgggcgttcttgccggttcccgggaaggtgcggccatccgcccacggggagtgcagctcctcgctcttcggacgcttgttggccggaaccttgccttcggcgtggctgatcggctgcatgccgacgatgcccttctcgttcttctgctcgtcagccagttcatcgatggtggtcttttcggcctcgtcatcggtctccggctctgcaggagcggattcgccggtcgcggcggcttcgccgtccagacccattacggcctcggcggcgttcacggcctcatcctcatcggattcggtctcctcgtcctcggtcatggccacgcgttcgatgtccacgtggaacagcagctggatggtttcctccttgatggcttcgatcatggagttgtacatctggtagccttcacgctggtattcgaccagcgggtcgcgctggcccataccgcgcaggccgatgccgtccttgaggtagtccatctcgtacaggtgttcacgccacttgcggtcgagtacggcgagcaccacgcggcgctcgagctggcgcaagccttcgctgccgagcttgtcttcgaaatcggagtactggtccttggcgtcggagacgatgagctccttcagggcctcaacggccttgtcgcccttgagcttgtcgacggcgtccttggccgcttcctgctccacggcgatcgggtacacggaggagatggccttgaacagaccgtcccaatcccaatcgtccggcttgtcggaaccgttgttggcgcccttgatgtagctcagcacggtgtcgtcgatgaacttgaggatgtcctcgtggatatccgcgcccttcagcacagcctgacgctccgcataaatgacggtgcgctgcttgttcatcacgtcatcgtacttcagcacgttcttacggatttcgaagttacgcgattcgacggccttctgcgcggtgcgcacgcccttggaaacgctcttggcttcgatcggctcgccttccggcatacccttggccatgacacgcgccaccagctgggtgttgaacagacgcatcagatcatcttcgagggacaggtagaaacgggattcacccggatcgccctgacggccggaacggccgcgcagctggttgtcgatacggcgggattcgtgacgttcggtgccgagcacatacagaccgccgagcttgacgacctcctcatgctcgtccttgacctggtccttgatctcggccaaagtgcccggccaacgcttctcgtactcgtccggagtgtcatccggggagtagccttcggacttgagcttcgcatcggcgaggaactcgacgttgccgccgagcatgatatcggtaccacggcctgccatgttggtggccacggtgacggcgcccttacggcctgcgacggccacaacggcggcttccttgtcatgctgcttcgcgttcagcacctggtgaggaatcttggccacgtcaagcagagaggacacgacttcggaggattccacggatgcggtacccagcaggaccggctggcccttcttgtggcgcttggccacatcacggacgatggcggcgagcttttccttcttggtacggaagatcagatcgtccttatcctcgcggatcatcggcttgttggtcggaatcggcagcacgcccagcttgtaggtgcccatgaattcggcggcttcggtctctgcggtaccggtcatgcctgccagcttgtcgtacatgcggaagtagttctgcagggtgatggtggcgaaggtctggttttcggccttgacctccacgccttccttggcttcgatggcttggtgcagaccctcgttgtaacggcggcccggcaggatacgtccggtgtgctcgtcgacgatgagcacttcgccgccggtcacgacgtagtcgcggtcacgcaggaacagctccttggccttgatggcgttgttcagatagccgatcaatgcggtgttgttcggttcgtacaggttgtcgatgccgagatagtcctcgaccttggtgatgcccggatcaaggatgccgacgaccttcttcttctcgtcgacctcatagtcctcgtcacggttgagcttcagaaccaggcgcgcgaactggcggtaccagcgggtcacgtcgccctcggccggaccggagatgatcaacggggtacgagcctcatcgataagaatggaatcgacctcatcgacgatggcgtagtggtggccacgctgtacgagatcggacttctcccacgccatgttgtcgcgcaggtaatcgaagccgaattcgttgttggtgccgtaggtgatgtcggcgttgtactgcttgcgacgctccggcggcttctggttggtgatgatgcagccggtgctcatgccgaggaagcggtagacacggcccatcagctcggcctggtagctggccagatagtcgttgacggtgacgacgtggacgccctgaccgtcgagtgcgttcaggtaggccggcagcgtggccacaagggtcttgccttcaccggtcttcatttcggcgatgttgccccagtgcagagcggcgccgcccatgagctgcacgtcgaagtggcgcaggcccaaggttcgcttggaagcttcacgcacggtggcgaaggcttccggcatgagcttgtcaagggactcgccgttttcgatacgctgcttgaacttggcggtctggcccttgagctcctcgtcgtcaagcgccgcgatctcgtcctccaaggcgttcgtcgctttggccacgttctcaagcttcttgatctgtcggccttcacccatgcgtagggctttgtcaacgatatctaccacaatcactccctttgtgtatggtgactttcctcgattgaggatagtcgctttctcgcgatttccgaaaagctccgtccattttacgtaagttttgacgtatcttgtttttcgcataagaaaagaggcccgcatgtatgacatgcgagcctcttatcgttcagttttcagccattagccattacttcttggccacattctccggagtgtcgatttcgaagacgccgtagctccaaccgtgacggtggtagacgacggacggacgaccggtttccttgttgacgaacaggaagaagtcgtgaccgatcagctccatctcgtacagggcctcgtcaatggtcatcggctcggcgatgtgcagcttgcggcggatgacgattggggtgtcgccgacctggacctcgacggattcgccagggccgagatcagcggaaacggcgtcggccgggctattgttcggcgcttccggctccggctcctcgacgacgaccggctcgaccgggcccagatcgaccgggaccggatcggtgtagccacgacgatggtccttgcggcggtcgcgggtacggcgcagacgaagcgtcagcttgtcgagagccaaatcgagcgcgctgaactcgtcggcgctggaggcttcggcacgcaccacggtacgacctgcgatgacggtgatctcaacgcgcttggcggtgtcggcctgacgcggattgccctcgtgggacagcacaatctggacacgctgcgcatccggggcgatagcggtcacacgattcatcttgctttcgacaacgtcacggaacctttgcttgatctgcgtatgacgtccggtaacgacgatttccatgtggacctccctagactcaagcggtgttaaccgctatatacggaccaaccagctgcatcgctgcttggtagtcatcattgtatccataagattggtgatttgctggaaaactccccgagaaaacaaaagtttttttacgctttgctttcgacgattctcttgctatagttgtgcgtttgagacctcttgatggccgcgaccgattttgtcggttgaggaacttccgggctccatagagcacgatggcggataacgtccgcccagggcgacctgagagatagcgcagcagagaatagaccgccttaccggtttcggccggtgggtaagggtgaaacggcggtgtaagagaccaccgggccgctggtgacagttggccgcatggcaagcctcatcgggagcaaggccaagcagaaggcgttcgaggactgctcgtccgaagccttcgggtaggctgctagagcctgacggcaacgccaggtcgagatggatggccatccgtgccgttggcacgacagaacccggggtataagaggtctcactctccactctttatgttttgaggatttctttacaccagcctctttatgaaactgacgtcacgcccttggtcaacggtcgccgtcaatcaaacagttcctgtgcgatttggcgcagaatctcaggattatggccttttctgccgcccgcgctccagaagcggcgcctacgtgcatcgcgttccagaccggcggtttttctcgcggttctacggcctaattcccatgcggcttcagtaaacacgccgtaggattccgcctcatcacaaacctgttgggccagcctacggtcgacgcctttccgtgtaagctcagcgaccgcgcccctacatcccataagacgggtcgcacagtagcgtaccgcggattgcgcgtaggcttcatcgtcaatcagttgaacccttgtcagtctttcgatgacgtcgtcaaccacttcagaggtatagcccttaccaatcaggcgctcacgcagtgcgccggaaggtcgaggcgcagcgtccagcaatcgcaatgcggcttccctgcatgcgtcaagatcatttggatcctttgcggcagtagaatcgccgttcccgacacgcccagcgtgtcgcgcgtgtcgtggcgttttcgtcgcatttgcgcttccagcgaacaaactggaacggtcaggtttcgttcgacggttccacctctgaacgttcgtgcgttctggatcctctgaagaaagggcaaggcccccagtatcggccgacgccggctgaaggccctgttccttaaggaaacgttcggcgctgatcatatgtcaggctttggcggcttttgaagttttagacgtcttaccatcatccggcgcgcccgcggcgtcctccgccccatcgtcctcggcgaactggtcggtaggtttgatcagaccgaatgccgccttgaccttgttctcgatttcctctgtgagttccggattgtccttgaggaactgacgcacgttttcgcgtccttgccccagctggtcgccctcataggtgaaccacgagccagactttttgacgacgttggcctgcaacgccatatcaagcacggaaccttccttggagatgccctcgccgtacagcacatcgaattcggcggtcttgaacggcggagccatcttgttcttaacaaccttgaccttggtacggttgccgacagcctcatcaccgttcttaatggtctggatacggcggatgtccatacgtacggacgcgtagaacttcaatgccttgccgccggtggtggtctccggattaccgaagaacacgccaattttctcacgcaactggttgatgaagatggcggtggtaccggcttgcgccagcgcaccggtcatcttacgcaacgcctgactcatcaggcgcgcctgcagaccgacatggctgtctcccatctcgccttcgatttccgctttcggcaccaaggccgcgacggaatcgataacaatcacgtcaagcgcgccggaacgaatcagcatgtcggcgatttccaatgcctgctcgccattgtccggctgagagacgatcaacgaatcggtgtcgacgcccagcttacgggcatagaccggatcgagcgcatgctcggcatcgatgaatgcggccacaccgccggccttctgggcattggccaccacatgcagcgccaatgtggtcttaccagaggattccggtccgtaaatctccacaatacggcctttaggcaggccgccgatgcctaatgccatatccaaagccaaggatccggtcggaatgacctcgacatcctgttccgggcggtcgccaagtctcatggccgatcccttgccgaagcttttctcgacctgcgcgagcgctgtgtcgagcgcggcctgacggcgcggatcgattccattcgcggacttgttctgtgcggcgttctttgccgcgctcgtctgtgccatgactactccttgttgttgaccgagacgaatgaatggattcaccgtaaaaccgcatcatccatctacgcaagttcaatcggccattgtggtcgaagaacatgcatttcgacacgccgaagaccgctttcccttgaaattccagcattctgaaacttcgcggcgagccgttgacgacctgcccaatccgtgcttctgtggataactataccccattatccgaacatctgttcgaaatcggtgttttgcgatagccgaactccgcctaacgcaccggcattggtggcgcgttatggtcctttccccaacgtttggagtcaggaatgttcatctggtcgcacagaacgttccataccacgcggggctcctcccccatttcaagcgcttcgacggctgtcagaccgttcaatcgatcaagcacttggtcgcgtgcgagcgcgcggccatagctacggccgagtacctcttcaagcaactgccaaaattcacgttcctgcacgcgcccaagtgtacacagcaagcgcaaccaaaagaaaacgcccgacggaacaagccgccgggcgttagacgtccaacaggaatcagattgcgacggaatcgagataatcggcgaccatgcgcagcatctgcgccgtggagacgcccaacgattgcgcaatcgagctcagcagctcggagctggcctctttttggccacgctccacttcggagaggtagcccaacgacactccggccttttcgctcacctcacgcaacgttttgtggtcatgggtgcgcagatcgcgcagtacatggccgatggcctcgcgaagcgatacctctctgggttcgtcggtggtttccgtggctgccgacatggatcgtgcggaaacgcgttccgcgtcttcctcccgccatatgcgggtcaatgcggcctggcgctcgtctttggcctttttggccgcgcgggcacgcagcacctgctgctgggcgaacatcaccgcgcggcgctgggctggggtgagttccctgacgcgggcgttgccgctttgcaccgtgggaaccatcgccttgagttccatctgttccttggtgagtgtcatcgtgtccatgccgccagcccctttcgcttttcatacgtacgtccactatggtcaacacccatattcgtggattattcctgtgaaagtgctgaaagagtcctcagtttttccagaatacattgcacggtttcgtgccgcacggctttccgatcacccttcagacgcagctcataagcagctgtttgacgcgcacgaatgccattgaagccacagggcagggagcagccgatgtacaccaggccggcaggtttgtcaccatccggtcctggccctgcaacaccggtagtggccaagccgatgacacagtctccatcctcggtctgtcggtatagttgcgcggttcccgcagccatctgccgcgccacttcggggtggaccgccccttctcgggccagcaggtcggcattcacgccgagaatcttcgctttggcgcgaatgtcgtaggtcaccgccgagccgaggaacactttcgatgcgcctggtatgcgtacgaaggcgtcggcgagtagacctcccgtcagtgattcggcggcggcgattttgaaatggttggcttcgcaatagcgtaaaacggctgcggccagctcatcgcattgcgattggctggccgcggtcgacgaattttcggattcgctcatcgggatttacttggtttccttttcggattttgcggtcttcttacgtccgccgaacgtgttgacgaggtattcgccgcccgaatacaggcatagaatcaacgccaggtaaatcagggcgtacgtgatcgtgtaataaacggtcatccacagcggagtggtgttcatgccatcagcgaggctccacatcggcagcatgagcatggcaaggccgatgcactggcacagggtcttgtacttgccggcttgggatgcggcgatgaccttgccgccggtgtcgatgacgaagaaacgcatgatggtgatgccgatctcacggatgaggaacagcgcggtcacgacccagccgagcactgcgttgccgaattcgttgaagatggcggcgacgatcagcgtgccgcaggtgagcagcttatctgcgattgggtccatgagcttgcccagttcggtgacctggttatatttgcgggccatccaaccgtcgagcttatcggtgcaggcggcgatgatgaagataatcgccgccacccagcgcatagtcgtgtttttggtaccccatgcgcctgccatgacgtacaacgccaggaagatgacgaccaggacgatacgagagaaagtgacgatgttcggcggggcgttccacccgtcaagcagggacgatttgcgttcttcttgcttttccataccgttcacgttaccccgataccactacttggcgcaatgcgtgcggttgtcgcgttccatcatcgcgtgtccgcagcgtcggccggctgggtagaacctgcggtaagcgatgaggtttcgcccttgatgaaggcgagcacctgcggcagatcctgcggttggacgagcacttcgcgagctttggagccttcggacggaccgaccacaccacgcgattcaagcagatccatgagtcggccggctttggcgaatccgacacgcagtttgcgctgcagcatggaggttgagccgaactgcgtgctgaccaccagttccgccgcctgcaacagcacgtccatgtcgttgccgatgtcctcatccggctcgatggccttcttttcggcctccttggccatctcctcgatatcctcgcgataatgcggcttgcgctgggttcgcacgaactccaccgcgcgacggatttcggactcgtcgacccatgcgccctgcacgcggatcggcttggcctggcccatcggcaggaacaacgcgtcaccttggccgatcagcgtttccgcaccggtggcgtcgaggatgactcgcgaatcggtggcggatgaggtggcaaaagcaagtcgggacgggatgttggccttgatcaagcccgtgaccacgtcaacggacgggcgctgcgtggcgagcaccagatgcacgccggcggctcgcgcgagctgcgtgatgcgctggatggagctctccacgtcgttcttggccaccatcataaggtcggccatttcatcgacgaccacgaggatatacgggtatggtgcgaccttgcgtttggagcctgcgggcgcatgcaccttgccagcgcgcacggcagcgttgaagtccttgatgtggcggaatccgaagaattcgaggtcgctgtatcgtgcgtccatctccttgaccacccattccaaagcctgtgcggccttcttcggatcggtgatgatcggggtgagcaaatgtggaatgcccgcataggcggacagttcgactcgtttaggatcgaccatgatcatgcggacctggtcaggcgtggcgcgcatgatcacggaggtgagcatggagttgatgaagctcgacttgccggagccggtggcgccagccaccaacaggtggggcatcttggtcaggtcggcggtcacgaaatggccttccacatccttgccgacgccggtgagcatcggattcggatcgttccgggccttgtcggagcgcagcacgtcgcccagcaccacggtttcgcggtcggagttcgggatttcgatgccgatggcggatttgccttcaatcaccgacaggatgcgcacgtcggagctggccaccgcgtaggcgatgttcttctgcaggttggtgaccttctcgaccttgacgccagggccaagctccacctcatacatggtgacggatggtccgcgcaggaagccgatgaccttcgcatcgacgttgaactgttggaaggtaccggtcagcgcgcggatcacacgatcgttctccggagtgtgcgcggcgtgcggcgcgcccttcttcagaatgttgaggtcaggcagatgatacggtccctcgggaatgtcatccgccgcttccccgtcaacggcagcagccggcatatcgtcaaggacctcgccggtcgcggcatccaccatgacttccttgccgttggaggtgccgtcctcgtcgatgacggcccatgggtcgtttggagcgacgccaaccggcttgatttcgctggacggcaccggctcggcgacgctgggcatggtgccgctcgcggtgccgatcggcgcggacgagaaggagcgtccgcgaccgttctgtggcatggccgtggtgccggacggcgcagcggcggaataatcatctgaatcataatcatcggcacgataatcgtccgaagaaatgctgcgtggcgaatcgacctgttggtacggctcgtcgacgatggtttccgcggtctgtccgtgccgttcggcggcattaagaaacgcttcgtcgccggcgtaatggtcaaggtcgccatcatcgacgttcttgctcttatgggatgcgaagcgttgcttcatacgcgtaaggaagcccggactatcgtcgttttctccatccgcatcggtgccgtcgtgggcgggaacgccttcggcgaaggcgagtgtcgtgcccccaacgcggacttcgttcggaaactgttcggcctcatcgtcaatgtcatcacggtttttaggcgttccaacaaacttggccgccagagccttcgccttgtccggtatctgcgtgacccgggtatgggtaatcaacagcaacgaaaacaggatgacgactacgaaaatcgcaatggaaaagcctttggaaagcccccacgccaacggacagccaagcacatagccaagcaggccgcctgcccgctgcagcaaagacatatcgaacttctgggagtcggaggcaatcgccgcgtcaagaatagagcagacggaccagaggatcatgaaccatccgagggccatatggaggttctcatccttgttttgcgtcttgcgcatcagactgaacaccacaagcgccaggaataccggcagaatcacgctggtcaatccgaacagtccggaggccatggcatgtaggacctgtccgaaagcgccctggacacggaaccattcggatgcgcagaacagcaccgcgagaatggccatgatgaaacatgcgatgtcgcggcgatatttacgcagtatgccggcgatcggcgaggaatcgacctcgtccatgactttggtatcgccggaacgcgatttgcctgcggaacccttgccgcctgatttcgggttggaagatgctgttcgtgccataacaggactcgattttacccatgggcaccgccatggcacgacgacatccgatacttatcgaaagtttttgccgttcacgccgtcaggcgcttcggctagacgatatcgccaagatgatgctgcgtgtacgcatccgcctgcgcgtcgatcgcgtcgtaatcgccggcgtcggcatgctcgatgatggccatggcattgcccagcagcgcggggttgagagcctgcagccagtggatacgcggatcgcggccaaaccatcccatctgtttgcgtgccagacgcttcgtcttctgcgcgatgctcatgaacgtgtcatttaaatcgcacaggccatccaaatagtcgacaacctgctggtatccaagagccttgcctgcggtgatgccaagccggggacggatacgctccacttcctcgacgaaaccgttctccagcatctgcttggtacggatgtcgatgcggcggtcaagttcctcacgcggcaaatcaaggccgatctgcacggtgggaatcacataccggtaatgcggcaggctcgccgaatacggccggcccgtcacttcgatgacctcaagcgcgcggatggtgcgtcgaggattgtgcggatccatgcgggccgcggcttcaggatcctttgtcttgagctcgtcgaacagcgcaccggcgccttcgaccttttcacgttcctcgaggcgtttgcgcacctctgggtcagtgccaggaaaggaaatgtcgtcgatggcggcacgggcgtacagaccggaaccgcccacgaggatagggcgcactcccctggcctgcagttcggcgattttggcgcgggcgatctcctggaaacgtgccacggacatggcgtcgtccggttcgatgatgtcaatcaggtggtgcctgacctcggcctgttcctcaggactcgccttggcggtgccgatatccatgcccttgtacatctggtaggcatcggcgttgacgatttccgcctgctcgcccttggcctccaacgccttggcaatggcgatgccaagtcccgtcttgccggacgcagtgggaccgacgatggacacgaccttacgggtttcgggcttgctttcagtggcggacggcataggtttgccccgcttccggattcggatcggcgatgagattgtggcgtcccgcatgggtgacggtggcggtcacgaaatcacccacctgcggcatcgactcgccttccggcacgccgacatgcaccagcacgcccgtcttctcacgtccagtaacacgatgggtggcggcatccttcttgccggatgcgccggtgaccatcacctcgacgtcacggccttcgaaagtcttgagattctcttcggtgatacgttcctgcagcgccacaagacgttcgaacctgtcctgcaccacgtcatgcggaacctgctccatctcagccgccggcgtgccgggacgcggcgagtagatgaacgtgaacgcggaagcgaatcgcgcctcctccaccacgcgcagggtttcctggaagtcctcctccgtttcgccggggaagccgacgatgatgtcggtggagatctgcgcgtccggcatggcctcgcgaatcttgcgcagaatgtcgaggaacttggcggaacggtaggagcggcgcatcgcacgaagaatcctgtcggaacccgactgcaacgggaaatgcagctggtgcatgacgttcggtgtctcggccattgctgcgatcacgtcgtcggtgaaggccgcgggatgcggcgaggtgaatcgtacgcgttccaaaccgtcaatctcgccgcacgcgcgcagcagcttggagaaggcaaaccggtcgccgatgccgtagccgaaggagttcacattctggcccagcaacgtgacttccttggcgccttcgtccacacattggcggatttcggcgaggatgtctccgggacgacggtcatgttccttgccgcgcgtggtcggcacgatgcagaaggtgcaggtgttgttgcagcctacggagatggccacccagctcgacaccttcgacgcacggtcggtaggcagttggcttgggaagtagttgagttcctcctgcaccttcacctgcgcgtggccttcgatgcgggcctggtcgagcagctgaggcagggatccgatgttcttggtaccgaacacggcgtcgacccacggggcttttttcgcgatcttctcacggtcgagctgcgccatgcagccgccgaccgcaatctgcaagttcgggcgttccctcttcaattcggcccacagtccgatggtgccgtacatgcgttcggcggcgttttcgcgcaccgcgcaggtgttcatgacgatcaggtcgatgtcatggttgagatactgttcctcggtggcgggcacgtagccgtcggcctcaagcacgccggcgatgcgttcggaatcatgcacattcatctggcatccgagcgtatgcacgtagaacacgcccttgccgcgcgtgggggtatcgttcgccgccggttcggccagtttcgaggcacgctccgcctcggtcatcatgtcttcgttcataacgcaccatgctaacggcagggcggcacaggcgtttcggaacgcgggaacgccccgttctcggcgcaatcgcagggcattgaccctcttcgatacacagcatacgttcagttttgcggaaagcgaggcggtacactgttcttccgtgatacttgacaggcaaaatcgaattaacaccaccgaattgcagatgcgtctgaagaacgtcgacgtcggcgagggatccctttcccccgaacagatcaccgagttcatcgaccagatgcaggtgtatgagggtgcgatgtacgagatcagcaccaaattggagattcttgactcggaattccaggtgcgcttctcccataatccaattcaccatatggaacgccgtctcaaatcgcttaactcgatcctcggcaagctgcagcgccgcaacctgccgttgaccgtcgacgccatcaaggacaacctgttcgacgtggcgggcgtacgcgtgatctgcaactaccgcgacgacgtgtattccgtggcgaattatctgtccgcgcaaagcgacatccaagtgctgcgtgtcaaggattacatcaagaacccgaagcagaacggttaccgttcgctgcatgtcatctacgcggtgccggtgttcctgtcatccggaccgcactacacgccggtagaggttcagctacgcaccatcgccatggattattgggcaagcctggagcatgcgctgcggtataagacggatctgccggacgcgaagcttgccgagcattcgcagacgctgttggattgcgcgcgcagcctgcagaacatcgagacgcagatgcagaacatccatcgcgacatcaacagcgccccgcgtgtgggtgaggcgccgcaggcggactgatgttttcggaaaatggcgattgacggacaaatcattgcctgtcaatcgccatttttcgacgatatcgaacgttattcgcgcttacgcagcaatcgtggtattttcaccggaacctgtgcgagcacggtgccgatgaaaatcagcgcgcagccgatgtaggctcgtgtggtcatgacttcgccgagcagcaacgcgccgcccaccgcggagaagaacgattcgagcgacatgatcacggccgcgcgcgacggcggcaccagctgctgtccgaccacctgcaacgtgtatgccacgccggccgagccgatgccggcgtacacgatgggaaaccagctttgcatggcgccggcccagtcgatggagccttcgcatagggagccgatccagctcagcagcgcggtggtggaaatttgtccgaaggacagcagaatcggatccatcttctgtccgaacgtgtcgatgacgagaatatggcctgcgaatagaaccgcagtggacaacagcaccacgtcggcaagggtgatcgagccgaatccgtcggtgatgcacagcagatagaagccgaccacggcgatggcaacgctgacgatgacgttcatggtcacgcggcggcgcagaataaggaaggcgagcagcggcgtcatgacgatgtagagcgccgtgatgaagccggaacggcctgcggaaccggaatagaggatgccgtattgttggacggtgctggcggtgaacaatacgatgccgcagatgacgctgacgaccacgggattgcccaggcatttcggcatggccacggttataccgttgccaagcgtgacggttggacactcattcgattcacggcgtcggcgttcctgttcggcgatgcctcgacggcggaaccacagcaacggtattaatgacagcgcgcccaatgtgaatcgcgtggccccgaagaacagggggctcatggaggccatgccctgcacttgggatacgaatgcgaagccccagatcatggccgtcagaacaaggcaggccatgccgccaatctctttcctctgcatgagccactaccctatggcacgtttttcgccgacagaaaagcctgaccatattctggtcaggcttttgtttgagggttcagcgcagaggacgtcgcgggatttttcagtcgcgatcgccgaagagctggagaatatacaggaacatgttgatgaagtccagatacaggttcagcgcgcagatgatggagaccttcttgaccatgtcctcaccctggcctgcgtactgggcgaacagcgcgcgagtagcttgggcgtcgtagacggtcatgccggcgaacagcacgaggccgatggcggagataaccatcagcatggtctgtccgggagcgaagatcataagcagcacttcggcgacgatcagcacgatgaggccgaccagcagaatcggaccggctttgagcatgttgaccttggtggtcatgcccagcatggtgagcgcgaagaagaagccggcgcacaacgccagggagatgccgatggtgccaagatcatacgccatgaaaatggtgcttagcgagaagcccatgatcgcggcatacacgtagaacatgacgcgtgcggtgctcggcttgatcttttcaatgcgggcgccaagatagatggcgatcacgatttcgacgacgaacggcgcccaagcgccaatgacgccaagcgactggatgagcgcgatgtaggcaccggtggcttgggtgaggatggccacagccgcggtgacgagcaggccgatggtcatctcaccgtaggcacgggtgacggaagcatgttcggcacgctcataggagtatgtcgcctgagccggaatggtggccgccggagcgccctgcgcatacatgttctgcggcgcgtactggtattggttctgaccgtacggattctggctgtactgcccgtacgaattctggttcggattgtattggttctgcccatacggctggccgttgaatccattggcgttgttgccttggggctgctgaccgaatgtcataatcgctccttaactcgattacgcatcacagtacggtacttttctgactatttcatgagagcccacgtcttacggtgccgagctgaaactaccggcaccgtatatccaatgcgcaatcagaccgtgaacttgtgcaccactttcgcgctatcgttcaggtcgaacaaatcagtgacgtcgaccgtcacttcggaatcgtctttcaaggtatatccaatcgtcacggttccggtggctccgggctggacttcggcgaaatcagaattggaatcgtatccggcagggttctcgctgtaaatggcggtgtcgagagcttgcccattttggaacacttgcgggctggcgaggattgcaaacgaattgtttttatccgtgttgttggtccattcgaatgtgaccaacaccgtgggctgattgttatagtcgttgttgctacgtaccgcggagacgattttcacatgcatggtcttcaaatcgccttccatatcctgatcgcccttcggctgattttttgcggagccttttgcggatgattgtgagcttgacacgccggtggcctcgtctatggccttgcttgctgcggactgcatggccagagtaatgacgatggccaacaccgacagcaccgcagcgacaatcgccaatgccttgccgcgttttttaccgcggaacgtgccgaccaatgccacaatcgcaagaatcacgccaatgaaaccgaaaatcgcagcaatgttgttgataatcggaatgaagctcagcacgaagccaagcgcgccgaacaccacgccgacaatgccgcacacagtcagtcccttctcttcctgatagaccggctgcagcgggggttggggttggatgggctgcagcggggcgatgtaaccactcatgatcgttccttcttctcgaatcggttgagacactttcgagggtacggaattccgcgctggaccggtattggacgaaaggtcattcccgtctgcactttggggcgtgcgaaacgcacggaagaacaatggcgtctttcggggacgggcccaataatggtaggtatgagcgagacgacgaattccccgacccccatcgaagtgccggtacgtaccagaggctggcaaagcatggtgatggtggtctgcgcgggcttcatgtgcttggcgcagaccgcgttcgccgcgcaacggttcggccaggattccgccgtatacgtatggatggtgttctgcatgctggtggcgttcgccatcgggtttctgctgctcgcccgttcccgttatccgcgtgccacattcgtcgccgcgtgtgtggtcgtgctggttttcccatacgatcccattctcgctttgatggcgttgaccgcgctattggcccgccgtaatgacatgaagaccacggttcgcgcgatcgtggcgggcggtttcgtcacgcttgccgcgcaggtacgcgacgcgttgcggccgccggaggcatccatctggcatatggtgttcgccaaaccggataccggcagccaatatggcaccgacctaatcatgcttgccgatgaccgcaccatcgtcatcaccgcgatagtggctgcattgttggagctggccatcgcgactttggcggggttgcatatccgttctcgcgccttggcatcgctggccacggccaaggcggacgcggcggacgcgcaggtggcgcagctcaagaccacgatcgacagtcagcagctggccgacgcgatcgctgccgaagcgcatgacacgcttgcccattcgctttccctgctggcgttgaatgcgagcgcgctgcaagccgagtcgaagaagctcgcggccgaagcgggaagtctggacgccggccaactggccgggcaggccagccgaatcgcggacaaaaccgaggagattcgcaaacaggcggcaggagcgttggacgaggcgcacagtgtcatcgacatgctgcgtcatccggagcaggcgaaggcgcaactggcgccgtccgatgagacgtcgttgacccgtgaatcgttggatgcgcttctcggagacgcacgtgccgccggcatgcggctcaacacatggattgacatccaacaattgggccagctcaacagggaaaccggcaaaatcgcctatcgagtccttcaggagggactgaccaacgcgagccgccatgcgccgggatccccggtatcgttggaactcaccgccaatcccaccgcaggcgtgcacgcgcatgtgtccaatccaactaatccgtccgttccggcagcatcggcggatgccacgcgtcccgccatggattccaaaaacgctttccgtaccggtgccggattgccgggattggccgagcgcgtccggcaggccggaggaacatgtcgattcggttttgacgcacgacacgcgttccatgttgatgtgcagctaccatgggttgagtgagcagcgaagagaacagcgatgacaggccgataacggttggcgtgattgatgacgatccgatgatttgccaggccatgcggctgattctcgaagattattccaccggcaggctcaatgtcgttttcacctgcaccgatggcggtcaagcggtcgacgaggccggcaggcatcatccggatgtggtgttgatggatatagccatgcccagcatggacggcatcgaggcgacacgaagactgcgcgcacttccgcagccgccgcatgtgctgatactgacgtccttgagtccgagcgggaccgtggagcgggccgtcgaggcaggcgccgagggttttgtctccaaaaccgatgcaccggaggacatcatccgccgcatcaccgatgtgtgcgacggtctgccgcaattcaatccatccagccaacggcagctcatcaacgatctgaacatgcagcaaccgcaatcgcgccgggacgaggctcgcgccatgctcgacgctctgcctgagcgggaacgcgaggcggtggttcttgcagccgacgggtacaccaataccgaaatcgcggaacgaatgttcatttcggaacgcaccgtcaaggcgcacatctcatccgcgggagacagattatgcatgggccgggtacagatggcgcgtttggttgaacgtgcggatctgccggaccaattatgaggcgaaggattctacggcagtggagactccgttacgtccatgaaacgccggtgcaccccctcccataaactagaaaacagtatgccgcacctgcggtgcaaacgttatcaatgagggatggcggtcgatatggcgatcagcgcgacggaaaaacccctgggcaaagtgttcacttccgattaccaactcaccatcccttcgttccaacgcgcgtacacgtggcaggcggagaacatcgaacagctcgtcaacgaccttcaggacgcctgcgccgacccggacacgccttacttcctcggctcgctcatcctcgtcaaggacggccccacccaataccaggtcatcgacggccaacagcgcctcatctccctgtcaatcatcgtctccgtgctgcgcgaactggaagacgaccccgacctcatcgacagcctcaacgacctcattttggaaccaggcgacaaactccgcggcatcaaagccgagccacgactcaccctgcgagaacgcgacaccgacttcttccgcatgtacgtgcaggaaggcgatttggaaggcctgttcgatctgagggacaacgacatcgcctcgcacgcgcaacgcaacatcgccgtcaacacccgccgcacattcgacctgctcgccgccatggacgccaaagaccgccgccgattcgcctcatacctggtcaacggcgtcaccctcgtcatcgtcaccaccgacgacctcgccggcgcgcaccgcatcttcgacgtgatgaacatgcgcggcgtgccactgaccgcatccgacgtgttcaaagcgaaaaccatcgcggaaatatcccccgccgcgcgtaacgcctacgccacacgatgggacgacatcatggacccgctcggcgatgactcgcacacgctcgaagagttcttctccgacctgcacctgatcgtctcgcacaaggccgtctgcacacagctgcttgaggaattccgcaaagacgtgctcaaaccatacgtgaagaaacagaacgtcatctccttcatcgacgatctgctcgccccttatgccaacgcgtggctcatcctcaaccgtccgaccgacgccaacctgccagacgacatcgtggccatgctcgtctcactcgccgactaccagaccaccgactggaaacccgtggccatgtgggcgctcgtcaactccatccgcaacctcggcagcgccaacgcacaagtgttctccacacccggaaatatcgggaacgaaaccacgaacgcgcacgacgaacgcctccaattacacgacatcgacagactccacgacgttctcgccgcactcgaacgcgtcaccggcgtcgacagcctcaaccggcaaagcccactcgcccgacgcacacgcgccgcaagcgccatccgagacctcaacaaaggccataccctccaacagatccgtggattcctcatcaccgacgaggaccgacgttccgcactcgcgcatctacgtggcgagttgcagaccagtcccgccatgaagaaacttctgctcatccgcgccaacgagcagaaggccggctaccgcatcacccgaccgcgcagtctcaaagcgttgccgatcatgcccgaacaggtcagcgcgaaatccgatttcgccgcttggccggagtcggtgcgtgaccattgggcaaaccgcatcggcaatttggtgcttagtcaggccaacgaaacccaagtcgcgccactcgccacgtatgcgcagcggcgcgaccgcatgctgttgtcggcaagctccagacgttttccactgacagccgaactcgccaatatcgccgaatgcacaccacagacgctgcaataccggcaggatgagatggttcggctcatcgccgaccattggaatattcgttacgatgccgacgatacggatttgtcgacgttgaacgaggagacgctcaatgtgaaagctacggcctcctctcccacgtccaaacgcgtcagcattgcccaagtgctggaagccgggctgcttatcgccggagagaccttggtatgggagcgtccccgcaagggcgaacgttgggtagcgaccgtcacttccgaagacaagctgcgcatggatgacggcagggagtatgccacgcctactgccgcggcgcgtgccgttggcggctcatcagcgggtcttaccgtgtggaaacgcacgtcgaatggccagaaactgagtgacgtttggaaggcgtatcgtctgcgcaagcactgaggacgccgaacgaccagatggtcagtctcaaccagccggattcaatcaaccggattcagccggtcaatgccaggccagccattcgacggcgagtttggtgcgattggagatgttggttttggcaagtatgtcgctgatgcggttgcggaccgtgccttcgctgagaaacagccgtgacgcgatctcacgattgtccaatccctcggccacaagttccagcacgtccaattcgcgttcggtaaggccggcgaaacgttcggatggtccgctggaatcggggttccgagatccttgaactgcctgcgcatcatcatgcgacacaacgcgatcgactgatgaggattcgtctgatgtcgtggattgcggactgacccgcagcttgctcaacacttcggcgcccatgaccacttgtccggccatgacggcttgcaccgcgggtatgacggacgaaacgtcctgtttgatcaagtagcctttcgtgcctatttccaacgctttggcgatgtatgactcgtcggcgaatgtggtgaggataaggattcgcgcgttcggatgcgcgtcaagaatcgcctccgacgcttgcaatccatccattcccggcatctgcacgtcgaccagcaacacatcgggggcatccatctcatattgggtcaccgcatccgtgccggtgttggcggtccatgccacatcggcggtgccggtggcttcgagaatcgtggataatgacgagcagacgattggatcatcgtctgcgatcgcgacatgcattaatgcgctcctttctccggttgcgtcatttccgagccactcgccggcttggggatggatacgaacacgcgccaaccctcgtgatacggcccgcaaatcgcggagcctcccaacgcacgagcccgttcctcaatgtccgaaatgccgatgcctgtggaatcgtccggtcgaatgaactgcatggcgacggcttcagcagacgatcttctcacggttccatcatcctgcacgcacagctgccacaatgcggggaaatcgcgcagggtgattgaaacgttccttgcctgactgtgtttgaccgtattgttcaacgcctcgcgaatcgcagtggcgaagcagcgggacacggccgccggcgctgaatcgatgccgttgaccagcctcacccgcaaggggccggcgccgtccatgctgtgcgcggccgtctcaatctgcgaagcgaaatccgtaccttcgtctttcaaatcatgcacggctttgcgcaccaaagtcatagcctcgctcaccgtgtcatgaatttcacagaaacgttgggccgattgttcctgtccggcaacctgggccaccacgtgcgccgcctcggtctgcatgatggctcgggtcagcatgtggccgacattgtcatggatctcacgtgcgatgcgcgtgcgttcggcaagcgtcgccgtgcgtacggccaacgcacgatcctcgtcgttttcggcgatctgcgagcgcaggcggcgaatctggtcgcggcgggaatcctgcaatcgccgcacttcgcgggcgaggttcgcgcagcgcgtgcaaagcagaccggcagcgaatcccagaaccgtttggagcaccatcaatatgatgatggacaagtcggatggaacgtgcgagccaatcgaacggaaaatcactatcgtcatgggaagaagccacagccatcgcggcaccaacgcttgcaagaagcggctgccatcgacaccagcggacgatgatgccgcgttgaatgctgcgatgggaagcatcagataccacgccggcaccaggcatgcgccgcagtcaagcatgacaatcaacgccatcgcaagccacgaacccgacgcgtattcccccaccgcggcacaacacaccgccacaagcgcgccgcacatcaggtcgaggccgacgtctccggatgcgtatacgcccatgatcatgcccgtggccaggaacacggcttggaacagcaaccgtttcatgccgcctcccgtccgccgattcgtgtctgattggttcgcttgcttccagagtaatgcacatggcgcatggcacagccggcggcatcaacgaaggtgacatttgtcatgttcgaaagtgacatcattccggcaattgtgactacgcgcaccatgtcgggggcatccggcggcacgacaatggaatcagaggcatggagcacgagaaaggagctcgtcatgggtggacgcatgaatgacgctgccgatgcggtcagcgcggtcaaggtctcgaaactggtgaaacgttacggagacatgctggcgctcgactatttcgatctcgacgtgcatcagggggaaatcttcggcctgctggggcctaacggctcaggcaagaccacggcgatcaactgcatacttgcgttgctcacgttcgatgagggcactgtgcgcgtgttcggcgagccgatcagccctaccagctatgcgttgaagcggcgtatcggcattgtgccgcagaacgtggccgtgttcaacgaattgaccgttgaggagaacatcgattatttctgctcgctgtatgtttccgacaaggcaaaacgtcgcatgctcgtggacgaggcgttggatttcgtaggattgcgcgattaccgtacctatcgtccggcgaaactgtccggcggtctgctgcgtcgtcttaatatcgcctgcggcatcgcccacaagccggatctgatctttttcgacgagccgaccgtggccgtcgatccacaaagccgcaatgcgattctcgaaggtatccaacgacttaaccgcgaaggcgcgacggtgatctacaccagccattacatggaggaggtcgagcagatctgcgaccgcatcctcatcatggatcatggccggcatctggctcttggcaccgcggaggaacttaaggcgatgatcagcaccggcgaacgcatcagcatcgaaaccgatgatctgggagggcgctcagattcggccgatacgacgcttgcgcgattgcgcgcattgccgttcgtgaccaacgccgactatgacggccatgagctgacggtgaactgccgccagggcgatcacaatctcatcgacgtactgcagctgttggagcacgagggcacgaatatcgggcatctctccagtcgccagccgacgctcaatgatgtgttcctggaactgaccggcaccgcgttacgcgactgacttggcttgcaaggcttgtggcaaatcgaaaggcatgtgacatcatgtggcagacgttactgatcaatctcaaactgcatttgcgggagaaaacgcaactgttctggctgttcgccttccccatcatcctggccaccatgttcaacggcatgttcggcaacatcgcggaaagtttcgaattgcacacacttgacgtggccgtggtcgaggacaacgcgtggaagacgtcctatggggcgcagacgctgatcgaaggcatttcatccgaatcgtctgcattatcggacaatcacgtgaaagtgagtgccgatggcaagaatggaacgggactcatcaacacgaccaaggtggaatcgattgcgcaggcggaacagctgctggccgacggcaccgcgcaaggcatgctgcgaatcgatgacggcagattgcgattctccgtctcacagtcgacgcaatcgtccgcgtccgatgtgatggcgtcgagcagcggcttggatatttcgctgacggtgctgggcaacatcgtggacctgtacaaccgcaacaccgatgtggtggtggacattgcgaagcacaaccccgaagctctgatgaatggcaaggtgaccggcagcatcggttcggcgaatggctatacaaaggaaatccagctgacgaattttaaaccgagcggtacggcacgatattactatgcactgctgggattggccgcgttgatggccatgagcttcgccatcaacgtagtgacgatgacgcaggcgaatctttcggctttgggtgtccgccgttccgtttcgccgcttccgaaatcgcagcaactgctggctggattcctgtccagttggctgtgttcgttcctgagtctgaccgtggccatgctgtatatccggttcgtctgtcatatttcgttgggcggacgtgaatgggctggtgtgggagcatgtctcatggcttcgttcgcggcgagcgcattcggcacgttgcttggcgcgctgccgaagattccaaccggcgccaagcaggggctgtgcacggcgatcgcctgcacgttgtcattgttctccggactgtacggttcgttcgccatgcagttgagcgacttgatcgcccagcgcacaccggtgctgagtctgctcaatccggcgcagcagatcacgaacctgttctacgacatcctctattacgacaatttcaaaccattcttcaccaccgccggcatccttgccgcgatgagcctggtctgccttgctgcggcgaccgttctgttgaggaggcaacgctatgaatacctgtaagacggcgctgagaattctcaaatcgcgcaagatgtacctggtcatctatttggggttcatcggcatcatgatgttcgccatcagctggcagatcatgcgtggctcgatgacgggtggcgatgaggtgttccatcccgatacggcacgtgtggcggtgatcgaccgtgatggcgatgccgatggtatttcatccgcgctgcgttcctatcttgcgttggatggcgagatggtggaccttgccgacgattccgaggcgttgcagcaggccgtcgcttcgaactatgttgatttgatcgcaattgtgccgcacggcttcgcttcggattatcagaaatatctggatggttcgtcaaatgaccaaccgactgtcgaaaccgttgtcagctacacttccggagcaggctccctttcgcagctggaagtcaacgaattcctgtcattgacacgcaccgcgtacttgggtcaagccgggaagcaacagtcgatggaaacggccatgcggacggcgttggataccgcgaaagcagatgccaagacgtcgaaaatagcggtggtgcaatcgccatccgcagatactgataataccaagccggcggcatccgcattcgccggcaccatcaaaacgggactctatccgttgctgctggtcatgccgatctgcacgttcctggtgattggcaccttcaatgacagtgagattcgtcgccgcctgtattcgtcgccgacgcgtctggtgtcgttgcagatgcaggagatgctcacctgcgccaccttcggcttggtggtgtgcgtgggttacacggcggcgacattggtcttgatggtggccgcaggagtgccgttcgacgggattacatccacgaatgtggctttgacgttcgtgtcgctgctggcgtacacgttgatggcaatcgcctgcggtttccttctggggtcggttggtttctcggaaatggcggtcaatgcgttcgccaacgtattcggtctgctgtgcatgttcacgtcgggtatggcattccccatcgatatgatgcccgaaccgatgatcatgatcggcaagctgctgccgggatggtggctgtgcgtgtccatcgacaacgtgttcgggcttggcacggcggccgcaaccggtgtggattatggttcttgggcatcgtcggtcggcttggtggcattgtttgcagtggcgttcatctgccttggtctggcattggggcgtatccgtcgcacacgcccgtccttggcctcccccaccaccacgcagttggccaagtaaatcaccaagtgttccgttccatcggccgagtcccgatggaacggaacatccgcctttgccgtaggctctcaatcaaatcggatggaaccggacgaaatcggactaggctgaaagcatgatcgaccacattacacttcatgtttcgaacgcggaacgcagcatcgcattctatacgaaagctctgtctccgctcggatacattccaaaagcccatcacgaaccgaccatcggtttcggcgtggatgacggcacgccccgttcggatttctacatctccccgatggacgatccgacgcaacagccgattcccacgcatatcgccttccgtgcaacgaacgaacaagcggtacgcgacttttatgaagccgcgatcacggcaggcggaatggataacggcagacccggaccacgtgcctaccattccgggtattacgcggccttcgtgctcgaccccgacggcaataacatcgaagctgtcacagactggtcgcacacaagccaatcatgaaatcggccgccgaatcgcaaaaagtcatcgggtgacattgcgcagccaacggtacttgcggtagtgcaacaacgcgggaaccattttgatgcattcgtcggtgttgagcagcgcatacaccaccaacacgggcagtttgaacacgaacgcggccaacagcccgaccggcaccacaatcagccacatgacgatggcatcgcacatgagaccgaacttcgcatcgccgccggctggaaaaataccggcgatcgtcagattcgtcatgcatccgcatgccgcgtaatatgcgcagacgaacagcatgaccgacaggtaccgtgtggcttcgggcgtaaggttcgcccattgcaaagccagcggacgcgccgcgacaatcaacagtcccgtcgcggtaccgaccacggccaccagcacgcacatcctgtcgcccatcgccttcgcctgtcggaaatctccacgtcccagcagattgccgaccaaaatgccgccggcattgcccagaccaagggacaggcacaccagcagatccttgacgatattggcgatggaattggcggcgactgcgtccgcacccaaatgtcccatgatcacggtgtacatggtgaaaccacatccccacaccaattcattgccaagcaccggcaggctgtatttccagaaatccttctgcaacggcccatcgggatgcagcacatggccaagtcgcaggtgggggccacgacgggtcgccacgaccgaccatgccagctcaatcgcacgcgaaatcaccgtggatatagccgcgccgaaaatgccaagcgcgggaatgccgagactgccgataccgtaaatcagcgccgcgttcaacacgacgtgcacgatcacgccaaccgtgctgaccgtcatgcccatcaccgcggagccggtgttcttcatcagacacaggtacatctgggacaggccgatgaacaagtacgacaatgacgaaatccgcagatatcgcgcgccaagcatgatcagcgtgccgtcattggtcatgatggacatcaactgttccggcacgagcagtgccgccaggaagaacgccgtcgacagcattccggcatacagcatgacgaatcccagcacgcgttccaccgcgtcacggttgccggcaccccaatactgcgccacgagaatgctcatgcccagggtcagggccgcagtgaacaggctgaacaggaactggaactgcgtggcgagcgagacggcggccaactcgttttgccctacccccgacaacatcagcgtgtcggcgcaggacgacaacgacagcatgagctgttggaaagcgataggcaaagccaatttgaatacatggccgaggaattcccggtccggcatgatggtgcgcacgatagtctccattggaatacaagcccgtttcagacgacgggcaaacgaaaacgccgggatatgtaggccgaccagccttatcccgacgttgggccgaatattgggcgaggttttacagcgaatccttccatgcgcggtattcggcggccttgccctcccagtattcacggtccgcatcagtgatcttgcgaatcacatggcacgggttgcccacggccaccgaatgggatgggatatccttggtcaccacggagcctgcaccgatcaccacatcatcgccgatggtaacgcccggacagaccaccacgctgccgccgaaccacacgtcattgccgatggtgatcggacgggcgccttccggaccggaagcgcgtacggccgcatcgattggatggtatggcgtgtacaggccgacgcgcgggccgaagaagacacggtcgccgatggtgattctcgccacgtcgaggaagatgcagtccatattggcatagaagttgtcgccgatatacgtgttgcagccgtaatcgcagttgaatggcggttcaaggaacgcgcctttgccgagtgaaccgaacagttcgcggaacagcctgtcacgttcctcgaacgcgtcgtatgcggacgtgttgatggcgtgcaccaagcggcgtttacgcatgttcgcttcacgctgcatatcaccgcaaatatacaattcgccggaaagcatgcgttcccactcgttcgtaggcaccgccacattatccacggcaacggccgcaccttcattctccgccattgaaagctccttgtgaatctgtttgtcaatcgtttgacgtcctttgacaccattcaacaccaccaacatcgacggcagcactcgcaatgttgtagaatcatccttgttctttgcattatctaccgtttattagagtagtcatgaacactgccgatgaagacgcacagatggaacgggacgaatgggcctcccgtgaggtgatgcccatcaccaattggggtcgccgacccgatggttcggagatagtgcagtatgacgcgccgatgttcttctccttcaccgagcattcgctgctccaccagtacccccatatgcgtgcggaatgccattggcatgtcgaccttgaactcacctacatcatccatgggcatatgtggtatttcgtcaacggagaaacagtccggctcgatgaggggcaggcgattttcgtcaactcacgtcagctgcattacggtttcaccaaggacggttccgattgcgaattctcctgcacgttgctcaatccggctaaaatgtgcgcctcattcgaagtgtacgaccgcttcatcgcgccgttgatggcggagaacacgatgccatatgccgtcatcaccgacgacacggcccccggtcggcggctgctcgccaccatccgacagcttcatgcggcgaaattcggtccgctggagcggtcagagcggtcagccgaaccgttgcccgccgacgatatgacgctaaccgacgataccgaggcgttgacggtgctcagctgtttctatgcggtcgtccgcgacatactggcgatcgccggcagtcattgcgcgacttccacagcgccgcacccccgcatcgtgacgctacgcaagatgatcgattacgtgcagagatattacgtgcgtccgatcaccttgaagcaaatcgcatcggccggatcggtgggacgcaccacttgcgcatcgatattccgcgaatcgctcaaccagtcgccgatcgaattcgtcaacgacgtgcgcgtgcgcgccgcagccaacctgctggtaacgagctcgctgcctatcgccacggtcgccaaacagaccggtttctcatccgccagtttcttctcccgcaccttccaccggttcatgggcgtcacccccatcacgtaccgaaccacgcataccaagcggaaatccgaggaataaaaacaatcggctgcatgccccacgccgtcacgcataaggacacgcagccgattgcgtcacatcaagccggaaaggacacgttcacttcctcttcagtccgcgggcgatggaggcgttgcgcacctcgaccgtgccgtcggtggcgaagacgcccaacgactcgcccggacgctcgtacatgcgcacgttcaacgccaccccatccacgtacaacgtgccgatggtgtcgtcgacgacgagacggatgtggtacgtatgccccgcctcgaggccgatgttcatgacgtggattggcaacggtgtgttggacggtttcttagaggacgagtccctgttcggtgaattccttcggactccggtatccaagggtggagtggagccgctggttgtcggaccaccacacgtagtcgtcggggtcatgcctcagctgctcgatcgtggtgtagtggttccggtacacgagctccttcttcagcagcctgttcgtcgattcgaccacggcgttgtcgtaggggttgcccttgcgcgacagcgatcttttgatgtcgaacacgtcgagcagctcgtcgatcctcgtgttgtcgaactcgccgccccggtcggtgtggaacacctggacgtccgtcagcgggaagtcgagggtggcgaacgcgcccaataccaggctcgcgtcccgggtccgcccggcggaatggccgacgatgcccctgttcgccaggtcgaccagcagacacacgtacgcccagtctccgccgacgcggacataggtaagatcgctcgccggatgcgtgtgcggggcgtagccgtcgaacccgcggtccagcaggttcgcgagcctggcctcgtcggcccgcgtcctgtgcggttcggaccgtccgcgcgcgtacgcgctcgcattgctgggggaggggctttttcttgttattcggcgtgtttgcgtggccttcctccgccgacaccgcggccggggcgttgtgcgttccattggtcgatggtgtcctcgcgccagcctctggccttgccgacaaccacgtccgggtcgggcagcctgtagcgtgccagtgcgcctttggtgattccgaggcgttcggccacctcggtcatgctcagatagcgttcagtcatccttgccgccccgtctgtccatggcgagcgtggcaaggctccagatgccggccgcgagtccgaacagtccggcctgccatggttttccagcgaagccgagcatggccgacagcaggccgcatgtgatgccgcagacggcgaatatggtgcttgttttcatgatggccatgaaataggatggaaccggggttccgggcactaggtctgctcggaaccctttcgtcatctcttatggcgtggtcggcgccgtatcgagatgatgagcgccgccagtgcgatgatgttgctcaccaccgagctgatggcggtcacgatgtccgtccatttcatgctcacctcctttccgttgacataactattataacaaagtatgtaaagtattgcaagccgaaacacaaaaaacagagaaaaaatcaacggattgatagacttgatgccacgcaaacgaaggggcgagcatggcctacacaatcagacaatacgccaccaaagacggaaaaagatacgaggtgcgctaccgtaagccggacggttcgtccaccggaaggcgtggcttcaagcgcaagatggacgccgacgcgtggggcgccgccaatgtcaccacggcgaaaaacgtcggagcatacatcgacccgcaagccgggcgcaggctcgtggaggacttctgggagccgtggctggccgccaagaagaccaaggcgaagccaagctacatcaagtcgctggaagacgcttggcgagtgcatgtggagccgcagtggggcatgagggagatgcagtcaatcacgcgcgacgaagtgcagcggtgggtcaccgatctggcaggacgacgcagtgcgtcggtgacgattcgcgccgagaatctgcttcgcagcctcatggagagggcaaaggccgatcggtgcatccacgacaatccatgcgacggcatcgagctgccgcgcaagcaggtgcggaagcacgtctatctctcggctgacgaattgtctcgtgtggcgatgcagtgcgggtggcgtgagccgatcgtgctgaccttgggcctgtgcggcatgaggtggggtgagcttgtggcgctccgtgtcgaggatgtcgatctgcaacgctgtcggctgcatatatataggagcatcacgcgtctttccagcaggatggtggagaccgacccgaaaacccatgatggacgctcggtgatgttccccctggtgttgcgtccgctgctcgccaagcaatgcgaggggcgcgagccgtccgattttcttttcaccgctcccggcgagcctctggacgagccgatgggcaacggctggaatccgacgcggcacgatgggtggttcgcggtggcgcttcgccgcgcgggcgtggggcgtggccacatgacgattcacgatctgcggcataccgccgcttcgctcatggtgcagtccggcgctaatgtcaagaccgtgcaaaggcaattggggcacaagtccgccgccatgacgctcgacgtgtatgccgaccttttcgacgatgatctggacgatttgtcggagagaatgggcggtttgctcttttcgcagaatgtgggcaaaatgtgggcaaaagcgacgcaaggcattgatggaaccgttgaaacggcaagtgtttgaagcttttctcctgtgggttcgagtcccgctggaggcacttttggaaaccgccagagatggcggttttcctttattctccaacggttttggcatcatcgcgattcactgcgattcaacccttttccacggtgggttatggaaaaatgtgggcaatgtgtaggcaaaatgtggcatatcgttcccgaaacattccgtaggtacactgtcggacattacaaaccgtatgacaccgactgaaacggatgacgcatgacttcgaaagacatcaagcctgtaatcgaacagctcgccactgaaatccccctgatgcttgcgcaggtgattatcgttgccggcgtgctcgctatcggcgaaatcgcatgttctccgctgtactttaccttgatggaccattcgttggcactcgttccgtgggcattggaagccgcattccttgccgtggcgttcaccttcgttgtgggcttcgcattgttgtggtgcgccgaatcgttcactttcaaactcaaggaacgattccgcccgttcggctatgcggcggtaggattgattggatacggcgtatggagcctgctggtgttcaccgccaccatcaattcgatactcgccaaggtcggggaaagcgttcttaccaacggccaggtcggcgcgatcgcgctgaacggagcagccttgggcttcgtcgctttccttttcgcaaaactgctcgacgtcaaactcggcaatcgcaaaaccgttgcgataattctgcttatcgcggaaatcgtcattgccatcatcggcctactcatcatgattcgcatgttcagcgtgctttacgcggcgtgacggcgaagacgcggaaaagagagcgcaatatacatgttcagcattctggagatgttcaccatcggcgtcggccccagctcgtcgcacaccgtagggccgatggtcgcggccagcagattcgctgcctcccttgaacgtgacggcatactgaaccgggtcggccgcgtgcgaacggtactgtatggttcgctcgccctgaccggtcttgggcacggtaccgatcgcgccacggtggcgggcttggaaggcaacgtaccgaaaaccgtcgataccgatcacatgagcaatatccgtatggaatgcgaggcaggcggcgagctgatgctcaacggcacgcatcgcatcgatttcgattacggacgcgatgtggtgatggatgtatggcaccgcatggcggcccatcccaacggcatgcgattccaagccttcgaccggcagaacaatctcatcgatgaacaggtctggtattccattggcggtggattcgtcagacaaggcgacgccgacgacctgatgatcggcatccatgagaaaccccctgcgggaacggccttcgccgatcagaccgacgattcctcaaccgatatcgatatggacatgccctatccgttcaccacatgcgacgaactgatctcgctgtgcgatgaacgtcacatgagtgtggccgatgtggtgtgggccaatgagacggccatgcggtccgccgtgcaggtgcgcagcgatttggacactgtatggcatgtgatgcgccgctgcgtgcagcacggttgcaataccaaccaaaccgttctgcctggcggccttgacgtgccccgcagggcgccaaaaatgtatgcaaggctcgcatccaacagcgacgtgctcaaacgggacggcaggcgctccgacgccgtactcgaatcatcggacgccgcatgggtcgacctgttcgcattggcggtttccgaggagaacgcggcaggcggacgcatcgtcaccgcgcctaccaacggtgcggctggcgtcattccggcggtgctccactattattggcatttcgtggatcatgcggatgaggatggtgtggtgacgttcctgctgaccgcaggggcgattggatacttgttcaaacgcaacgcgtccatttccggtgccgaagtcggatgtcaaggcgaggtcggcacagcctgttccatggccgcggcggggctgtgcgccgtgatgggcggcacgcctcaccaagtggagaatgccgcggaaatcggtatcgagcacaatctgggactgacctgcgatccggtcggtggtctggtgcagattccctgcatcgaacgcaacgccatggcggccaataccgccatcaacgcggtccgtatggccatgctgggcgacggcacgcatatcgtgagtcttgaccaagccatcaaaaccatgaaggacaccggcgaggacatgatggccaagtacaaggagacgtcgaaaggcggtcttgcggtcaatgttgttgaatgctagcgatggatggtgctaatcttggtgacactgtgttttttcaaggaggttcaccatggcatctgaaatgcctgttgtcaatgccgaattcggcgatcgcccgaccatcgaattcccgactgagatcgctcccgccggcctgaaggtcgtggagctctttgaaggcaatggcccgatggtccgccgtggagacaccgtcaccgtcaactaccatggtgtggtctggggcaaggacaccccgttcgactccagcttcgaccgtcaccagccggccacgttcggcatcggtgtgggacaggtcatcaagggctgggatcagaccgttccgggacacaacgtcggttcccgcctggtggtgtccattccgccggagtacggttatggctcccgtggtgttccgcaggccggcatcggcggcgaggacacgctggtgttcgtgatcgacatcatctccacccgctgattgacgggtatcattcttccaaggtcaaggaggataacatggccgaagaaaagacgatcctgctgacgcaggaggcgtacgacaagatgaaagaagaactcgcctggcgtgagggcgagtaccgtgacgagattctgtccaaggtctccgcggcgcgtgccgaaggcgatttgagcgagaacggcggctatcaggctgcccgtgaggcgcagcgcgtgaatcagggacgcatcgacgaactgaccgtcaaactgcgcaatgcgaagattctgactgcgcccaaggccggtgaggtcggtgacggatccctagtgacccttgaagtcaacggacgtgaaatggtgtacgtgcttggcacgcgagacctgtccatcgccacggattacagcatcatcagtcctgaatcgccgattggcgccgccatcaatggcgctcatgccggagatacggtgacctataccgctccgaacggccgtgagatttccgtgaccatcaaggaagccaagccgctcgcctgacatacgtgtgacgaaaacaacagcccgttcctccatcgcattcgtacgatgaggggacgggcttattttgttttgtccatgtggggttgattacgccttagggccacaattgcacgatcaccatgtagatggccaccatgtggcaggcgtatcccgccacggttccggtatggaagatctcatggaagccgaacaccttcggccaggggtcgggcttgcgcagcgcatacacgatggctccggcgatatagcaggcgccgccggcacacagcagtatcaccacggtaggtccggcatagggggacatccagaacaatcccatgaacgcgacgccggacacgccgaaaataatatagacaagaacataaagccagcgaggcgcgctgatccagatgacatggatgatgagcgccaccgtggtgcagatccacatgcccgcgatgatggaatcacgccagaatggcgtgagcgcgaaggaaacgggcgtataagtgccggcgatcagcaaaaagatgttcatatggtcgatgcgacggagcacatcggtaacccgtggtgaccaatctcccagatgataacaggcggaattgccgaacagtaccagcgagcaggtcatgaacacggcgcacgcccatttgagcccggtgccatgagcgaggcagatcagcacgatgcccgcggcaagagccaggggagtggcgatggcgtggatccagccacgcaggagcggctttggcctgccatgcacgtcgagtctgattttgcgttcgatttcggcggggacgatgccttcgatttttgcggcatgggcttcgcctttggcgatggcacgtttggcttttgcatccgccttgcgtcgaatgttctcggccttattgtgcgccttcacgcgaatggtctcagctttcgcctgcagggcctgctcgcgtgcttcggcgatgaccgcgcgtttcgcctcgatttctgcgtttgtaggtttcgccatcggatgcctccactataagttacggaaccgtaacctacgttagcgtaaccgtcggatatgtcaatcggcgtttccgcattatacgtgggcatatggtatgcaacctcgccattgatgcgtattatggttgcatggctgatttctcacatatcctgatgacccgtccggatttcggtgacgacgatcgtgaatggttgcaccagttggtggccgattggcaggtgattgccgatttgagtttcgccgacttgctgctaatcctgcagaacggcgagggcaagtacatcattgccgagcaatgccgtccgtccacggtgatgagtctgagagccgaggatgtggtcggcaacgtcgtcccggaatccctgtgcgccgagcttgacgcggccatggactccgaatcggtgttccgctcctcgaaactgcgtacggtcggcaaggccaaggtctgcaacgtgtacgccccggtgcgtcataatggcaagacgcttggcttggtggtccgcgagaccaacatggccacacgcgaatcgaacggccgttatgagtccgaaagcatcagcgccggcaaacagctgtatgagatgattccgcgcggccagttcccgtaccgtaacccggttatgaaccagcgccataacgcacgtgtggcggatggcttcatcgtgctcaccgtcgacggcatcgtccgatacgcgtctccgaacgccatcagctgtttccgtcgtttgggatcggtcagcaccatgcagggggagtatctgagcgagatcggcaccaaactgctgcatgagaacgatccggtgctggaaacgctgccattggtactgagcggcaaagccgcggtggattccgaattggacgccaacaaagccgcggtgtccatgcgctctctgccgttgatggacgccaatggtcgcgtgggtggtatcgtgctgtgccgtgacgtcagcgaattgcgccgccgcgagaaggaattgcagaccaaggacgccaccatttccgagattcaccatcgtgtgaagaacaatcttcaggcggtatccgcgttgctgcgcttgcaggcgcgcaagaccaagtccgaagaggtcaaaaaggagctcaaggaagcacagcgccgcgtgcagaccatcgccatggtgcatgagggattgagccagaccgccgatgagatcgtcgactatgacaaggtcatttccaacctgcttaagatggccgtcgatttggctacgatgcgcgaccagcacatcgatgtcgatttcgtaggcaaattcggcatgatgccggcacaggatgccacgccgctatcgttggtgcttaccgaactgatcaccaattcggtggaacacggtttcgaaggacgtaaggaaggacatatcacgatttccgtgggccgcggtggcaataacctcaacgtggtggtggaggatgatggcaccggcttggcggatgaggagcatgatggcatggctcgctcttccggatcagggcttggaacacagatcatcaacacgttcgtcaccaatgattttggcggaacggtgcattgggagccacgtcgcggtggtggtacccgtgtggtgctcgacatgaaactgcgtgccgcgcaagataactgacctctagaactggaatggcatatggaagggccggtcggattccatcgaatccgaccggcccttccatatgccctgaaaagaatcagacctgcatctgcatggcctgcgagcgacgtgcacgcatcgcgcgccgcttgagcgcgcgccgctcgtcttcgctcagaccgccccaaacgccgtagtcctgattggtgtcgagcgcgcatttcagacacgcgtcaatcaccttgcaggtacggcaaacggccttggcttcttcgatttgctgataggcggcaccggtgttgccgaccgggaaaaacagttccggatccttatcccggcacgcggccttggctcgccaatcgaaagcactgctcatgtaatcgccttcctcttgccataagtggcgttctatccgttatttagataaccacgaatcggatgatttttcaagactttttcgcaaaagaagccaggtttttttagaatccttggaattccgcgcattgcacgggacatgcccgtgcttgttggatgaagaccccacgcccggcaatggcatagtcatcgacgccgaaaccgtcgagaaccgcgctgggaatccccatcatcacatcggtggctctttctccgcaaggaaacgcaacacgtgtgaggcaacgttcaagtagggtgctttgcggcttttccacagctgcgattaccgtgacggacggatcggcgagtgcggtcttgagcttatcggcttcgggcatggctgcgaaaggggagagcaattcgtcggcgtcatccacgaaccatatggtgcgttcgtgctgcggcgatgttctgccgtcgtcggtggtccattcgctgttcgtcttgcgtgtgaaccggatggtgcagcgaccggattcatagagacggctggcgcagcagagcagcagattggttttgccgcttccgcatgcgccaatcacggcgatgttgccgtgtcctacgtcaaggaatgcggtggagatgagtacaccgtcgtcgctcaaagcaaaaggcacatggtgccatgcctctcgctgtggcgccgtcaaatcgtctttgcctgcatgtggtgcgagcggcgcggagaacaaaggggagggattggtggtgccgctgaatgccgatgcggtgttgatggcatgcaccaaggaatcaatgtcatggaccgcgctgcagcggaaaggaacagtgcgttgaccgtcatgacagtaagcggcaccggggaaggccggtggaatcaaagctgcatccttggtgccgatcagttcattcgattgcatttggtcggtgacgcgtaggcagatgctcagcgatatgttggccttcatatcggcatggacctgacccatgggattttgcgtgcatacgatgagatgcatacccaaagagcgtccgagcgacgccaatcgattgagtcgctgcatatagtcgggtagacggtcgcgcaatgcatggaattcgtcaatgaccaccacgagccgtgcagggggatgggaaagctggtcgaatctggaaacgcgttcggcacttaccaaggcctccctgcgtgccaattcttgttctatggcgttcagcgcacggacggcatgggcgaggtcaagatcgcagacgttgcccacggtatgcggcagacgctccaaagcgttgaaggtcgatcctcctttgaaatccagaaagacgaaatggagggtttgaggactatgccgaatcgccaatgccatgcaccaactgatcagcagttcggatttccccgagcctgtggtccccgcgaccatggcatgtggtccggatgatgccagatctatatggaatatgccatgttctgacatgccgatgccgttcgttggggaacggacaagccaattacgcacgatggtgcgccatatgagcgggtcgttgtccaggccatgcagatgctcaaaacttatggacggcatgtcggcgaaaagctgagcatggtcgatttcgtttccgttatgatgcgttggaaccggcgaatcgcttccagtaatggtgttgctgttcgtttcttcatgcctgacgcgcatgatcatggtgatgagcatcaatgcgctgccgagcagactcggagcgagcatcgccgcatagagccaatgacgttgcatacacatgacaatcagcatgatgagctgcgccagcaaaggcgcgctccaactcaatacagtgagatgttgttcgcttatacggtgaggggcctttttgttcatacggccagcatgggcaagagcggcggcatgccgcaagccaatatgagggttgtggtcggaggatgtgggttatccacatcctccggcgtgtcgtcagttttgctgttcggccagcgtgcccacggttcctgcggaatgcgtgccgtgtgagagttcggagaaaagctggatgttcttcgcgtcattcagcagaacgcacgatccgaccccatcgacgtaatagtccggatcggtccaatacacgcttcccgaaatgccatccttgcctgaggcgcttttgaaagccaacgccatccgaagcagagaggaagtcgatgctttctcatccacggttacggagctcaacgccgctgcggcgacctttttggtcttgttgaaattcgtgagcgtctgtttggaagcgcccttcttgacgatggcgttgatcacctggcgctgacgtgcggcacggccgaaatcgccttgcacatcggcatatcgcatacgggagaacgccaaagcggtgttgccgtccacggtgtggcatccggcggtccagttcatacccgaataagggtcattcacattctggtcgtagcataggtccacgcctcccaaggcatcgaccactttgacgagtccgccgaagcggaccattgccacatggttgattttctggccggtgatgtcctccacctcgttgaccaactgtttgcggctgtacagctgcgccacggcgttgatcttcatatagctcccatcgatttccaccagggaatcgcgaggaatggaaatcagcgaggacgatcctgtcttcggcttggtgagtacaagaatggtgtcggttctgaaaccttcgacgtcgccggcgtctccgatggtgccctcacgttcgtcggagccaagaataagccagctttcgccggcggtgtccgctttggatgtcagccaggtctgtttgttgagctggtcatcgacccagttccaagcggagaatacccctattcccagtgcgagaatcagtacaaggaaaatggaaaggacgatacgtccgacgcgaggtcttctttttggcacggaagccgtcgctggagaggatggaacagatcggagcgccgtggagacggaggatgacccccggaactgctgcgttggattggccgtgcgggtatgttctggagcgaaggacaccggagatgatgaagggtttcttcttgtctcgctcgttgcccgtgctgcaggctggaagctttgcggaaccgaggaagaaggacgcgccgtgcgtttggccggttttacggatgatgcatggtcagaacgtttcgccggtgcgaaactcgctggctggctcggtgcgctttgcgagcgggaggaatccgtggacggcatggtttttttgcgtcctgatgacggaatgaaacttggtggcacgctcgtaggctcttttgctcctttgccttcactcatggttcctccaaaaagattcgtccctgcgtcatacgttgaaaggggacgtgattgcgtggtctacgtcagttctttgccggaacggcacatacggtcgcattaaggtatcgatccgcaaggccgatatactggcccgtggtcgcgtcatgaatggagccgtcatccgggtcgacggtgccgccagtgcttggatcgaccaacgtgccgtcggatttggtgatcagtcccgtgacgggatcgggagtctcggcagtggtgtccgactggttgctgtcggtcgtgccggaatcgtcggagctggctgaattatctgaactggtgtcggaggagtcgcccgagtttgaatcggcggtatcgaaaatcggcttgcccgctcgcatcttctcccagagattgtcggcttcgtcggtccagacggaacggttggggtcggacggtgctgggaccacggggacggtctgggtctgcaggttggtcatggtgaaattcttcaggctcatggcaagtcccgccaaagccgcggtatcagccatgccttgggatatgttgagcgatttcagcgcggatttcgccagctggtacagctgcgcggtatcagtgaacagattcttgctgagcgcctcgctcatcagctgcttgatgagatactgctgacgtgtggtacgcgaggtgtcggatccgtctcctatgccgtgacggatccgggcgtactgcgtcgccgcaacgccgtcaagatggtgcatgcccttgtcgagattgagtccggtgtacgggtcgttgacgttctgcggaatgcacaggtccacgccgccgactgaatcaatcatcttgaccaggccggcgaagtccacgacgatgaagttctgaatattcaacccggtgagactgttcacggcgttcagcgtgcagctggccgccgaggagagatctccgccggttttgtaggcacctgcgaagatggaattgaacatgacgttatactgtgcgggaatcgtgcccttcgacgtttcgcactgaggcacgtccaccagggaatctcgtggaatggagaccaggttgatttccttgcggtcggcggagatctgcacaatcatggcggtgtcggcctgatggttgccgatgacgtcatcgaaactgcctccgatggcttggttctccgcgccgtcacgggaatcctgtccgatcagcacgaactcgatcggcttgccggagttcggatcgatgatggatgcgtccgtattcagggaaccctggccgatcacgtcgaccgaattgttcttgatgatgccattgacgtccatccaagtagcggcagctgcagtgccgacgaacaccagagtcgcggcgattgccgcggcgactgcggtcctgacgtgatgctgcacgcgatatcccaggctgtgacgtggtttcgcatcctgaagaccattgatgttaggaagcttattgccggttgatgacgttgccacggtgttgccttcctgattgagatgcgcgtttgacgcaatgcttttagaacctaccactatccaaatgggcaattatagggttaatggccgattttcaccgattctgcgactgtagaccccagattgggctgaactttagcatggattttctgaaatataggcattgacacggggaaacttgacaaaattacattgcgtgtgtgtaatttgaagcggtgtgaaagtatgcgcataaaaggtgcgcacacaattatgggaggactcatgtggggcgtgactgatgagtcttctgagaatccgcttgctgaactgtggggtttgttcaagcgggatgatgacgtgtcttggcagcacaaagcgctgtgctcgcagaccgatcccgaagcattcttcccggaaaaaggcggttccaccagggatgcgaagagggtttgcgcccagtgtgaagtccgtgaacagtgtctgaaatgggccatcgaccatgatgagcgtttcggtatctggggcggtatgagcgagcgtgagcgtcgtcgctacaaaaaagagcacaaggaacgggcttgaaggcatggtgcgtcccgtgcgtacacttaaattatgaattctaacgccagcagcgatatccagacaatcgtgaccgatgtgctgaacagcagaccgtatacgcatcggcaggacgtcgatatgtccgtggctgcggtgatcaccgcgcagcatgaccttcgattcctcgcttctaccgttggagcggtgcttgcgcagcgcatgcttccaggaatgatcgttatcgccgattgcacggggcagatcgagcagcccatgcagatgaccttcgatgtcattcactcatcacaggatgtgcttacggaagtgccggaagccaaaacggtgagggtcattctggtgggagtgaagcaggcggcgtccttcatggacgctgtaacgcgtgcgatggatcagatcggcattgatgccggcatccgcgcgttgtggaccttgcatgacgattcgcggccggcggatgaccggtgcttcgagacgttgctggatgcgtggagaaacacgccgacagccgcgctgctcggtgccaagcagttggattggcaggcgaagaacctgcacaatgtgggtttgtatgccgggcaccatgatgtcgtttccttggtggtcgacggcgagcctgaccaggagcaatatgacgggcgtcaggatgtgctgtcggtctccctatcgggcgcgttggtgccgttggctacgttgcgtgcgttcgaaggggctgacccctggttcggcaccttcgcggaatccacggacctgtgccgccgcatatgtcttggcggtgggcgtgtcgtagtggttccccaggctcgcatcgcccacagaagagcccgattcgaaggaatccgttccaagaacgggcgccctgtggaagacgaggacggtcgcatcgatccgtatcttgccgtacgcgaggcgaatgccaaatacgcgtacactgacatgcaccgttcatggtggccgttgctttggctgtggtccatcatccagtcgttgggattggccgtgctttgcttggcgcgcaaacagccgtatcatgcatgctgcgagctggcgatgccgtggcgtgcgctgctgcgtctgcggggtgcttggcgcgcccgtgcgcggttacgcaggcaaagcaaggtcacgcttaaatcgctatccacgctgtctgcgaatcatcggcaggtcagggaatggcttgaccgtcgccgtgcgttgcgcgaccagagggatgtcgtgctgctcagtcctcttgagaaggaccatctgcgtaaacggttgctgcgtagatggggattggccttcggcgcggcgctgattgccggcatatggatagtcgtgctgtattgggacgtgcttcgttccgtatgttcgggtgcgtcgatgtattccgcacagctgttgcccacgggcgcgagcttcacccagttgcttcataccgcgaccacgtcatggtcgtatgcctcaggcacgggcatcagtgcgcctaacgcgccatggctgttggtgcttgcgctggcgtcggtgctcactggtggacatgttgccggagctgtcggactgatgttcttccttgcagccccgctcatggtgttttccttctgggcgctggccggcatcttcacccgctcggatgcggtgcgctgcgtggtcgcgttggcgtggttcgcgttggcgttgtccatgggactttatgatgacgcggatgtcacgatgctgacggtcatggtgtttcttccggccgctttcgccttctcgttccgtgcggtcggcatgtatcggacggaggatctggtcaatccccacgcgtcggtccaggcggcggcggttgcggcgctgtgtttcattccggtcgtcgccgcgcagccgcagttgttgctgccgctgatgctcaccttcctgggattcctgctgttcgtccgctcccataagcccgcgttgctgctgattccgcttccggcggcgttcgtatgcgcgccgacgttggtcaatgccgttcgtttcgcttccgacggtacatggcgtcagctgttcggcagcgtcatgctgccctcctccgcgcatgatgacaaaccggtcgtcgcgaatctgtccgatctgttgctgcgggtattcggcatcggcgccgacggtggcgcatggcggtatgtggcggtttccatactggcgttgatcgtattgctggccgcggtgtcattggtgttgcctttcgtgctgcgcgtgtcccgtatgatgtgggtcgccgtgttcgcgggattggcgacggccttgctgtccgcggcgattgcggtggccgtcgatgtggatggtccggtctccggttccatgcttccgggaaccacatatgcgatgatgggcttgctcgcctgcatctgcatgatgtcgggcggcgcggttcgacgtttcgtcatgctgagacagcatgagaagaccggcgccgtcgaaatcgaaggacgcggctcgaaggcagtgtcgattgcctcgcatgtgggtcgtgccgtattggtttgcctgttggccgtctccgtcgtggcctgtgcgggattcaactatgtcgaatgcgatcacagccaggtaaagaccagcgatgctggactgccgatggtggcgaccgatttccttgggcaggatgatgcacgtcgcgtgcttgccttgcgtgccgatagcgccgaatcggtcagctacagtgtgatgcgtaccggtcgtggcgacttgattgacagctctcccgcgcgacgcgtcgaagtggtttcgggacgttccgacgggtccagcagaaccattgcgcaggattgcgcccagttgctggccaatgccgattccgatgccatcaacgagcttggcaagttgggcttcggcggcatttacgttatcaagcagaacggcgacaaagcgcagcgagaggcctcgaaccagctcaattcgaacattggagcctccgacgggacacagaatgtcgtcagtctggataatggcacgtattatcgtttgacggttcaggatctatccaagcagcatatcgatcgaagcgggcttgataaggccggctcaagtgtgtggcgtcgttcatggctgtggtgcatgggcgtcgttcttgtagcgtattgcctggtggcgcttccgcgcattcgtcgtcagggtctggaggaagcatgagcagacattctcgtcccaatacgcctttgcgtattgcgcttgccgtaatctcggtattgctcatcgtggtcctgatggccgtgacgctcatataccggccatcatggctgcatgcggacacgcccacggtggaacgctcctcggtgggtcgtaccgtcagcccccggcagcggcagacgtactgcccgtctcgcatgaccattgccgataccgatgcctatggagatagcgaataccaggcatccaacggcaatatcgcgtcttccgcgagatacgccgccttcggttcggtgttccattcatccgtcgcctcgatgggagccgacatgacggcatccgtgtcgatgctggacaaaaaagacgactcgtccgatgacatctttgtggcttccggcaatgtcgatgacggctcccgattgcaagacacgcgtctgctgacggcttcgaacggtaccggcgcggtttcctcagtgatgtcatgggccacggacggtgatttgaagggcgtatcagcagcctcctgcgtcgtgccggcgctgaaacaggcgttcctgctttccggtacgaagaccggcttgacgcaacagcttgttgtggccaatccctccgccaaggacacatcggtgaccatcagaatctggggctccgacaaatccggcgcgctggcgctctccaccggatcgacgctgaccgtggcctcaggcaaggaaacggtactgaatctttccgcagctgcttccggccaagacgcgctgtatgccacggtgactggaacggacactcctgtggccgcaatcgtccgcaccgtctccatggacggattgacctcaaagggatcggattacgcgcttccgaataacgctttcgcgaaatctctggccctctacggcttgaatggcggagaccatgcgacactgtacctgtatacgtcccgcaaaacggatgtcaccgtatcctggatcgactccaagggggcacagcagaccaatcagcaggagctgaaggcgaaccgcgcgtccgccatcgatcttggagacgttccaaaatccgctaccggcatcgccatagccgcttccgaaccggtgtctgccacggcgaagatttcagacgatggccccgatgggcagtccgatttcgccctagtcaatgcgtccgctccggcgaagatctccgccatcgcggttcctgaccaatccaccgcgacggtaggtttcgtcaacaccgcggatggggatcggaccgcgatcgtgacggcttacgacacggacggcaaacaagtggacaggcgtgaaatcgccatccgtccctcggcctcgacgtcggtgcgcatcgccgatattaatgatggcgatgtcgccgccatccgtttgaaggatcccgcccaagccgtggtctggaatcttcgtgtcggacagaaagatgtgtccggtgcgaaactcgccggacttgccatcatcggcgccgtcgatttgaaggaggccagagagcaggtctgggcgaatcaggatatgactgttgtccgttgaaagtcacatgccccaatcaggatctatttcttccggacggcgtccgtagatttccgccagacgtgagaccacctcgtccctgattgcgaattgcaggtccatacggttacgggcatgcgattgcagcggcatgcggtacagcacgatacggggtggaatgccgtgcccggcgggaaatgactgcgatccaagatgcggaacgtcctcccaaggcgcgggatcggatggcggaacatcctccacagcgaattggaccggagctatgagctcaggccatgccccgttgagtctgcggatttgcgccaccagcatatcgtcgaacataccgcttctggtacggtaccggggcagtctggtaccaaacatgggcgtacgcgtgccacgtccatggcggttgcggtatatcggggtctcccaaggcatctgttgcatggtttctaccttatcagggcttattcgaaacatgcgataccatggtatgggctgctcgacaaggggagaaatgatcatggcggatatttccgtaccttattggaacatcgttgatgtcaacatgctgtgcgaaggcgcgcggctgattgggtttgacctcgacaacacgttggcgcggtccaagaaacctatgaaagcggacatggccgaatgcttctctgcattgacatcattgattgacgtcgcggtgatcaccggcggcaaatactcgttgctgcaaagtcaggtggtggacaggctgtccgaccatgccgacaagtcgaaacttcacctcatgccgaccagcggaacccgctactaccggtgggacgggcaacggtgggggaaagtgttctcccacgatctaagcgacgaggaccgtgccaaggcgaaggaatcgctggaacggaatgctcgtgagcaaggcatttgggccactcatgtctggggcgagcgcatcgaggacagaggcagtcagatcaccttttccgcattggggcagcttgcccccgtcgaggccaaggaggcttgggaccccaccaacgagaagaagaaccgattggcctgtgcggttgctgccgaactaccgaatcttgaagtaagacctggaggctccagcagtgttgatatctcgcagcgtggcgtcgataagtcgttcgccgtccgtgaactcgcggatattctcgatatcgaggtcggccagatcgtgttcatcggagaccggatggaacccgacggcaatgattatcccgcggcgaaggccggcacaagggctgtcaaagtgaacggtcccgcggataccgtgaaattatgcggcgagatcattgccagattgtcccgatgacggagccggcgtgaatctgatggcgggttcattcgcgcatatggcgaatctgttgttcccacgaggctgtgcgggatgcgacaagcctgatgacgtgttgtgcgatgcctgtcttgcgtcattcgactgcgaactgtcccaaccattggaaacggctgagatgggtcgatggttcgcgtgcggatggtatcggggtgccgccagacagtcgattctggcatggaaagaccacggagacgaggaatgcgaccgtccgttctcggatgcgttgtgcaggcttgcggaacgcgccggtgtgattgacgccatggatggcgttcgtgagatctgcgataccatactggtcgttcccgcgtcgtcgtcgattgcttccatgcgtcagcgcggacgacggcacatgatgccgctggcaaaacggttgtcggcgtttctacggtgccggacaggtttccgcgtacaggtatgcgatgcgttgacgaacaaaggaatcaaaggcaaatccgtcgagaccaagggcacggaacagagggcgcaacgccttaaggggcatgtcatggttcgtccgggcgtcacccttcaaaacaaggcggtgattctggtggatgacatcgtcacctctggagccaccatgcgtcgttgtgttgacgctctaacttcacagggagctttggtcattaccgtgctggcgttggcacacactccggccggcagacctttgacggcgtaaatcgtcactcgtcatcggaaatgtgatatttcggcaaagtgatttcgaaatcggcgccgcgcggatcatccaccactcgtaccgtgccgccatgcaactgcgccgcccatcgggcgattgacagtccaagaccggttcctcccgattcggtacctggtcccgtcttgcctttgacgaatcgacggaagatatcggaccgcgcttcttggggaatctgcgagccgaagttgacgacattcgtcacaatcgtgccgaaatccttgttttcatgcgcttcgatgagcaccgcggtattgtctgcggagtgtttgagcgcattggcgatgatattggtgaacaactggcgcagacgatcctgatcgccttccatttcgatgtcgtcgggcacgtggatttcgatattgtgggcatgcccggcatcggcgatttccaacggttccacggtttcgtcgatgaaatccgcgaaattgaatttatcgatctgcaggctcgccgcaccggcttccatgcgggacaaatcaagcagaaacgcgatcagatccgacaaacggtgcgtttggttgagaatgctttccagattcgatggggtcggttccacaacgccgtcggccatgttctcgaccatggcctgcaacgcggatacaggcgtacgcagctcgtggctcacattggctaccatgtcccgtctcatctggtcggcatgctgcagttcctccgccatctcattgaaagacaaagccagctgtccgacttcgtcgcggctgttggcatcgacatgcacccggacggtgtagtcgccgtccgccatagcttccgcggcatcccgcatctcgcgcaggggagaggtgagtcctctagagaagaaataggtgatgcccaaagccacggcaagggtgatcggcatggctatccacaggctcaatccgactttgagcaggaaccaagccatgatgaatgcgatgatggtggaaatggtgatcagcacgctcaattccattttgagcgaagagaacaaaccaatagggcgttcggtatccaacggattgaccgaacgccctggttttgaatcagtggtacgcataccaccaaatcttagcgcatcatactattcttccggcggttcgaacgcgtagcctacgccatgcacggttcgaatggtcttcgaacccagcttgtgacgtagcgccttgacatgcgaatccacagtacgggtgccggacgcatccacccaatcccacacttcctcgagcagcttctcgcgagtgagcacggacttcggcttgcgggccaaagtggccagcaaatcaaattccgttggggtcaaatgcacctgctccccattgacggtgacgatacgctgggccggatcgatgaccagagagccgaaatcaagcagtttctcgttttcggagttcttggcgatgaccttcgccctgtccacacgacgaagtagcgccttgcaccgggcgatgagctcgcgcatggagaacggcttggtcatgtaatcgtcggctccggcaccaagaccgatgaccttgtcggcctcgtcgtctcgcgccgtcagaatcagcacaggcacaggacgttcagccacgatgcgcttggtggcctcaagaccatccatcacgggcagcatgatatccatgatgaccagatccggacggagtgtggaagcggcctggacggcgctggcgccgtcggaagccacgcgcgcggtccaaccctccgcagtgatgcgctgcgcgatggcggtggccaaggtcggttcatcttcgaccaccagaacggtacgtggaattactgtggattgtgctgatgaattgagcatagcgttccgcctttctcagagttccggcttcaagaatactgctcccagtgccggaacggtgattttcgcggaccaatcacgggaatgatactcacccttgaccgccttgaaggtgccgttgtgaatatcggaaccgccgtacttcttatcgtccgtggtcagcacttcggtccacttgccgcccttggtgagcggaacctggtaatcctcccatgcctcgcccgagaagttcacgacaacgaccatctgctcgccatccttgccgatacgcacgaagctgagcgtgttatggtcggcgtcatcgctggtcagccattggaatccggcaggatcgaagtcctggctccacaatgcgggagacgccttgtacagggtgttcaggtcggcgacgagcttctgtacgccacggtggtcaggccaattgagagcatcccaatccaccgaaccgtcatgatcccattcgccgtactgcgccacctcattgcccatgaaggagagctttttgcccggatgggcccactggtaggcgaacagcgcgcgcacgccggcatagcgctgccagtcatcgcccggcatcttgccgaacagcgagcccttgccgtacacgacctcgtcgtggctgatcggcagcacataatgctccgagtatgcgtacaccatggagaaggtgatctcgttgtggtgccacttacggttgatcggctcctcgtgcagatactgcagggtgtcgtgcatccaacccatgttccacttgaggccgaagcccaaaccgccggcatcggtcggtgcggtgatgccgggatacgcggtggattcctcggcgatcatcatgatgcccggattgttcttgtacgcggtcgccgtggcttccttgaggaagtcgatggcctcgaggttctctcgtccaccgtagatgttcggatgccactggcccggcttgcggctgtaatccaagtacagcatcgaggagaccgcgtccacgcgcagcgcgtcgatatggtactcgtccagccagaagcaggcgttggccaccaggaagttgcgcacttcgcggcgtccgaaattgaacacgtaggtgccccaatccggatgctcgccacgggtcgggtccggatcctcgtacagaggcgtgccatcgaatctgccaagggcgaacgcgtccttcgggaaatgcgccggaacccagtccatgattacgccgatgccggcctcgtgcatcttctcgacgagatacttgaagtcgtcagggccgccaaggcgcgaatcaatcgcgtaatagccggttacctgataaccccacgagccggagaagggatgctcggccagcggcatgaattccacatgggtgaaaccttccttctggacgtaggggaccagcttgtcggccagttcgcgatagttcttcacatccttgcgccagctagaggcatggacctcgtagatgctgaccggaccgttgtgcgggtcggtcttggctcgctggtccatccagttctcgtcatgccacgcatggacggagtcgacgacgatggaaccggtgcgcggcggaatctcatgcgaacgctccatcggatcggccttcatgacccattcgttgttggcgttgaggatctcatacttgtaaatcgttcccgcttcgacaccaggaatgaatagctcccagactccagaggagcccagttcacgcatggcgtgggtgcgtccgttccagccgttgaaatctcccaccacacgtaccgcatgggcattcggagcccacacggtgaatgcggtgcccaccagctgttcgcccttgacgccgtcattggagcccaacggatcgtcatagcgcagcacgcgcgctcccaaagcctcccaaaggcgctcatggcgtccctcgccaaacaggtacatgtccaaatcgccgatggtgggcagataacggtacgggtcgtcggacaccacggtggaaccgtcttcatattcggtgctgatgcgataatcgggcacgtcgaagccgtcatcggtcttgatggccggaatgagtgccatgaaaacgccattgtgttcatgcaccgcctgggttcgggcattttcggtgatgatcgtcacggatttcgccaacggacgaagcacgcggatcgtgacgacatcctcatgctcgtcgggaccgagatgcccgccgagcacctcgtgtggattgtagaacgtaccgttgcttactgcatccaggtcgccctgtgcaacaggaacggcaacgctatcttctttgatcttggattctgtagccatgggaaaagtgtaagcatgaaatgcttgaaaattggcccgtgtcgcgtctttttttggttttttggcggatttttaggcaagtccaaccctgatggcacaataattcgggttttgtgtaagcttttcacggaggattcatgggttacaaggtcggcgacatggtcgtctatccgcgtcacggcgcagcgaaggtggaggccatcaccgagcgaacggtcaagggtgtgacccgagaatatctgcagctgtcggtgctgtcgtccgacgggctggtcatcaatgttccggtggagaacgccaagaaagtgggtgtccgagacatcgtcggcgccaaggaggtcgcgaaggtcttcgagattctgcgtactccgatcatcgaaaaggaaatgaactggtcccgccggtacaagctgaacgttgagaagatcgccaccggcgatgtgaataaaatcgccgaagtcgtgcgagacctcgcccagcgtgatgtcgacgagcatgggctgtccgccggtgagaagcgcatgctcaccaaggctcgcagcatcctgacttccgagatcgcgttgtcggagcatcttaatgagaatgaggcccagcgtctgcttgacgtgaaccttggttatgaaccgccgcgccctggcgacgaggatcatcacaccgaagctcctgaagaggcggccatggacactttggcgcgcgtcgaggcggagaacaagaagtccaagaagaagtaagggaatttccatgcgtatcggtcagggatttgacgcccatcgattcgcgtcccatgatgcaggcaagccgttatggcttgcctgtttgcgttgggatggtgacggcatcgaaggtgattcggacggtgatgtcgcagcccatgcgttgattgacgcgttgctttccgcagccggattgggtgatataggcatgcttttcggagtcggttccgattccgccggtgccggcaagcacggcgacgagatgctccgcgcgacggttgcgtatttgcgtgcgcatggcatgaggccggtgagcgcaagcgtggtcgtcgtggccaatcgtccgaaaatcggcaagcgtcgtgacgaggcgcaacaggcgttgagccatgccatcggctgtgaagtgtcgctgacggccaccactaccgacggcatgggattcaccggttcgggcgagggcatcgcggccatcgccagcgccttggtggaaccgatcggctgatactttcgctacctgcggcgtgccgattcgattattttggcgacaatccagaacagtgtggaaatcgtcacgatgatgaagcttgggggagcggggaacatggcggaaaccaacagtccaccccaaatggagatcaaacagatcacggtggagacgaccatcgcggcgaatggggaccgtgagatgatgttcgcagtcgcggcgggcgtgaccacaagagcgaatatcagcaatgtgcccacggcgggcaccgcgatggtgatcacaccggccataatggccatgaagcagatgttcatgagattcaccggcacgccttttgcctgcgccacctgttcatcaagcgagctgaacagcagcggtcgatagataacggccaaaacggccagcaacaacacgtcgaaaaccgcaaatccgacgatctgcccgtccgtgatcgtcaggatggagccgaaaagaatcgattgcatctgctgcgaggcggaactggacaagcgtgcgaaaaacagacccatgcctgtggcgaacgccaatacggttcctgtggcgatttcgcgttgcgatgcctttttgcccagtgcgccgatcaccaatgctccgccgagagcgaacacgccgagaccggcactgaccggcagacccaacagcacggctccggtcgctcctggcagtccgatgtgcgccagcgcatgcgcggcgaacgtggaatgacgggcgatggtgaagtaacccatcactccagcagccaaggcgatgcacaggccggcgaggaaagcgtttgtcatgaatggcgcggtcagcgtgcccatccaatccggatcgaaggagaaagcggtttcgttcatgatcatgcctcctgcgaaatgcggttgtgttggtggaatcttgcgatttcctccggcgcgtgggcgtcgacgtcaatgtcatcgggctcatcctcgcttggagtgacgaacatatctccttggggagtggtgaccacctgcaccgtggtgccatatagatgggtgagcagcttcgaatccagcacctcgttcatcttcgcataatgcggatgcccgtcgagcagatatacggctccggtgagaatcggcagaagcatgttcaaatcgtgcgccactacttgaatggacatgccgagttctcggttgagtttggcgagcacgtgcactgtggcgcgttggctggccagatcaagattggcgagcggttcatccaacatgagtagttgggggtccgacaccagcgcttgggcgatggcgacgcgttgccgcaggcctcctgagagttccgacagccggtatctcgccttgtcctgcatgccgacgaattccagcgcattgcgtactttgtctttttgcaggcgggtgatgggatgaatgccgaaccttgccccggtcaggccaagcagcaccgactgttcggcggtgatgttcgattcgatgtcggatgcgtagctctgcggcacataccctatacggtgattcatggcgccggccggcttgccgagcacggttatgccgccgtgggcgatgggaatcaatccgagttcggccttcatcatggtggttttcccggctccgttggtgccgacgatggctgtcaccgagccttgcgggatacggaaggtgccatgctgccagatgatgtgtccgccgcgtgagacccctgcgtcgtcgaattcgatacagaatgatgccttgtcgtgcatggctcgctcccttgataagtcaacgatagtattctcgcaaacggtgttgacaatcattctcaataagaagcatgcatggacgatgaaaagtctcgtgatgaatccgcctggatcgtaaccgttgctggaaaaaagagtccgccgatgtcggggaattactcgacatcggcgaatcgggggagggaggatgaccgtggctttatttaccggggtccgtctgccctgtgttgtccggcgttgcggcgtcggaatcggagtcgggattgtcgttcgacggctgctcgccattcgattcagagggagagacgtccgaatctgatgatgtcgcatcatctttggaggaaaccgcctcattcatttgcttgatgagctgcgcgatccatgagatcaggcttttgctgtcggccggcatctgttccgtgacgtcgatgaccggcacatcggatttgtgtgcggtgccggtcagaatatttgtggcatcatccgccttctgaacattgttgatcagcatatccacttgatgcccctccagaatcttctggaagtcctggagttccttggacgagggttgcgagccttccgagatggactgcgtgtagctttcgggagtcttatcggataggcccatgtcgctgagcagataatatgcgaccggctcggtggctgcgtaggagacgttcctatgtgtatcggagaactctttcatgcttctctcgattaccgtctcgcgtctgttccacgccttgagtttgtttgtgaagtatttcttttgcttgggcatgatgcggctgtaggtgtcggcaagctccttcgccatggcgttgcgtgcgtcgctggagaaccagagatggggattgtctccctcaacggctccgaccatttgcgcggccgaaacggaaacggtgtctctttccaggttttttgtggcccaggagtcgtatcccgctccgttggacacgacgacctgtgccttctgcagggtgtcgacagcagtggtcttcggttcgaacgtgtgggcgtcctctgttgtggaggacagaatcgaggtgactttgacgtgcacgccgccgatctgctccgccaaagccccccactggttgaccgacgccaccacgttgatcggggtggtctgctcctttggtgtgtcgggtgccgttggttgatcgggctccgaagaagcgccaaagcaggaagcggtgcccagcaccgtgcacaatgtgattcccgcggcaaggatgcggaaaaatggacgctggtgagagcgcatgtcgattgccttcctcttgggtcgtccgtcgtttcggtcgcgtccatctcatatagcacatgcgcgacttacgactgaaaccaagatagcctacgatacttgcaaatgccaatacgacaagcgacttagcgaggaagtggaccacatgggaacaaggattgatggcaaaaaggtggcggcacggaccaaggcggacctcgccaaacgcgtggaactgctgaaggcgaggggaatccaacctgggttgggtaccattttggtcggatcagaccccggctccgtgaaatatgtcgccggcaaacatgccgattgcgccgaaatcggcgtgaattccatcaagcgcgagctgcctgagaatgcgacgttcgatcaggtcgccgatgcggtccgccagctcaatgcggatcccgcctgtaccggatatatcgtgcagttgcccttgccaaggggaatcgacgagaacgccatcatcgatctgatcgatcccaagaaggacgccgacgggatgcatccgtataatctcggcgaacttgtgctgcatgcccgaggagacattgccacgccgttgccatgcacgcctcgcggcgtgatcgagctgttgcgcgcctacgacatcgatttggatggcaaggaggtgtgcgtgctgggccgtggcatcaccatcggccgtaccattggtctgttgttgactcgtaaggcggtcaacgccactgtcacgctgtgccatacgggaaccaaggatgtgcgtgaacacatgcgacgggccgatgtgatcgtcgcagccatgggagtggctggtttcgtcaaaccggaagacatcaaggaagggtcgattctcgtcgacgtcggagtatcccgcgtgttcgacgaggaatccggccgatacaaggtcaagggtgatgtcgataaagcctgttacgagaaggctttggcatatacgccgaatcctggaggcgtagggccgatgacgcgtgccatgctgttgcagaatgtcgtggagatggccgaacgtcagttgtgagtttcgcgatagtgctttcgggcgtgtcgtgacatgcgacacgcccgatttttgtgcatggcttcttgtagactttcgccttgtgtgtatttgcacgcacgtataactgaagaacgattttatccatccactattttgtaagaaaccacattaatggcagagaacaataacgaagtcgccaaggtcgccatcaacgacatcggcaccgaagaggacttcatcaaggcagtcgattccaccatcaagaacttcgatgatggtgatctggtcgaaggtaccgtcgtcaaggtcgatcatgacgaggtcctgctcgacatcggctacaagaccgagggtgtcatcccctcccgcgagctttccatcaagaaggacgttgatcctgacgaagtcgtcgaggtcggcgacaccattgaggcccttgtcgtcaccaaggaagacaaggaaggccgtctgattctgtccaagaagcgtgcacagtacgagcgcgcttggggcgacatcgagaagatcaaggaagccgatggcgttgtcgaaggcactgtcatcgaagctgtcaagggtggcctcatcgtcgacatcggtctgcgtggcttcctgccggcatctctcgtcgagatgcgtcgtgtccgcgatctgtccccgtacatcggccagaagatcaaggccaagatcctcgagctcgacaagaaccgcaacaacgtggtcctctcccgtcgccagtacctcgaggagacccagtccgaagtgcgcgagaccttcctgtcccagcttaagaagggccagatccgtgaaggcgtcgtgtcctccatcgtcaacttcggcgcgttcgtcgatctgggcggtgttgacggcctgatccacgtttccgagctgtcttggaagcacatcgatcacccgtccgaggtcgtcaaggtcggagacaaggtcaccgtcgaggtgcttgacgttgatctcgatcgtgagcgcatctccctgtccctcaaggccacccaggaagatccgtggcagcgcttcgcccgcacccacgttcctggccagatcgtcaagggcaaggtcaccaagatcgttcagttcggtgtcttcatctccgtcgaagacggcatcgaaggcctcgtgcatatctccgagctggccaaccgccatgtggagaacccggagaccgtcgtcaagccgggcgaggaagtcttcgtcaaggtgattgacgtcgatctcgaccgtcgccgcatctccctgtccctcaagcaggccaacgactccgttgatccggcttccgaggacttcgatccggctctgtacggcatgccggcagagtacgacgagcagggcaactacaagtatccggaaggcttcgacccggcaaccaacgagtggatcgctggttacgagaagcagcgtgaggagtgggagtcccagtacgccaccgctcacgatctgtgggagcagcacaaggaattcgttgccaaggaactcgagaacgccgaggcttccgcagccgaagacggccaggctccgaaggaagagaaggtcgaagaggtgtccaactactcctccgacaacacctccaacggcaccctcgccgattccgaccagctcgccgctctgcgcgaccagctgctcggcaagtgagtttcgacgaatcaaaataaactgattcgcgtaaaccgctgataaatggccccgcaccatcaggtgcggggccatttgcgtatgttgcgagtccgtcaaacattacaatggcggttgtgatgattcgaattgggttgaccggaggcatcgccgccggcaaaagcacggtcgctacgcatctgcgtgaactgggcgcgacgcttgtcgattatgatgtgctcgcccgaaaagtcgtggaacccggaagcgtgggcctgcaacgaatcgtggaacatttcgggtcggatgcgatgaacgcgcaaggtggtcttaatcggcgatggatgtccgaacacgtcttctccgatccgaatgccgaatccgaacgtagaatccttgacgatatcgaacatccgttgatctacgatcttgcattgtcggaggaacggcaggcggtcgaaaagaatccggatgccgtggtcgtacatgatattccgcttttggcggaagtaatcgatgacatacccatgcgtttcgaccatatcgtaacagtcgaagcaccggaacagacgtgtgtggaacgtatgatgcgcacccgtggcatgagtgaggcacaggcgaaggcacgtatcgcgcatcagcccacgcgtgcggcacgagaatccatagccgatgcggtgattgactcatcccaggatgtagaacacatgttcgactgtgttgataggctgatggaacagtggcgtaaggaagcgagacggaaccatgggattcaacattgaacgagtgaacaagccgtttgtggtcaaatctccatataagccttcaggcgaccagccgaaggccatcgaggagctggccacgcgcatcgagaatggcgagaacgacgtggtgctcatgggcgccaccggcaccggcaaaaccgccactacagcgtggctgatcgaacgtctgcagcgaccgacgcttatcatcgagccgaacaagacgctcgccgcgcagttgtgcgccgaattccgcgaactcatgccggacaatgcggtgagctacttcgtttcctactacgactactaccagccggaagcgtacattccccagaccgacacctacatcgagaaggattccaacatcaacgacgatgtggagcgattgcgccacgccgccaccgcgaaccttctgacccgtcgcgattgcgtggtcgtggccaccgtctcctgcatctacggtttgggaacgccggaagaatacgctggccgtatgctgttcctccaggaaggccagcagatcgaccgtgacgatttactgcgcaaattcgtggacatgcaatacaagcgcaacgacatcgccttcacgcgaggcacattccgcgtgcgcggcgacaccgttgagatcatccccgtatacgaggaactggccatccgcatcgaattcttcggcgacgaaatcgaccgcatctccacgctgcatccgctgaccggcgacgtgatcgcgcacgaatcgcaggtgcacatcttcccggcctcgcattacgttgccggaccggaacgtatggaacgggcgctcaaaaccatccaacaggaacttgacgagcgtaccgccgaattgcataagcaaggcaaggaacttgaagcgcagcgtctcaccatgcgcaccacatacgatctggaaatgctctcgcaggtcggcacatgctccggcgtggagaactattcgcggcatttcgacggacgcgcgccgggcacgcctccgcacacgctgcttgactttttccccgatgatttcctgctcgtcatcgacgaatcacatgtcaccgtgccgcagatcggtgccatgtacgaaggcgacgcgagccgcaaacgcacgctggtcgaacacggtttccgcctgccgtcggcaatggacaatcgaccgctcaaatggccggagttccaggaacgcgtcggtcagacggtgtacctgtcggcaacgcccggcgattacgaactcggtttgagcgacggcgtggtcgaacagatcatacgtccgaccggactagtcgatccgcagatcgacgtgcggccggtggaagggcagatcgatgacctgcttgccgaaatcaaagaccgcgtggcaaggaacgaacgtgcgctggtcaccacgctcactaagaaaatggccgaggatctgaccgactatctgctggaacgcggcatcaaagtcgaatatctgcattccgatgtggacaccttgcgtcgtgtcgaactgctgcgtgaactgcgtgaaggcaagatcgacgtcatcgtcggcatcaacctgctacgagagggcctcgatctgccggaagtgtcattggtcgcaatcctcgacgcggataaggaaggcttcctgcgttcctaccgttcgctcatccagaccatcggccgtgcggcgcgaaacgtgtccggcaccgtcgtcatgtatgcggacgacatcaccgaagccatgcgcaaggccatcgacgagaccaaccgccgccgtgacatccagatcgcctacaataaggaacatggcatcgatccgaagccgctcatcaagaagatctccgatgtcaacgacatgctcgccaaggaggacgtcgacacccagacattgctcggtaccggataccgaaacgcggacaaagccggcaattcgcatctcggcgtgccacataccagcaaggaggaatccggcaggcggcacgaggagattctcaaggccggattgcccgcacaggatctagctgatctcattcgacaactgtccgagcagatgcataccgccgcagaacaactgcaattcgagcttgcggctcgtctgcgtgacgagatccgtgacctgaaaaaggaacttcggcagatgacggaggcgagcaaatagttctcgaccggtcatacggcatccgtaccatagtggattatggctgaaacaccacttgtttttgaaatcgccacgtttgcggtgcttgccgtcttcttcgtggtggacctgttcatcatcgggcgcaagccgcatgtgccctccaccaaggaatgcgtgcagcatatcgcgttcttcgtggtcatggcgttgatcttcggcggactcatgtggttcttcgccggctcgaagcctgccatcgagttctactcaggttggctgaccgaatattcgctgagcatagacaacctgttcgtgtttgtcattatcatgtcgaatttcgcggtgccgaaggaactacagaaattcgtgctgtcagtcggcatcaccgtcgcgctcgtactgcgaggcatgttcattttggtgggcgctgccatcatctcgcgcttcacttgggtgttcttcctattcggcgcgttcctcatcgtcacggccatcaaactcgtcgccgggggagacgaggacgaggaataccatgagaacgcgttgattcacgcactgcgcaaggtcatcaagatcaccgatgaatacgacggcgaaaagctgcgtactatcaagaacggtgtgaagcattggaccccgatgctcatcgtgttcctgaccatcggcaccaccgacgtgatgttcgctttcgattcgatccccgccattttcggcctgaccaaagatccgttcatcgtgttcacgtccaacgtgttcgcattgctcggtctgcagcagctgtacttcctgctcggagagctgcttgacaagctcgtctatcttccgctgggcctgtccgtggtgctgggcttcatcggcgtcaaactcatcatggaggccctgcatggcaattcgctgccgttcctcaatggcggccagccgatttcctgggttccggaagtgcccacatggctgtcgcttgtcgtgatcgttcttgcgattggtggtgcggctttggcaagtgttattaagatgcgcaccatgaaagcgaacgaaaagtgacagtccggcaaacgttgggagaatagagcttttctattctcctacgaaattgtgagcgctcacaacacacctagttctgaggtggaagtgggcgctttttgctagtaagctatgccattggaaacagggtcgtcagatccaaaatcaatatcaacaagaataggcaggcattcatgcgtaaagccaagatcgtagataccatcggtcccgctaccgagtccctggaaggcatcaccagccttgtcgaagcaggtatggacgtcgctcgtctgaaccgctcccacggcactccggaagaccacctcaaggtctacaacaacctccgtgccgccgccaaggccactggccgcaacgtcgcagccctggttgacctgcagggtccgaagatccgctgcggttggttcaagaagaacgccgacggcgaggacaaggtccagctgaccgaaggccaggagttcgtcatcaccactgatgacatcgaaggcgacgagcacatcacctccaccaccttcaagggtctcccgggcgactgccatgcaggcgatccgatcctcatcgacgacggcaaggtccgcctcgaggtcaccaaggtcgaaggcaacaacgtgtacaccaaggttgtcgttgccggaccggtctccagccacaagggcatcaaccttccgggcgtcgccgtgtctctgccggctctgaccgagaaggacgaagaggatctgcgctgggccatccgcaccggcgccgacatcattgccatgtccttcgtgcgcttcgccaccgacatcgatcgcgcccatgagatcatggacgaggaaggccgccgtatcccggtcgtcgccaagatcgagaagccgcaggccctcgagaacctcgaggagatcgtcaaggcgttcgacggcatcatggtcgcacgtggcgatatggccgtcgagtgcccgctggaagaggtcccgctggccaccaagcgctgcatcgagctggctcgtcagtacgccaagccggtcatcgtggccaccgaagtcctcggctccatggtcagctccccggtcccgacccgtgcagaggcatccgactgcgccaacgccgtcctcgacggtgccgacgccaccatgacctccaacgagaccgccgtcggcaagtacccggcagtcaccgtgaacaccatgagccgcatctccaccttcgccaccgagcatggtttcgaccgcatcccggagctgaagaacctggatatgtcctccacaggtgccgtctcttccgccgccgtcgacctggccgacaagctcaacgccaaggccatcgtcgcctacacccagaccggttccaccgtgcaccgcgtgtcccgtgaacgtccggccaccccgatctacggcatcaccaacaatgagcacaccttccactggctggccctgtcttggggcaccgagtccttcctggtcgacgaggattaccatgacaagtcccgcaaggacctcatggttttcaccgacaaggtcctcaaggacgccggcaaggtctccgatggcgacaagatcgtcgtgctgagctccgcccagggcgaacaccagccgggtcgcaccgattccatctacgtccacaccgttggtgcctgcgactgagatttgaatcgtcgcgttaaacgctgattccataatcctcccattggttcccgatgggaggattattgtttttacgcgatgtccccgaatgatgacaacgccgagatttggcgcaaatcgcaatcatgtggtattcttccagagttgcgtgcaagccctcgtatcccaattggtagaggaagcagcctcaaaatctgcgcagtgtgggttcgagtcccaccgagggcacgtaagaaatcaatatcaatccaggcccgggttggggcatgttaggccggctttgggtgtgacagtggaaagagaccgacatggctgcagagaagaccacggaaccggacgaagtactcactgatgaggagctccaagctgctgcggctcccgagccggattctgccaataataacgaggcgcacaagcgcaccgtcgtcgttgccgaagacgaatccgtaaaccgcatggatttggtcgccatgcttgaggataacggctatgaggtcgtcggagaggccgccaacggtgaggaagccgttgaactgaccagtaagttccgcccgagcgtggtgtgcatggatgtcaagatgcctcgcatggatggcatcgaggccgctggcatcatctgtgatgagaacatcgctccggtcgtcatgctgacggcattctcccagtctgatttggtcaaaaaggccacgggcgctggcgccatggcgtatgtcaccaagccgtatgaggaatccaagctgctgccggctttggaagtcgccatgggccgtttcgccgaaatcaacgatctgcttgacaatgtcgaacgtagcgagtccaaactgcaggaaaccgaggaacagctgaagaaggccgaagagcagctgaagaaggccgaagaaacgctggaggagcgcaagctcgtcgaccgcgccaagggcctgctgatggacaaggcggacttctccgaacagggcgctttccgttggattcagaagacctccatggaccagcgcattccgaagaagcgtctggccatggccatcatcgccaagtatggcgaacagaagtcggaagcagaggatgagcgctaacacaccaactgtggaaggcacttcacgcggaacgctattggtcgttgacggccattctttggcgttccgcgctttttttgccttacccgtagagaatttcagtacatcatcaggtcaggccaccaacgcggtctggggattcgccaccatgctttcgcaggtgatcgatgccgaacatccagaccatcttgccgtcgcattcgatgtgaagggcggcacgttccgcaaccagatgctgccgcagtacaaaggaactcgcgacgcggcccccgaggaactgctcagccagctgccattaatccagcagatgctgacggccttgggcgtcacatacatcgaaaaacccggttacgaaggtgacgatgtgatcggcacgctcgccagcatgggcgaccaggcaggctaccgcacattggtgctgtccggcgaccgtgatgctttccagctgatcaacgacaacatcaccgtgctgtatcccggccaccatttcaaagacctcaaacatatgaccccggatgccgtgcaggagaaatatcatgtctctcccgcgcaatacccggatctggccgccttgcgcggagaaaccgctgacaacatccccggcgttcccggagtcggcgacggattcgcggccaaatggatcaaccagtacggcggacttgagcagatcatcgaacacgccgacgagatcagcggcaaaaaaggcgaagccctgcgcgaaaacatcgaacaggtcaaactgaaccgttccgtgaacgctttggttcgtgaccttgatcttggcgtgtcggtatccgacctgacatttggacaagtcgacgctggtcaactcgacgatctattcaccaagctcgaattcggtgttcggaccaagaatcgcgtgctcaaaacgttcaatgcggacaaaccatccggggacgtgcacgaatccagcaagctcgggctgccacatgtcgaagacgtcaacgatccgcatgtggtggagacatgggtccaaaaccatttccccgtggtgcaggaacatctgcacgaacgccatgaacgctcctccaacgacattccggaattcggcttcgaaatcgattcttcgacccgctgcacggacaaggtgaaacagtcctggacgctttacgccgaaggcacgagcaaacccggagaagcctctctttcggcattgatgatcgccgtgcacggcgaagccattcgcatcgacgtattcagtccggatatggtgcaatgcctgcaaaggctgttcgaccgctatcaccattccatggtcgtgcacggttacaaagaacatgcgcatctgctgggcagcatcggcgtggaacttccggaaccattgttcgacaccaagctcgccggatatcttgcccacccggatttccacgcggacacgctggaacaggctgcggcccatttccttgatctgcacatcgaagcacaagccgaagccgcgacacaggggaccttggacttcgacgagcctgaggaaaacgattccaagaacgatgagctgatactcacccgcaccgcaatcgtggggcttttggccgaatatttggccggtgtgctggataagcgcgaacaattcggtctcctcaaatccattgagcttccggtctctcaggtcctgcatggcatggaacaggtcggcgcccaagtggatatgacacgtctggtgcagatgcgcgaccaacttgccgccgacgctgcccaggcacaggaaacggcgtggcagttcgcgggggagcaggtgaacctgcaaagccccaaacagctgcagaagatcctgttcgaagacatgggattgaaaccgacgaaaaaaaccaagtccggttcatacaccaccaatgccgcggcattgcagaccttgcgtgaccgctcgtacgataacgaccgcgcatgccagttccttgacgcgttgctgatgcatcgtgaaaagaacaagctcaagcagatcgtgcagacgttgatcgacgccacaaaccgtcatgacggtcgcatccacaccactttcgaacagacggtggcggccaccggacgattgagctccgtcgatccaaacctgcagaacattccgaaccgggatcccgcaggtcgtgagattcgatccgcgttcgtgccgggagagggcttcgaatcgttgctgagctccgactactcgcaggtcgaactgcgcatcatggccgacctttccggtgatgaggcgttgatagaggccttccgctccggcaaggacttccataagtatgtggccagcttggtctacggcattcccgttgacgacatcacgtccgatcagcgtagccacgtcaaggcgatgagctatggacttgcctacggtctgagcacgtatggacttgcccagcagctcaagatcaagcccaaagaagccgaatcgctgaaaaaccagtatttcgccacttttggcaaagtccatgaataccttgaatcgcttgtctcgtccgcacgcgaaaaaggatataccgaaaccattttcggaaggcgcaggtatttccccggtctcaaatcgccgaaccgtgccgtgagggacgcggccgaacgcgccgcgttgaacgcgcctatccaaggctcggcggcggacatcatgaaaatcgccatgattcgtgcgtatgacgcactgcaggaagcgaaccttggaagtcgcctcatactgcagattcatgatgaacttgtggtggagatcgcgcccggtgaggagaagcaggccaccgcgctggtgaaggatgccatggagcatgccgtcaccatggccgttccgttggacgtatcgacgggcatcggttccgattggcaattggcggcccactgatccgttcccgtcggataatcgaaggctgattaaaaaagaaagaaggaagattgtggcaacgctgaagcaggtcgtggatgtgcttgaaacgctgtatccgctgcgatacgcggaacaatgggatgagccgggactcatcgtgggagaccttcgccacgacgtgcgcaacatcgcgttcgcggcggacccatccatggcggtgatcgaccaggctatcgccggaggcatcgacctgctgatctgccaccatccgctgttcttccgttccgtgcatgcggtctccggactaggattccgtggtgagatcgtccggaagctcaacctcgccggttgcgcgctgtgggttgggcacaccaatgccgatgcctcctaccgaggagtcggcatggccgccgccgacgcgttcggcctgatcgaacagcgtccgctggtacccatcgaagatccgaaagccgaacatccggtcggattgggccgtgtcggccggttgcaggagccgatcgcattgcgtgatttcgcccgtcgtgtggccgacgcgctgccatacaccgaacttggcgtgcaggtgtgcggcgaccttgacgcgacgatcggcacggtggcggtattgccgggctcgggcgattccctgttcgatgaagtgcgtgccgcaggcgtcgatgtgtatgtgaccagcgatctgcgccatcatccggtgaccgatgccatcgagcaggcgcgctatgaggcgtccatgcgtgccgcggacatcgaactcggccgaggcgacgccactgttcgtccgatgttcatcaacacgccacacagcgccatcgaatccatatggttccaatacgccatgggcgatgtgcctcgtgccgtatctgaggcgaccggagacatccccaccgtccgctggatttccatgaacaccgatccctggaatctggtactgccgtcctgcgggcaggaacgctgaacgacgatgtccgatatgaccagcatggatatgtcgctgaacgaatccagcgatggcgtggacatgaccagaccggccacagtactcagcagagagcacgtgtatcaaggcgcgattttcggcgtggaggacatgcgtatcgcgttgcagacacgagacggcggacaaaccgtgatccgcagacaggtgatgcggcacgcgccctgtgtggtcatgctggtgcatgactgcgcgcaggatttgtacttggtcgaacgagaataccgtgtcggctgcgacgccttcgcctacggtctgccggcaggactcatcgatgacggggaagacgtcgatgcggccgcattgcgtgagctgcgcgaagagaccggcgtcgagccaatcgacgaaaacagttgcgatatcgaccatgtcgggcaattctattcatccgaaggcatgaccgacgaactggccaacatcatggtggtgcacctgcgccactggcaggccgtcgaacggcatttcgacgccgacgagcatgtcgaatctgcttggatcccgtggaagcagctacgagacacgcacatcacggcctccaattcggagatcgccattttgcatgagcaaattcgcagaatgcggcaacaatagcggcctgcaggtttcgaattgtaaaaacaatcgccggaataaacgaaataacgaattcaactcgcaaaacgtgcgatacttgaattatgcaaatcagacctggatcgatgtatccactcggtgcgagctacgacggcgccggcgtgaatttcgccctcttctctcaagtggcccagaaagtcgagctttgtcttttcgatgaggaagaccgtgagacccgagtggaaatgacggagcagaactcctacgtatggcataactatctgccgggaatacaacccgggcaacggtacggctatcgtgtgtacggtccgtatgatccagcaaagggcctgcggtgcaacccgaacaagttgctgctcgacccgtacgcaaaagccatcgagggaaacatcgacggtgacgaaagcctctattcgtattggttcaaaagccctgaggacgtcaccagcatgaatacgctggattccgcgccgcataccatgaaatcggccgtggtcaatccgtatttcgactggggcaacgaccaacatccgaacatctcctaccatgattcggtaatctacgaagcccatgtgcgtggcatgaccaatctcaacctggacgtgccgccggacatccgtggaacctacgcgggcctcgcatatccatcggtcatcgaatatctgaggaagctcggcgtcaccgccatcgaacttatgccgatccaccagttcgtcaacgacagcttcctgcaggaaaaaggcctgagcaactactggggctacaacaccatcggcttcttcgcgcctcataacgcgtactcaagctccggacaacgcggcgagcaggtcaacgaattcaaatccatggtcaaggcctaccatcgcgccggcatggaagtgatcctcgacgtggtgtacaaccacaccgccgaaggcaacaacctcggcccgaccctaagcttcaaaggcatcgacaacggtgcctactaccgtctggtcgacaacgaccgacgccactacttcgacacgaccggcaccggcaactccctgctgatgcgctcgccgcacgcgctgcagctcatcacggacagcctgcgctactgggtcaccgaaatgcatgtcgatggtttccgattcgatcttgcggccacgctggcccgccagttccaggaagtcgacaagctgtccgccttcttcgacatcgtcgaacaggatccggtcatctcccgtgtcaagctcatcgccgaaccttgggatttgggttccggcggctatcaggtgggcggcttcccgtccagctggtccgaatggaacggccgctaccgtgattgcgtgcgtgacttctggcgttcgcaaccatcgacgctaccggaattcgccagccgtctgatgggcagctccgacctgtatcagatgaacggccgccgtccggtggcttccgtgaacttcatcaccgcacatgatggcttcaccatgaacgatttggtgagctacaacgagaagcataacgacgccaacggcgaaggcaatagggatggcgaaagcaacaaccgttcctggaactgcggtgtcgaaggcccgaccaccatcaaggacgtcaacgacctgcggcaacagcagatgcgcaacatgttcgcgacgctgctgtgcagtcagggcattccgatgatctgcggcggcgatgaggtggcacgcacgcaacagggcaacaacaatgcctattgccaggacaacgccatttcatggaccaattgggatcttgacgatagtcagaaggatctgcttgagttcgtttcgaagctgattcatctgcgactcgagcacccggtgctccaccgtcgtcgtttcttcaccggccgcgagccaggagacccggacgataagattccgcaggtcgaatggatggaccacaccggttccatcatggacatggaagattggtccaatacccacgcgttctcggtgatgatctatctgaacggttccgatattccggaagccgactggtatggcaaccagatggtggacaataacttcatcctgattttcaacgcgcattacgagccgattatgttcaccttgccggacgagcggtatggcaagaaatggcgtctggtcgtcgacacgcataatccgaagggtccggaactcaactatgaggccggcttcgcgatcacggcgcagtcgagaagcttcctgttgctgatgagcgatagaaagcccaccacaaagaactacgatttctgatagccatgagaacaggcgaggtgccatccgtacgggtgacacctcgccgtattgtttgtggactgtgctcgtgaaccgttacgagaattagacttccgacgagagtcgggaaacggttccaggaacggtttcgctgacctccgcaagatccttgacggattctggccgcttggtttgcgccagaataagctgcgtctgcacacgatcggattcgatggccgcaatctgccgtgaaaagatgatgaaccagcccagaaacatcatgccggcaagagcctcgacgttcgtcaacgtgttacgccccgccaaccactggaacccggcaagagccccgatcacgatagctaggtctgaaatcacatatactacttttgaaagctgcggggccagccaaggcagcgcgatcatcagcacgctcatcaggcagggaagaccgcgggcgaatacgttgtgcagaatcggatgcggcgtgtaacggaacatgccgatgccgatgaaggcgatgcctgcgagcgtcagcatggtcgatagcagaagaatccgcgccttgaagtgtttgggagcttctttttcatcgcttgcagacagatactgcatctgcagacggtgcgtggtgatgagctccgaaatcgcgaaatagctgatgatgacgatgcagacgccggccaacatcaatgtcgaattgaacatacgagcagcaaaagtggttcgatcgcccaattgggagaaattgttgttgtaccagtatggatcatcggacgtcaatcctgcgatgctgacaccggaaaccacgaagaacggcaacaaggatgcgatggtcttggcattcatgagttccgcctgtacgaacgtgacatagcctacgacccccgagatcgcggcgcagagcgcagtcagatagccttttaacgtgcgcaaccccatcatgttgctggcaatggaaagcagcatgaacgccgtgacgaaaatggtcgacgcgtagaccacggacaaagcgagtatctcgaagatacagcgaataggaatggtccagccatgtttcaacgtcatcgacctggagttgcgcgcataccccaaggtgaacgagatgactccacatcccgcggtgattccggcacacacggtgaacaggcgttgggtgacacgccagatggcgggagcgaattgcagatataggtccatggcgatccatgcaagagtggcgcatgccatgaaggaaatgatgcctgaagcctcggcttgctgatgacgtcccatgcgcgttccctccagtatttgccattctagcctgtcgttgtcctaccatacgctacaatggaaactcgtgttcacctgccacgtgcgggagtgcatgaacgggctgtagcgcagtttggtagcgcgtctgctttgggagcagaatgtcgcaggttcaaatcctgtcagcccgaccggagcccttggaaacattaggttttcaagggcttattttttccgtcgaaaacaatccgcatacaaatgcatacaaacgccgcggtacctccatgcccgattcacacgagttcgcgctcgcggagggctccgatcgcgtcggccacgtcgtccaatcgttccggccagagcgccgtgtaggtgttcaatgtgatgctgggagaggaatggccgagctgcatctgcagggtcttcacatccgcgccctgggcgatcgcgaagctcgcgtatgtgtggcgcagactgtgtatggtcacgcccgcgtcctccatgccggccgctttgacggccttgttccatatccttgtccgccacgtgttcgtccagacgttcccgccacgggtggcacggaacagccagtcgtcatcacccatgccatccatctgcgccttgatctgcggcatgaggaaccgtggtatcgcgatgttgcgggccttgccgttcttcggtgtgccgagcatgctgccgccgtgcccgtcgtcagtccatgtgcggcctatcctggcgcgccgcctgtccgcgtccacgtcaccgaccttgagggcaagcgattcgcctatgcggcatcccgtataggcctgccatctgaccagcagaccgtccaccggcttcccgatcttctccgcctcgtccgcgagcaactcgacctcgcggaccgagaggaacaccatgtcgtcgtcggagacgatcttcggcacggtgaccctgtccacaggattctcaccgatccacccgttcgagacggcgtagtcaaagatgcccttgaggacgactttcatgatattgcggatgcttctcgcgctcagcggcttcgaatcacgtccgtccggcaacgcggccggataaccaccgtccatgagctggccgacccactcctgcagcatgtcagggcgcagctcccgcaacgtcatgccaccccatttgggcaggatgtacaggcgcagctccctcgcataccggcctgcggtgccgggtttcagatcaaccttcgacgcgagccattcgccggccacgtcatccaggacacgaagctcctgacgaggatcgcggtagcgtccccgccggatgtcgtcctccatggccgcggcatactcctgcgcttcggcgagcctggcgaactgcttcaccctctgcacacgtctaccgtccttgacgatggtccaatgacaacgccagcgcatcccgactccataacggcttttacgccacttctcaggcacattggccttcatcggatcgcgtgagttcgccaaagagcgtttggccgcgcgactcggcggattgccatcatcgtcattcttgagccacagatcatcaatggtcactttcatgacgcttcttcccacatgtttttcaccccggcgctcgcggtatgcgggtggccggggtcattttttataaggaatccgaaggggtataaggctctataagcacgtataaaggcgtataactattgcatgcacacgccggaatcatgaagcagctgccggtagtccatcagcacctgcaccgtcacacccaattcgaccgccatcggccacgccgcgccctcataaatctcctcggccatgccgtaatccaccggactgatcaacgccagcgcggtctccctacgacaccgacgctcgcatttggccccgtatcgtgtaccgcagccggggtcatggtgtctggcgtggatgagttcgtggcagagggtgcagcggcgttggaatccggccagtcgttcgtcgaggatgatgaggcggagcggatcgtagtagatcccgcacctgtctccggccagccgacgttcctccactcgcacgcccagtgtcttcgaccaggacgtcaatgtggcgtcgttcaccgtccagttccgtccaatcccttggcgaacctgtcgaaatcgctttctcgtgccgcatcccacttgtggaactcgtcgagggccttgcgtctcatctgctcgtgtccacggttgcctttgccttccagcaacggcatgcccgacagggagatgtactggtcgatcagcgtggcgcattcctccatgctggtgagggtgtggttcagtactcgtgcctccacgaggtccagcagaccggtggtgagcgtgttcaacgccttcatctcgcgttcgttcagatagttctttgccacggtcacgtccgtggaccgtggatgtcctttcggagcgcccttccaagtagtcaatcccatgttcggcttgccgtcgtccacacgatccatgacgatttcggcggcggtctgatgggtgacggcgtagtgcatcttgttctggcagctggcgaagaagtccctagccgtctgcgagttcggggcatagtcgtagctgacctcgctgaacaggtcggtgaccttctgccagaaccgacgctcgctggtgcggatgtcgcggatgcggtcgagcagttcctcgaaatagtcgtctccgaacggtctgccgttcttgagcatgtcgtcgttgagggcgaatcccttgacgatgtattcgcgtaggatgccggtggcccattggcggaattgtgtggcctgtctgctgttgacgcggtatccgacggcgatgattgcgtcgagattgtagaaagagatttctcttgatacctggcgagaaccttcttgtcgaactattcgagatttccgaatggttgacgtctctgtcagttcgccggatgagaagatgtttttcagatgctcgttgatggtcggcacggtaacattgaacaattctgccattttctgctgtgtgagccagaacgtctcccgccagtacgtgacttcgactggtacgttgcgcccgtcctcttggtagaggattatccggccttcctgtggttcgtccgccatgcttgtctccttccgattccacaaccatcttgttgacgtcaacaaaatggtctgttgttgatgtttccaacggttttgaactattcggttatttctaatagttcaatccgcgtatgacgcgcgcagacccagttccttggagctcccgccttgagcggcttgctgagcctatcgctcactgcttggcggtcttcaccactgtggtggtgcccatcgcggtggtctcccagctgacgccgtccgccttggtgtaggtgaagtccttggtggcgtcctgcgagccgagcagggacgcctgcatcgccgcggtgtctccctggctcgtccacttccagtcaccggccttgtccggcgcattgtaggagcccttccagtacaggctcttcgtatcgccgttgtcgctgacccactggacggtgatcgtgtcggccgttatctcggcttccatccaggaatccgtgctgccggagttggtctgcttccatgtgccggtcagatccgcaggctgttctaccggcttcttctctgccggcttcttcgtcgtctgcgattggctcgtgctgccggcgtcggcggttttggcgtcactggcgttgccgcatgcgccaagcccgagaatgagcagaccggcgacggccgttgcgattgtcttcctgtacatggtttccttctttccctagttgatttgcatcaaaaaaatctagtctcttggcgtctccgcctcaagcatcttgttcggatcgtcattggcggcagtgacgtaatcctccggatgcgcggcgatgcgatccaccaggtcatcggtgatcttttggcgctcgcgggcctcgtaggcgcgggcggcctcgctggagattgacccacaggctgccgcgaccagtgaaagagcgtccggaagcccaaagagtggagcgagtctgtctaactcgctaattgcccaacttcttttaccgagtactcggtcgctgacataaccttttgatcgtccttcaagagccttggagaggtcggcctgggtaatgccattggcttccattgcttggctgatatatttgcaaatcaccagatcggtgcgtgttgtgctgctatccatagcgatgactgtattcgaattttcgggaagttacatctttacaccgttcggtgtgtcgaatttgccataccgaatattcgggagtacattgaaagcatgttcaccgaatatccggtaaacgtcgaacaaagtcccgaatattcggggaatggaggtgatgtgacaagcaatgaatacgtgacacaggcaataaaagtcaggatggctcgacttggaatcactcaatccgacgtcgccgacgcagttggaatcaatcgggtcgtcatgaatcgatacatgcgcaatcaacgggaatggccgattcgcgttctcgacaagattgctccggcattgaaatggcaagacggtcttgacatcttcattgcagcaaattcagaagaaaaagaaccgcaatcggcgctcgccaaatcatgaatcgaaaggagaatccgaaatgagcatcaacattccggccgagacaccggatgaatccacgaacccgatttccgttgaggagttcgaacgcctgcacccggcgatgctgggcgcgataagaaaagccgtccgcgaggaaccagctcgaacggttatcggaacagtgggcgacgacaggaggagccacctgtccagccttgacctgcgaggaatcggcatcgaggtcggacggcagttgtcggcccgcgacatgacgactgaagtcatgggctcgattctcgagcgcatcaatcaggccgcggaccgactaagcacggagatacaggaactccgttcagaacttatccgagagcacgtcgagacagtaggcggcggatgccatggaagcatccatcgaatcgaatcccttggcgaggagggaaagcccttggcacagggctctcatcctctcgtcgggatcggacgtttcagcggccttcccgaacacggcgctcgccttcgcgaaatcggatccattgctcatattctcacctcccttctttgcgtgggtctgctcattctcccactcggcaggaagggcctcaaatgagagtgcttcgaaaaagcaagcggcgctcgccgaagagtgaatcgaaaggagaatccgaaatgaggaagatgaagagatccgacgttcgagaatggattccaggtgaaccgctcgaacgggtcgacttcggcaacggctgcacggggatggataagagcattccgaaagagccggggaacgctggcgatttcaagcgtctcatctggaaatgccgcaccatcgaagcggacggagggccatgccttgatgtgcttccatccgaatactggattgacgacgtgaagcaggccggctatttcgatgtggtcaccgacgaatcaagttacggcccatgcagcttcggtgatgcgtggttttatctcgctggcgttgatgcgggatggcatctcgcccgcaggaagcgtcattccggtttgtgtgcgaccttgcgtggcatattcgattcgttgactcatcgccacgagaacgcgactgatgcagaaccgttggttacggcctcgaagccctctcgcgaatctgccgaacactcttcgagctgcggttccacgcctccttctttatctcggtcagagatacacgaatcttatgactgcgcgacatgtgggacgaccgccactcaatctcgaaatcatcgggaagtagcagcaccgcattctcgccggtgaagccggtatggcagatctgattcggtctcaaccgcttggccaacagcggcgtataggggcttgttccgaacgttgcctgaggtgggattcggacgtcatacatcgtcagaggtccaacaagccggaaatacacgatgctgttcgacgtggaatcaagaaaaggctccaaatcggtttgggacaaatcgtccctacggcgaatggagtggatttgaaactgctgcagaacgttccacgccaaagacgctccggcgatgatggtcgaagcccagcctgccggatcctcaagaaaactattcacaaactcgattctagggagaatccaatgaacaatgaaatccagaagttcgatttcaagggcgcctcattgcgcaccctgaccgataaggcgggggagccctggttcgtcgccaaggacgtatgcgacatcctcgggacagatacaagggacttacacaagattcttgagtctgatgaaatcaccaatgtggatagtatccacattgctcagaatggcggtaaagctccgctcatcatctccgagcctggtctttaccgtcttgtgatgaagtctcggaagccggaggccaaggagttccagcgttgggtgacgcatgaggtgctgccgtccatccgcaagcacggcggctatatggccggccaggaacggatgacaccggaacagatggcgttggccagcatgcgatggctgcaatccaaggtcgacgaacaagccaaacagctcaaagcccaggaaggcaaggtcctgttcgccaacgcggtcgaaaccgcgaggacgtccatccttgtgggcgatttcgcgaagatcctgaaaagcaacggcatcgacatcggcccacggcgcctgttcgcctggctccgcgagcatggatggctcatcaaggccaagggctccagttggaacatgcccacacagaaggcgatggaccttcacctgttcgaggtcaaggagacgaccatcagccactcggacgggcacaccacgatcaacaagacgccgaagatgaccggcaaggggcagacgtatttcgccaaactgttcctcgcgaaaccaacacaggaagcgggtgcgtgatgagcgcgtgtcttgaaatcaacaacattccgcagagaaaagcgaagcgtatcagtgactatctcttcgcgcattccggcaaatggataacggacgacccgatcagagtcgagctcttaggcgacgggaaggcgttcgtaatcttccccgcgattgccgaagtggactcgagggaattcatgacgatgttgggggatgagtgatgattgttgcaaccaagccaagcgctcttagcgtggtggcgtccatcatctgcgcgatatccggaatctggatgtttgcctgtggactcaaatctctgaatcaattccagattcttcttggctgctcccttctgctcaacggattgcagattggcactagatgggtgatgctgcgggaactgaacaggaactacctgctcatgcgccgatctgggctatgtacggaaccgccgcgagagcaagagcgggaatctgaacgatgaaatcagcgaacatcccacccatgtatttctccttgatcttctgccagcgggattggtccttggtgtgcgattcggcgatgtacaaggctccaagcagacgctgcatggcgtcattgagctcgaacgagccgcagctctcccaatcgttgacgcatcggcgaacctcggtcgtgagattaagcacatacgacttcaacgccgctggcatgctcacatcctctttcaggcactgctcgatttcagaaaggaagccggagatgttctccctgtccttgtcctccatccgcacatccagctctacccacctgtcggcgatggtctgcaaagccagaaccgccgcggcatccaacctatcggtcgcaccggccaacgtgctgaagttcatacgatatccgttcgcgtcctccgagaatgattcccacaaggctttccaaataccgggcatctgtgatttcgccatgtcgagacgtttcacgccacgggcgatcagcgtatcaagtgttctttcggtgctgcacatggccgtgtatgcggacagcacgtccttccggaatccgtcgggctgctgctcgacctcaaaaaactgcagtaggtattcggctgcattcgacattgattcttctcctaactgttcggcccgcacgtcgcatatgcgggatgacaccgattttaggagggggccgggcggttctcctaacgccgcccggcatcacatacgcaaaggaggcgcgtgatggaagacgatacgacgttcgctgcgctcgctgaggtcctgaaaccgatgaacacgacgaaggacatcgcggaccgttgcggcatcaaggagggcaccttggcgtactggcgtggtgcgggaatcggcccgaagttcgtgaaggtcggacggaccgtcatgtatccgaaggagccgatgatcgcctacttcaaggaacacctctaccagagcacatgtgaatacgagggaaaggagtcggcatgaaaacgattcgcaaggcctgcgtgcaggcggtgttcgacgagttcgagacacggggcgaactggtccacgcgttcgcggatggggatgctaaggccatgaggcctctcggccacatcgtcggctacgtcgaccttgacgtcaccggaatcgtggatctcatcgtcgacacgatcaacaaggagctgtgatggcactcaggagaatcgacgtggaaacgctgctgacgccacccgaaccgccgaaggcgagcatcgtcatgcttggcatgagcggatacgcggttcgcatcagtccgaaaggcggggcccaactcgtggaactcctgcccgacggcgcctgcacgctcgcatccatcaccgcgggcgagcttgagacattcgactaccaactccacaacgaaacgggaggcaccagatgaccgacaacgatttccgtatcgaggaccggaaggaacgcgaggcgagacggccgaactatccgctgcgcagggtcaagttcctgctcgcggtcgtcggcctcgtcgccagcgtgacgctcatgctcacctggcatggcggtagccttgtgggcgcgcttgtggtcgagggcgtgtatctcgccaccgcgttgtggctggtggtgcggttcgcgtccagggacgacggcatggaggaggacagtgatgcctagcggcgcgaccagcctccaactgcacgcgaagtacgctccggtcaaccgtggcagcatccgctacggcgcatcccgaagccacggccaccacacttcgccgaagacatggagccaggagaccggcatcgaccttgaccggctcatccacgacgaacgcgagtacatcacgcggatgagacgccgcacccggcgtgacatcgacgtgaagccacgcatccaacgcgtgtacgagacgaccgtcgcactgcagatggaaggggtgacgcccagcagccacaaggtggcctcacggctcaacatcccccggagcaccgtgatgggcgacgtgcacaggctcgccggcatgggattgctcgtcaacgcgcggacccgacgcggaggcttcctcgccaccggcagaacacccgattggagtgacctggattgagtctcgaaacattaagcctgccggaatggccaatggtgtgcgaactcaccgtgccgggagacccgcagtcgaaaggccgtccacgcgtctaccagggacacggcatcaccccggcgaaaacccgggaggccgagaaccgcgtgtactcggaatggcgcaaccagtatccccgcctgccaccctacgaagggccagtctgcctgacgctcacattctggacggccacacggcgcggacgtgactgggacaatctggcgaaactgttcaccgacgcgttgaacggcgtcgcctacatggacgaccggcagatcatcgaagccagcgtgcacgtgcatcgtcccgaccagtacgtgcttggcgcgcacggcaggccacgcaaacggaaaagcggcgatccgctcacatggcacggccagccatacacgccacacacacaggcaagcatctatttcaaacaggaatacatacccagataggagaaaacaccatgaaaaacaccagtgaatacgttgtgcagaccctcatcgacgacgaggacatgagcgccgacctcgcgagcctctacccggcggccagcaaaatcggcgacgcagccgcggcattcatcgacaaagcggaccagaccatcgaaaagaagggtctgatgggcacgcctgccggaagcgaaatgcatcgacatttgccagaacgtcgtcaaggaaggcgcggccatcagccggctcctacgcaatccaaggacctgcaacaccgtgatcatcagccgacggtgcgaggaaacgaatcccgccaccgaagacgacggcatgacgcaatcgaccgtggaggacgtggaatgagcaagcagaggggacacatgccgtactgccgcacgtgcggaccattggggccggccatgcgaaccacgcccgcgttcgacgtcgtggaaacgcaccgacgctcctacccgcaccaccagaccagcgtcatccccaccaaaaccagcatcatcgtgaaaggaacaagcaaatgagcgcgcagaacctcgaaacattggccaaacggtacgtggaactgaaaagccgcatcgccgacctgcaggaagaagccgacggattgaaagccgaactcatggaagaccgcgggccaggcgaatacgctgccggaccgttgaccgtgaaaatccggaaaggcaagcgcaacctcgatgccagagcattcgaacggcgctttcctgtgcaacagtacgccgactgctatcggatccaaccgaaggcattgtccgaaatcgtcagccaggtcggcgagccagcattgcgcgggtgcgtgaagaccggtgcggcaagtctggtggtcgaatgacgcgcgttccaatcagccaggaggcggtcggccgcgcgctcagcaagacgctcgaccattacgacaaggcgcccggattcatggacgaagcctacatcatcgacacacaagaggcgggggacttggcggctttcctctgggcccgtctcgacgaggaatgcggaagggtgggatatgagctcacaactcgaccttgaaacagtcatgaaagccaacatgggcaccgcactcgtcgatgccacaccatccgcttcgcgggaatcggacgaatggaaggaaatccgcctgatcatcgaggcgcacatcgccaaccagccacgcagcctgcaaaaggagatcgggccaagcgaactcggcaccgactgcctccactgcctcgccgccagactcgccggatgggagaaacgccagtcggccgcatggctgccattcatcggcacatgcgtccacgaacgattcgaacacctgttcaacaagcgcaaggacgaattcaccgtcccggacgacgatggaggagaaccatgggccgtgaaacgcttcgaagccgaaagacacgtcgacgtgggcagcatccacggactccacggctatcagctcatccacggcagcatcgacctgtacgacgcggaaaacaacacgaccatcgactggaaaatcaccggccccaccacaattcgcaacgtcaaagccaacggtccaagccaacaatatcgcatccaggcgagcctgtacggcatcggattggaaaacgacggagaaccctgcaaaaggaacgccatctacttcctgcccaggaacagcgtcagcctggccgacgcactgccgatcgaattcgacttcgacccgaaacccggacggtgggcgctcagccgcgcgcaactcatcgccaacctcctcgacctcatcgaacaagaggatggaaccgaaatgcgcgacgcgtggatacacgctctgccaaccagtccgacccactgcttccaatgcggcagctggccggacgaccagctcggacaactatccgaactcaacgaaaaccaatatccggcattgccggacaaatggcggcaggccatcggcctgctggaatccacctacaggaaaacagaaaggtaaaaaacacaatgttcggaacgcaaaactatggtggcggattcactcagcaaggcggagccagctaccggccacaacaggcgcagcagcagtccgccgaatcgttaagccttgacgacgtgatgcagggcggcgcgcccagcgcgttcagcaaggacgatccgatcggcaccagcgtggaaggcgagatcgtcgaaatccgcgcggaacagcagaccgacttcaccaccggcgaacccctctactatcccaacggcaagccgaagccgcaggtcgtcatccacctgcagaccacactgcaagacccaaatcgcgtcggagactccggcattcgaggcgtgtacgtaaaaggctacaacatcggccaattgcgtctcgcatgccgtcaggctggagtcggcgaccatccgaacgtcggagaccacttgaaagccactttcgcccgcacccagcccgcgaagacccgcggctacaacgacgcgaaaatctacgactacgtcgtcacaccgaaaaagacggccgacttgaacaccgcgatgaacgacccgcaggccgcagccccgcaacagtatgcgccgcagccgcagtacggccagccagtcaccatcggccagcccgcaggcctgaccatgcaggaacgacagcaggccgcccaactgcaggccgccggaaaaaacgtgcaggagatagccggactgctcggcaaaacggtcgaccaggtcgtcaacgcgctcggcgcgggcagcggacaagagcctgaattctaaaaaataggaaaacgtccccaccacatccctgcagtgacgtctcgctaatcgaaaacgtcactgcggggacgtggtggacacagggggacataggcaaagtccacccaaaaaggacgaaaaatcaaccatatatagaaaaaggacaaaaggacaaagtgttttatatatatgtcttttttgttgttttttgtgttgtgtgtataggggagtaaccgtccccgcaaaaaggaggtgaaaaatgagaaactacagcaaatactcgcccattcccactgaagacctgccagcgcaattcgcgggaatcttccacctgctcgcactcaccttcgcgccggcgaacgaccgcacgatcattgcgaccatcgatggccgcaaccttgaacttatctgcgatggtggcgatactgccaccgaacatcgcaagaaaatcccagtcgtggccgccggctatcaaaaagccatctgggagctccgcgaagggcatcttcgctactgcccgtcacagcaaaggctctggcgtcgagacccagacacgtccgaccatgagggcgaaaggctcatcctcaattcatggcatcccgtgaaaaccatcgaggatgaataccatatcggcacgaacgcgcgcagcagtgagcgtaatccgctctacagtgcgacgattcttcgcgaggcgaagcgaagccaatggttcgaccaagtcgaacgcggcgtgcgctgcgacccatgcgtgtgggtgcgccgtgaaggaagaatcgtctgtctgcaggatgagccggatattgcggtcacgcagacattctcaccggcaggaatgggcaatcaggcattgagggatgcgaagcgcattctcgaatggttgaccgtcgatgagaagtcctgcgcgaatctttgccgaatgttcgcgacgccatggcttgagccattcaaacaattgtcatacgtactgtctggtcatggtggtgacgggaaaacgctgatcgcccgccaggcgatccttggcgtgcttggagtcgggaaagtgtttcctggtttcagtgtgcagggctattgcactggcggtggctacactctggggcgcgagtcgatgaatgatgagatggacggcaaggctttcgccattgacgatgaggcttgcgctgtcacggaggacatgctgccattgctgcgtgcactctcgacaggctcgcaggtgaacgcccgcgtcacgggcggccgttatcgtgtgatgacgccatcggccacattgctgattctgacgaacatgcagttcgccgattcaggcgagaattccgatacgcgtcgtttcattaaggtcgaattccaccagtcgaaaggccgctcgtatgacgaatatcatgcgatcgaggggttctgccatcgacatcccgcagcgttcttcgtgctgtcgtgccgcttgtgggagcgttcggatgagccggagattgtgaatcttagtcctgctcgcaccatcagtgacgagatgtattggctgatcagtgagatcgcgtcgaacgatgaacagtatggcgtgccagtcgcttccaggaacgactatcgcaaggagtttcacacggcggtgccgcagtctttgatggacgtgctgggcttggagaattcgaagaccaaggcgctgccgggcagtcaatgccgtgtggtgcgcgtcgccgaccagaatcgcttcgaagtgtatcgcaaggccgctctcgataacgagacggagcctgccgacacttggtggcagacggcattgtcgaagccgaaccgcgacagtcttaaaacgttggatgatgtgggcgactgtcatgatctggccggcatcgtcgaatccgcgttggctggcaatgtcggtttcgcgccatgcgagggcaaggcgcgaaagactggtggtccggtcgatgggaaggtgtcgctgtcgtggaagcggttgaatccgtcggacgagagccacacggattcgactttcatcaccgacaagatgactcgttatgccgtcattccgcttggcgactgtttcgtcatcgattgtgacaagccttctgaggctgatggtcctgatgggtggcagtgtctgcaggcgttggctggcgattacggttcccaggcgttgccggccacgttggtgaccaggactccgcatggcgtgcacttgtattatcgcatgccggcaggcatggatgtgagcttgctgaagaacgctgtgcatgagcagaatctgccaattgacctgcgcgtcagcaacaagggctatgtgattggtccgggcagtgtcatcgatgggaaccggtatgagctggttgatctgccggcgggcgtggtgccggaggcgagtgatgcggtcatgcgcatgctcaaggatttcggatacacgaacgagccaaagcaggaggctccgtcgttgagcctggacgatgtcatggccgacaggccggccgcgtcccgatcgcatggcgtgccggtcatgagcccggtgccggaaggccaacgcaacagcacattgcacgcctgggcgtacggaaggctgaagaaccatccggagaacgaacggcagatccaggccgatctgttccagcgtggccgtgtgagcggtctgccggacggcgaactcgaccagatctggaaatcgatcaaacgaagcctcggataagggtaggaatcatgatgggaatcatccgaaaacttggtggtcttctcgatgaggtgtccgggctcatcctgggattcgtcatgctgatgcttttcgaaacagcttggaagatcaccgacctcgtcgactggtggcgggatgagtcgtaaaccaccattgtggatgcgccggctcgcgccgccgggcaatccggcgcacctcgtgccggccgtctgctcatgcggacggtggatcttcagcgaacgtgacgtggtctggcagtcatgggacgccggcatcatcgccggcgacgacctggtcaccgcgatcatcctcggccggcagctcatccggatccgccgcatcgcgcagacggacacgatcagattggagacggtcgcgggaccgctcggcatcagcccggacggaatgtatctcggcgcgcatgaatgcgggctcatgcccatcagcgtcaaacccgccgacatgagcggaagtgaattccactattcgacccttgaggggttcccgacgatgcggccggatcccgacaatccggacccgtgggcgggaatacccgaaatggaactaatgttcgattcaggatggccgaaatgctagaatcgcaacatatgggcgaaaaacgggaagcaaccacaacatgtagtgtgtgtggcggggagtgccgtatccaagccacgatgtgcgacaagtgcgagaacactttgaggggatggatccacgactatcccatctggatccacgccctgcgcgagttcctggattcgacggcgcattacggaggccaccagcctggacgtgtcaacctgccgtccgcgcccacgccgatcagactctcggtcgttgaccatctgcaggagatcgaggatgcggtgacggcgttgtggtgtcgattgtatgcgccgccggccatgccatgggccacaagcatcgcggtcccgccagtcgctgacatgctcaaggcatgctggtcttgccagcggttgaaccgactgccggacattggtttgatttggcatgactgggagcggttggcgcgcaagacgctgggcatcatcgacgtgccgccatccaggcacggcatcggcaggtgcctgaatcctctgtgcggcgtggagctgagtgcggaggttggagcggtaagcgttgactgtccggtgtgcggcaacacttatcgcgtggtcgatgtgcgattgggtttcctgcgggagtgcatcgaatcgggcagggcgttcacggcgggggagtgcgcggagctgctgcgcgagtgcgggttccagtgcaatgcgaacacgattcgttcgtggcgcaagcgcggcaggctccagccggccggtgagaacgagaagggacggccattgtacaggctttcggatgtgcatcggcaggtgctgcggcgcgattcgatttgacaaaatcgaaagtgcaacgcagaattgtcagtggattagagggttcaaaccgaggtgacttggtttgaaccctcactcatatccgccttggattctcctgactccttgggttacgtacccgtcctgtccgaacggcatatcggacacgctccgcccactcccgtcagagtggacataccccaatgtggcaggcaagccaatcccgcgcttccgtgatgcggtgaagctcaaatcgcctgtccatgccttcgtaggaatcagtggtagatcgtaccggccgcgagtctttattggattctcttccttgtggccgcgtgtatgcgcgggttcgaatcccgccgaaggcacccatgaaacaaatccggggtaggggtatcggcaaatccgggaggggtattcgcagatgatggggaacccctacaagacacgggagcggccgtatacgggagcccctataccggcattccggcaagccaacggcgaagatagtcgtcggcaaatccacggcactccgggtcccatacacgtgggaggccacatgagcaagcggcgtaacgagcgtgtcagcaacggctggcggcgcagacagctcagggcaagagtgctggccgcatacgacgtgtgtgccatctgtggcaagccagtcgacaagacattgaagacaccacatccgatgagcgccgaagtcgacgagctcgtaccggtctcacgtggcggtgatccatacagcttcactaactgcaggctcacgcaccgcagatgcaacaggttcaagagcgacaagacagacgaacacgcacgagcgctgctggctggcagacaggaagtgaaagcaagctcgatgccgttcaaaacgttcggcatctgactccgataccagggcggggaccccgggtatgccccctcccggtcgcctcgggtgcagtgccgatttctccccgcggattcaaacgtcggaaacaggggaaacaacgaaaggtcggaaagcgaggattacgccgatgaagtgcgaactctgcggcaaggaattccagccttccggccacgggcggcctcagaagtactgttccaagtcctgccgccagaaagccgattatcgtcggaaaaagaacaggcccgcacaggaccggaacagtaagccgcccgtcaaagccgtggaaacgaaacagaagccggagcaggatctcgaccagcggagcttcgaacggatgatggacggcagcatgctggacatactgcgagacaaccgtgacctgctgctcaaggccatggccgatcccacgacgccggcgaacgcgctgcccgcgatcagccgccagctcatcgccgtatgcgaccgcatcgaatcgctccaggtcggtggcctgaccgacctgctggacgatgaggaagacgaggtgacggacgatgtcggagcgtcgattgtctgaaatcgccaaggtcctccgccagccggaaggcatcgtcggcagcgagttcacgcgaatcaacaaagctgcgcgcaaggccggcatccgtttcgacttgtggcagcagggcttcttgtggcttctgttcgccaagaacgcggaaggcaagtatgcgtgtggcgcggacggcgccgtgctgtccagctgcaggcagatcggcaagaccttcaccgtcggcaccgcgttgttcctcaaggcgatactcacaccgaacctgaaagccatctggaccgcccaccatacgcgcaccagcgacgagacattcgcggacatgtgcgagatggagcataatccagtgctcggccggtacgtggaacgcattcgcagagcaaacggccaacaggagatcacgttcacgtccggcagccgcatcatgttcggcgcccgcgaaaacggtttcggccgaggattgcacagcgtggacgtggccgtgttcgacgaagcgcagatcctcacagtgcgcgcgatggacaacatgattccggttttgaacacgagtcctaaccccctggtcgtgtatatgggcaatccacccaagccgggagaccagtgcgatgcgttcacggagaaacgcatgcatgcgctgaaccatgacggaaacctcctctacgtggagctcgccgccgacaaggacgcggatccggacgaccgcgaacagtgggctaaagcgaatcccagctatccgaaacgtacaagcgaacaggcaatcatgcgcatgcgcaacaacctgtcggacgattcattccgtcgtgaggcgcttggcatatgggacgagaccgccaccgcatacgccatcagtcccgacctgtggcaggccgcggccgtcgacgacgtgcccgagggcggcacggtgagcttcggcatcgacatgcctccggacaggagcgtgctgaccatcggagcggcgctacgatacgcggacggttcggccatcgtccagatggcgaacatcaaggacgcgcggcaggcgggaaccatgtgggccgtggactggctcgctgaacgctggccgaagaccgccagcgtggtcatcgacgcccagtcgcccgctatgagcctgctgccggaactgaagaaagcacatgtgaaggtcatggtcacgaacatgcaggagatgggccgcgcatgtggccggttcctcgacatgctcaaagccggaacgctcaagcatccgcgggacgaataccagtcgcagctggccgcagccgtcaagggcgcgaccacgcgcccattgggacagtccggcgcgatcgcctggaacaaactcggcagtgacatcgacataaccccgctcgtgtccaccacactcgccctgtacggggcgtgcacgacgaagcgacatccgggaagacgacagatcatcggaggaatctaaatgagcgacatccagacaacggcagcgccggacgggtggaaacctacgggaggagccggaacggtgccgaaactcgtcgtaccgacgcacatcgacggactctccggtgaggagaacgcgttgctgcgtgaactcgccgaggtgtggacgcgccatgcgagccgcaaccgaacactcaccgcttactacgaggccaaggagccactggttgattttggactgactgtgccgaagtccatcaaggatcattacacgccgcttgggtgggcgcgcaaggctgtggatatgctcgccgagctttgcgtgttcgagggattcgtctcgccgggcgtggacgacccgttcgaactgcaggacttcatgagccgcatcggattcactagcgttctgcagcaggccatccagactgcactcattcacggctgttcgttcctcagcgtcgtccaggacttcgaaggaagaccgctcatccgcacgcataccgcggaaagctcggccgccgtctgggattaccccgaccggcgggtcagggcgtgcatggccatcaccgacgtcgacgacaacaatgaggccaccggactcgtgctctacatgcccgaccgcaacatcagcgtgcagcgccgtctcggctactggtggcgcgtggacgatgagcaacccaccatcgacaacgagtgcagtgtgttccgcctcgcctacaaggctaccgaggtcaaaccgttcggacgctcccgcatcagccgggacgctatggccatcatcgacggcgcgaaccgcaccatcgtgcgcgccgaagcgaatgccgaattctacgcgttcccaaaaatcctgctgacaggcacttccgaagaactcgcctcattgggcacggacgacgcgttaaagctttatatgggtcgctacaacatgatcagcaaggacatcgacgggcagtccccgaccgtgacacaactggccgcgtccagcatggacccgcacttgacgatgctgaaaagctgggccgccatgttcgccagcgcgatgaacattcccgccagctcgctcggcatcgtgtccgacgcgaatccgacatccgccgacgcgaccgaggcgcagcgcgaggacctgatcatcgaggcgcgccattgcgatcgcgatttcggtgaatcgatcctgcaggcagcccgtcttgtggcacggatgcaggatccatccgtgcccgacgaggagctgatgaaactgcaggtcgactggaagaacccgaacacgccgtcgagctccatgagcgccgacgcattcagcaagctcgctggaagcatcgactcgttcgccaacagcgaggtcggcatgacacgcgccggattgagccgaagcgagatcgtccggctgaaggccgaccagcgcaaggcccaggccggacaggtcctcgaccagattcgcggcatgcgccaacagacggagcagacgcaggacgacggggaacgccagaccgacgcttccacgcaatcaactgttgcgggggggggctgaaggacagcttcgacgcactgggagtagcgatcagagccggggtgacaccggaatccgcggcatcgatgcttggactgaaaggcattgaattcaccggcatgacgccggtcagcctcaaactaccggaaggcggcggagatgagcctgaacagtctgaacctgccgccggaacgacgcagaaggcttgaactcgacctcaatgatttgtacgaggattacacggacaccatgagccgcctgcagaaggaggccggcaacagtgtctcgggcctcgtctgggacggtgaaagccaggagctcatcaaagcggagatcaaccggtatgccgacgccgccagcaggctcgcatccgactactacggccacgtacgcgacctgtgggcgcagtacggcggaatcgatatgccggaatacgagccgccttccatcaccgccgaccgcgcggtctggcagatggaaggcggtttcaacaacactgacttcatgggattgcactacaaggatgtcattccagatgaaaacggagccgttcacaacaacgccggaagaaccatcgacgacctgtggcccacgttcgctgacgaggagcaggcgctggaatacgtgcagaatctgattcagaccgtcgggcggctgaccatgcagagggctgtggccaacgatcccaccaagcctcgctgggcgcgtgtgccgcgaggggctaagacatgcgcgttctgccttatgctcgcctcgcgtggcttcgcctacctgagcgaggacaccgccggacggcagatgcaataccatacggactgcgactgcgacatcgtgccaagctggggcagcagcaaactcaaaggatacgatccggacaagtatcgtgaaatgtaccaggcagccaaggctgcggccggcgatgacggcgactggcgtgacacgctagcccaattgagacgcatctatcacgatgaggtcaatgatggtgtgactgcccaaccgacgattcgatggagcggcaaatcgattccaatcagtgcttccgaactatcgagattgtcggattatagcgtcaggatgcctggagatagattctccaacgacgagaagatcgcggctttgatggattggaccggagacagctacaaaagtatcaacggctacctgttcggcggacgaaacccgtcgaaagacgtcatccatcaggtcgaatgcatcgacgaagcgatatccgaccatatcacccgagaacgtttcacggtcgacaggcagatgcggttgtcgacgttccacgtcaacgacatggagtcgcttttcgatttgaataccggtcgcaccttcgaacacatcggctacatggccaccagcatcaaggagggaggcattgacgttgatggggaagaccgcatcgccacaagaatcctggtaccgccgggaagcgccggcgtgtatgtggagccgatcactcagcatccgggagaatacgaaattcttctgccgagaggaagggctcttcgtttcgaagggcttggagcatccgacggcagaccgatcgtttatctgagactgctatgattgagcctatggatcgttccgaccgtttcacgtttatgcccggtgatttgaaggaagtcaccgatgagcgccatcttgcggaaatcaaacgcaagtatggcgatatctccatgccgcaggacgaatatgaatgggtcaggaacgaaggaaagaagcgctggtccgtcggcgactatgtgtcgaccgacgagctgcggtccgaatacgcgcgaagaaaagcgctgggaaatctctgaatcccagaaagccatcacgtcgaaacgtgatggcttttcttttacctttcacaccccagcgatggggcggggcgcagccatgcgcgaaaccaacaagaatggccgtcaactcgccggcgtcaggcgtggaaaccaagaacaagcaaaggagccaccaaccatggcagaagaaaaccagaccggcgcggacggccaacaggagccggaacagcactctccggccccaaaggacgtgaacaacgcgaagctgaggaccttcacccaggaggaagtcgaccgcataatcaacgagcgtctcggcagggaacgcggcaggaaaagcgactacgaggagctcaaggagaaggccggacagactgccgacctcgaatcgaaactctccaaggcgctcgaggagaacgagaagctcaaaagcgaagccaaacaggccgaacacgagaaggagctctccacgatacgcgccaacgtcgcggccaaacacggcatcaccgacccgagcgtcctcgcgggcgacaacgagaagcagattggcgaatacgccgagaaactcatgaaggtgttcgccgacatgcgttcccgcggcacggttgcggaccagagcgcccgcaccggacaggccaaggcgaaacgctccagccgtgaggacttcgtcaacgccatgagcaatacgctcctgtgattcaaccagcgaaaacattcatttgaaaggacaaatcatgacagatccgtccatgacccgaaaaagcaacggtctagacctcacccctgaaacccaggcggagatctggcagaccgcaaaataccagagcgcgttcatgcagctcgtgcccgaaatgaagctgcccggcaacggcgctcgcgtgccgatcatcatcggagacccggaggccgcatgggtcaacgagggcgccgagaagccgaagagcggcgtcaccttcggcaagaaggacatgctgccgtacaccatcgcggtcatcatgccgttctccaaccagttccgccgagacttcggcgctctctacgaccaagtggtcgcgaaggggccaggtgccatcgcccgcacgtttgacaagaccatcatgggtctcgtcgacgctccgggagcggacttcgacaccctgaagagcgcgcagaccgtcagcatcggcaaggacgtgtggaagaacctgaacaaagccgacgacctcgtgtccgaagcggatggaaccgtggacggttgggcgttgagcacccagggtcgcagtgtgctccggcaggcgaccgacaacaacggacgccccctgttcctcaacggcaccgccgcctccgacgtgagcaccgtgctcggcaaccgcacctacatcagcaagggcgttcacgtgcccgccgtatccgagacaccgggaccggccaaggcagagatcctcggcgtgtgcggcgaattctcctccgccgcatggggttccgtcgaaggaatgcagaccagcatctccgaccaggcgtccatcaccatcgacggcaagcaggtcaacctgtgggagcacaacatgttcgccgtgcgaatcgaaatcgaggtcggcttccgtatccgcgacatcaaccgcttcgtcctgctcaccgcctgacggagtccgacatgacggacgaaccagacgtgttcgccacctccgtcgacctcgaacagaggtggcacaaactcaccgacgaggaacgtgagaaggccgacacgcatctcgcggacgtgaccgactacatcaaggaacgctccccgaactggcaacgtctccaaaaagaacggccacgcctgctgacgaagatcacatgcgacatcgtccgcagaatcatgcaggccgacccgtacgacattcccggcggcatcacgcagatgaaccagaccaccggcagcttcagcgaacaatacagtttcggagcgcccaccggcgatctctggctgcgcgacgacgagaaacgcatccttggcatcaacgctcagcgcgcgttcagcgtcgacatggcaacgggggagacgtcctagtggaaaccatcgaagtgtggcgcggccagtccaccaccgacacggacggcaaccccatccagggcaaacccgtccgcgtcggcacgttccaggcgatggtcgcgccaacctctaccaccgaccagaccgaggagaacgccagcccgcagaccatcgaatacacgatccacatccgcggtagccagccgacaggcatccaagccaccgacctgatcaaagtcagaggcatcctcctgcccgtcaaaggcgaaccgcaagtgtggaacaacatccacggacgccacatcggcgacgtcatcaccgtgggcgaacgggaaggataacccatggccaaacgatgcagattcgtgttcaaccgaaaggcattcagccagcaggtgctgaagaacgagaccctgcggggccgcatgcgcgacgccgccaacgaggccgtcaccgacagccggtgcatggttcgcgaccataacggcgcgaaccgaaacggcgtggccatcctctgccccgcacccgtggagcaggcgaacggcacattggaggacacgctcggaaggatgcgcgtatgagcatccccatcaccccacggcgcacggagccgctgctcctgcccaggctgcgggagctgttcccggacgtgacgttcgacacgatcgaacgcaacgacctcgaacctcccttcaccgaagccacattggccgactccatgcaaggcatgagcactcccatctcccaggccgtgcgactgcggctgagcgtgcgctgcatgagagaggaccatacgggcgactgggacaaggccgcccgcctgtgggcggcaatcgcgagggagatcatcaggctcggaaccgtcgcgccgctcatcagcgcgtcactggaatccgggccggtacgcatgaccgacgaggacaagagactggtgagcgcgtacggcgtgctcctgctcgaggtatccgtcgcctgaactgaaaacacaagaaaagacaagcaaagacgtgccgccacacgcagaacggaagcgaggtgcagacaggaatgtctgacagcaacgaagaacccatcgccgtcgaacagacggcatccgaaaccagcctgcaggacgggctcggatcgaccgactatgggtacgtgtccaacggcaataccgccggcaacgtgcgtctgatcaagaactacgcgctgttcctgttccccaagggcgacagcactttcgtcgcgccgaccggcgtgaactggacgccgccgtccaacaagaagccgatcggatacagcaccgaggacggcgccgtcctgcatccggagccgggcgacagcaccgactacaaggcgcacaacggcgacatcgtcctgtccgacacggacccgggctactggacgctccagctcgccgcgatggaaggccgcaaggacgtggtatccgcctacttcgacgtggacgtggaatccgacggcggcatcagcatcaagggcgccggcctgaagaaggaatggatcctcgtcctggtcgcgctcgaccagcaggaccgccccttcctcctgtacggcaccaacgcgaaggtgtccgaccgcgacgacgtgagcctgaaatccagcgagatcatgaacttcagcatgacgttcaagatgctcaagggcactaacggcgaacagttccacgcatggggcctcgtcaccgaagacgccaagtagcccattgattcttcccgtgcggccgatggcggtcggccgcacgggaccattacccataaccgccgataaccatgaaacggagacgaaatgagcgacaacacctaccatgtcgtggacgtggaccttaccgacgcggaggagctcaaacccgacgtgcacctcgaggtcgccggagcgaaactcgacctgccgaacctcaacaacgcggaactgcccatcgaactcgtgcaggccatcctcctgatcaaaagcaagcccgcattgtccgacgaggaaaccacggcctgcgtgagcacgttcctcgcctacttccagacgatgcagccgaacttctggaacgtgctgcgcaagaccaaacgtccgatggcctacctcaccgcgaccatcaaggcgtgggccgaggaatccggactggacccaaaagcgtttacctcgcccacctctggaacaacaatcgcgcggcactagcctacgactggatccgagcgtacgggcagatctacaggcccgtacgcttccgggaatgggttgaaggccaaagtccacgagtcgattggggactcgcctgggcgttgacccgcgaaatcctcaaagaccatacgagccactcgtggatggcgttgcagaacgccgtctacgcgcccgacggagccgaacaggcggtctggacgctgtccggacaacgcaaacgcccatggttcgaccacgagcacgacccgctccgcccgccaaccccgacgcacaacctcacccgccgtcaacgcgaggacagggaacggctcaaagcctacttccacatcaacgacgacctctgactccgaccgccatcggaatcccaacctacgaataaggaaacacgatggcagcacaggacatcggcgtcgcatacgtccacgtcgaaccatccggcaaaggattcggcaaaagcatcgaaggcgacatcggcgacgccgtcagcaaagcctccaggaaaggctccaacaccctcatctcgaagatcggcggcgcgttcggcaaaatcggcaaggtcggcacaggcgcgatcgccaccatcgcaggcggcatcaccgcattggccgccaagggcggcttcacgcgcgccctcaacatcgagaacgcgcaggccaagctcaaaggcctcggccacgacagcgcgagcgtcaccgagatcatgaacgacgcgctcgcatccgtcaagggcaccgcgttcggattgggtgacgccgcgaccgtcgcggccagcctgtccgcctccggcgtcaaggagggcggcgagctcacacaggtcctcaagaccgtcgccgacactgcgcagatcagcggccgtagcctgaccgacatcggcatgatcttcggctcggtcgccgcccgaggcaagctccagggcgacgacatgctccagctcatgtcgagcggcatcccggtcctccagatgctcggcaagcatctgaacaagaccagcgccgaagtgtccgacatggtctcggacggcaagatcgacttccaaaccttcgccgacgccatgcaggaaggcctaggcggcgccgcactatccgcaggcaccacattcaccggcgccctggccaacgtgaaagccgcgttgagccgactcggagaaacagccgccacaccagtcctcgacggcttacgcggcctgttcaaccaagccatcccactcatcgatacattcaccgcagccgtcacaccaaccctgcaaaaagtcggagcggcactccaacaaggtctcgagaacgcgatacccgccacacaggcgaaactcaaaaaccttggcgacacgatctccaacatccccggcttccagatgctcgcctcggcgacggccagcctcaaaagccaactcactggcctctggaacgcaatcacatcactcataggcggactcaacaatggcggcgaagccgccacaatgttctccacaaccgccggcgcgctcgcgggagtggtcgcttcggtcgcgcaggcgttgtcgaacgcggcgggatgggcgaagacgttcgtcaacacgttcatcgagacgggcgcgttgcagccgttccttgaaagcctgaccggcgtcatctccggattgggctcgctggtttccgtattggcggccgcggtctcgcaggccttcggcttcaacgacagcgcgcgcaccgccagttccgcggcgcagagcttcgccggactgttgaacactttgaccggcgtgctcatgacggtgggaggctggctgcagtcggtcggacagtgggcgcagcagaacggcgcactggtatccggcgcgttgaaagccatcaccattgcattgctcgcggtcaaaggctgggatatcgtctcggccgggctgaagacagtttccggtggactgaaggccatttccgcgactgcctccggtgtggagaagaccgctacggccacgttcgatttgattggcaagatctccgacgcgggaagcgcggctggagcactgaagcaactcgccggctcgttcaatattgtcaaggcagctcaatcggcgtggagcgcggtgaccaaggctgctaccgccgtgcagctggcattcagcgctgccttggatgcgaatccgatcggcatgcttgtcgtggccatcggcgcggtcgtggccgcgctgacatggttcttcacccaaaccgaaacgggcaaacgactctggaacagtttcgccacatggttcatgggaatctggaaccagatcagcaccgcatgccagccaatcctgcaagccatcgccatattcatcacccagaccatgagccaaatccaacaaatctggcaaaccggatggacactcatcaccaccgtcctccaaaacgtctggaacacgatcggccccatcatcatgaccgcgctcaccgcgatcatcaccggcatccaaacattcatcaccaccatcacaccactcctgcaagccggaatacagaacatccaaaccatcttccaaaccgccgtcacaatcatcagcacggtctggaacggactctggaacaccatatccaccgtcgtacaaggcgcatggaccatcatcgccacagtcatcagcaccgcactcgccgtcatccaaggcatcatccaactggcgctcgcggtcgtcaacgggaactggagcgccgcgtggtcggccatccagggcatcgcgtcggcagtgtggggcggcatccaaggcgtcgtctccgccggcatcggcatggtcagcggagtggtatccgccgcatgctcgacaatccggagcgtgtgggccgcgttgtggaatggcgtcggaagcattgtgtcgagcgtctggggcggcatcgtcggcaccgtaagcaacatggttggccgtgtcgggagcgtcgtgagcgggatcggcggaaccgtccggagcgcggtgtccggcgcgggaagctggctcgtcagcgcgggacgcaacatcatccagggattgatcaacggcatcacaggaatggtcggctcgttgtattccagcatcaccaacgcgttgtcgggcttggtggacaaggccaagaacgctttgggcatccattccccgtcgcgtgtgttccgcgacgaggtcggcgtgatggtcggacgtggcatggcattgggcatcgacgattccgcgcatgtggtcagccgttccatggattcgctcgtctccacgatgagcctctccgacgcggactggtcgaagaccggcaggctgaacgtcacggccggcaccggcgccaatgccggcgacggcgatctgcgggaactcatcacggccgtcgaatcgttgcacgacgacctcggatcgatcatcgccaggtacacgccgacgataggggaccgcgacttcgcaaggaaggtgagaagtgcaatcgcttgaatacgtgtgcgcggccacaggtgagcgcatcggcttcgaggggccgctgtacggcgagacgctcacgggactgcgcgcccgcgtctgggactacagcctcgcctcacgtggcatgacgggcatcacccgcaaggcacgcgaggcgacagtcaccgtgaagatccacgattctccagccacgctcgacctactgcgccgcctcgcggacgccgacatggcatccgggaacccgggcacgctcgtggccgacggcgaatgggaagccaaagcgtggatcacgaaaagcgaaccgcaatccatcacgcccacgatggtcgagacgcagttgaccatcgtgctggccgatggcgtgtggcgccgtccgaccatgacgcatttcacgccgcgatacgattccggaaccgccgaccttgactatccatatgattatccgcatgatttcgccggcatggcattgggtgccgagatcgtcaacgacacgtccatcccgcagccggtcaaactcacgatattcggaccatgcgcgcaaccgtacgtcatcatcggaaacaaccggtacgaggtcgacgtgaccgtgccatccggctcgcgtctggaaatcgacggcaccggcgatgtcaggaccgtcaccatggtcagcggcacaggtctcgccacaaactgcttcgcgcaggccgtgcgagggtcgggcaaggattccggccggtacgtgttccaaccgctcgcgcccggaacacagccgatcagctggccgggaggattccaattcgacttgacggtctgcgaggaaaggagcgaaccgccatggacctgatcgtcaccgacgccacaggcaaacccgtggcgagccacgcctcatacacgctcgacctcgcgttcggtagcggggagaacgacttcgacctgcaggtcgaagacgccgcgctcaaggcggggagccgcatcatgatcgacggcaccgagtacggcggcatcatcgacgacacggatgtcgacgtggacggaggcctgtccaccgtcacatggcatggccgcgactggcatggagtgctcgcctcgaagatcatcgaaccggacgggaacaacgattacctcactctgtccggcacgattcccgtcatcatgcgcacgctcgtcagccgtgcgggattgcaaggcctgttcaccgtcaccgacgaaagcgccgaccacaagaccacctgccagttcgaccggtacgtggacctgtacagcggtctggtcaagatgctcagggcaagcggactcaaactccggttgcgtaatgacggcgacaaggtggccatgagcgccatgcccgtccgcacgatcggcgacagcatcgactcggacctcatcgacttcaccgccaaacaggcggcgcacccgatcaaccatctcatctgcctgggcaagggcgaactcaaggaccgtaccgtcatccactggtacgccgacgcgaacggcacgttcagccacacgcagaccctcaaaggccttgacgaacgcaccgccacatacgagttgtccaacgccgaagccgacgagctcgaggacaagggcaggcagaaattccaggaacttcggaacaccagcaccatcgacgtggacattcccgacggcatcgacgcggacgtcggcgacctggtcacgggccgtgacaacaacacgggcctcgtcgtcactgccgagatctccaagaagatcgtcaaggtttcgggaggcgtgctcaccgtcacctacgaatccggaggcgccagcgccggcggcaacagcggagaatcctccatcggggatggtggccacgcctactacgctggagccggcctcaagcttgataattggaccttcagcgccgacgtgaccagacaggacatcggtgcgcttaatacggcgttggcgggcaagcagccgaaaggcgactacatcaccggcctgagaatcggttcggtggacacgctcgcaccaggcgcgcaggccagcgcgtcgcttaccggagatggcagcgacaagaccctgaacctggggcttccgacaggcggtcagggcgcgcaggggccaaaaggtgagaaaggcgatcaggggccgcaaggcgaaaaaggcgagaagggtgataccgggtccagaggagcgactggagcggccggtgaacgcggtccacagggcttggcaggcccggaggggccacaaggtctgcagggcctgcgcggggagaagggcgacgctggagcggccggtcctacagggccgcaaggccccgcaggtccaaccggtctaacggggtccaccggcccgcaaggaccggtcggaccggttggtccgcaaggcaagcagggaatacaaggagtccaaggcatccaaggtccgcagggcgaaagaggtgaaaagggcgacagcggcatatccgctccctcgaacggcttcttcacactcagcatggaaggcgacggtgacctatatgtgaattatccggataatacgagcccaccatcgttcacttgggatcccaagagcggcgacctgtatgtggatataccagaaaggtgattaatgaccaggcttctaatcggtaatatcaaaggccccaaaggagacaagggcgataccggtgacaccgggccgcaaggcaagcaaggaatgaaaggcgatacgggagccgtcggtccccaaggacctaagggcgatactggtgacactggcccacaaggcaagcaaggcgtccagggcgttaaaggcgacgtcggccttccggcgctcgtgatgaaaaagatactcgttggcgaatatccggcaggcgccatattcacgggaaacgtgagcgaatggttgaaccgaacaccactcgtcaatgaatattcgaccgcattgtcaggtggcggaaaatacagcatcatctggcagtgcgtttcgcaatccggcggccagttccaagggaagacggtttccaggcagtccatcatcggagcgcaaggccctgtcggcccgcagggtccgaagggtgacgtcggcccgcaaggtgtgaagggcgataccggcgagatcgggcctaaaggagccactggagctgccggacctaccggtccgcaaggtcctgaagggctgaagggcgacaagggtgacaaaggcgatgtcggcccctccggagaaggaggccccaccggtcccactggcccggtaggtccgactggtcctgccggacctaccggagcaacaggccccaccgggccgcaaggcaagcagggaatacaaggtgtgcagggactgcagggcccacagggaccgacaggaccgcagggtgccagcggcgtgacggcaccaacctccggattcttcacactgcaggtcgacccgaacggagacctgtacgccgtgtacgcggatacgaccaccgcgtcagaagctcccgtctcctacgatccggcgacgggcgacctgtactacatgatcaatgacggaaagtaaggagcgcatatgacgaagattctgctcggcaacgtcaaaggccccaagggcgacaccggaccgcaaggcaagcagggagtgcaaggaccgcagggccctgccggcgccactggcgcgaccggggccaccggagcgaaaggagaggccggccaacgcggcgagaccgggttgcctgccttgatcatcacacgcatactatccggatactggacgtccgcatgctcggattttgactggcgggcactcagtttcaaccgtgccccggtcgtaggcgaatacttcttcgccatgaccaatggcggcaagaacctgatgtacgcacagatcacagccaccgggaaaaacgtgacgttcaaaccggtttccaacacaagcctcgtcggcccgaagggcgacaagggcgagacgggcatgagcgcaagccaggcgttcatcgccgcccacccggtcggctccctctactggaccaccgccacaacaaatccgggaaccacctacggcggcacttggaaggaatgcaacaccatccttccaggacacatctaccagcgcacagtctgaaagagaaaggaacatcaatggcacgaaccacgaacatcaccagatacacctgcgaccgatgccacgcctccgcatacctcgccgacggtgacccacgcacctccagcgactggcacgacatcacccacaccaccgtcgacggagtcgcacagggcgcgctcgtctgtaccgcatgctggcagacgttcaaagcgctggcagccacgcaggacgccgcctacgccgcatacctcaacaacacaacagataggaaggaatgaccatgaccatgaatctcatcaccggcaaggccggcgctccgcacatcacatccagcgaccaaggagccatgcaggccggactggtcggaaacggcaactacctgctgcaaggcagcgacggcaaattccccgccgtgaccatgcagtcagcaaacaaagcgctcatcccggtcctcaaccttgtgatcgaaggacgatacgcacgcgtcaccgcggcggaaaccgtcaccatcgaaagcggagtcacaggacggaaccgcaacgacctaatctgcgtgaaatacacgcgagactcgaacaacatcgaaacgatcgcgctcgctgtgttgaagggcaccgccaccagtggcacggcggctgatcccacggttccgtcgggtagtatcctgaacaattccggtaccgtgtggattccgatcgcccgcattccgatcagtggcatcaccgccggaactcctgtcatgcttgtcaagcagttgcctccgatgagccagctgtgggattccgtaacccagccatggaaacctccatacacgaacagcagactcactctatgtcgcgtcggacgcatcgtcacgatcaacggcaacgtcaagttcgacggcagtggacagcagaactactcgacggcgaatgagaccatcccagaagcgttccgcccgctcgccgaccagagcatcatatcgttcccgtcctgcggtttcagcctgcttgtcatgcgtgatgggaaggtgcagatgcttggcgacccgaaatccgcttactccacggcgcacggctgttggatggcactgcaatagctttccgtaacccagactttgattaaatcacagtatggcaccgtgaccggcgtgaagtctggcaagatcgcgcagattagcatcaactggaaaagcgcgagcactgactcgtggggcagtggacagttcggtacaattccggagggttggaggcctgcggtcgtcacgcatggtacgtggtcggggcgtgatggtggcagccagcgtgatttcattctggaaacgaatggcaatttccgttatgccaattgtggcgcggtgcagaacagcggcacgttctccgggacgatgacctacattctcgcctgaatagctttccgtaaccctttccgcgccgaacacgaactggaaagtggattaccgcaccgccttggtcggcaggatgcttctagtcgcattccacgccaatcgcctcaacgccgattggaacgcggcgaaagagtgggaggtgtcacagattctcaaactcccagccggtttggaggcggcgttcgaggtacattgcgccgcaatatctaattcgagcatcggattgcatggcgtcgaagtgcaggtggcgcagcacaccatcgccttgcgttcctcgggaaagatgacagtaagcgcaaacttgggatgggtcgaaggctgtatcacggtgccacttgtctaggagaacgtcactccactaggaatcggcatggaaaaacgctgcatcagaatgttctccctgccaaccccgccaagtaacgtaatactgccatccggattccaattcgcttgcttgttgtagcgcggatccgcaagacttgatccaacacatcccagtccaattgtggccgatggacgtatccctgactgatataaccagaccgtatagttcgagacttcgacggttgatttgaaagagctcaaatcgacatacagcatgttgcccttgacggtaatcgtgttggatccaccatatagggcgccaacaaacgatcctgtgtcctgaaacttaaaggtagcagtgagggctacggaaagctagaaatcatgggattgggaaacaaagcgtgccggcgcaatcctgattgctgccaacgtttcccatgttcgccactcggatagttccatcagctttggccgtgaggcttcgcgccgtttgcccatttgatacaaggcagacagtcgacaagtcaacgatgggacgataccaggactcgagctttaccggacattcaacagcatcccaactgcccgaaccgattttcccactgaacttgatcaaaatcatcctgccgttacgtatgatgatccaattggaatcctggtacagggttacggaaagctacgcggctccgatgatgagtctttcccatgcccgctgcagacttctcagcacggacaaatcggggcggagatagtagcgggcggttgtcttgatgtcgctgtgaccgagttgtcgtgcgaccactgagatatcggctcccgcagcgattgccagagtgccgaaggtgtgcctgaggttccttggcggcacgcaggggagtttcatgcgttggcaccatgacgtgtaatgagctgccacctggttggcgttcagatcgccgaccagcctgccggttctgccgtggcgcaattgcgcgagccgtttgactgcgaaccgtggtagtgcgaccgtccgtcggctctggtcggtcttcgggtcggtgaccgtttcatgtccagcgacccattgcactgaccttttgacggtcacgattccccggcgtaaatccaagtcggcccattcaatgccgacggactcgcatcggcgcagtcccgcgcagacggagaccaataaccaggcttccaacgcgtgaccgtagaagcctttgagcagccgtcttacctgtctggcgtcgagcacgcgcggctcataccgccgcaggtgtggcagtctgatttcacgacgtgtcacgtcattgtcggtgactcccttgcgataggcgagtcggagtatcgcccgcagcacggcccacgccttgcgcgcggcgccggcctgattgaacgagccgagccactcctcgatgtcgttcgcggtgatcgactccatgtcgacgtcagcccatttcggctggatgtggcagcggtaggccgactcgtagcccaccctcgtgcactcgcgaagcttcccgcaggagggccaccagacctcatccacaaacgttcccaacaacatttcaacctccaaaatcccacacgtggttatcgcagcttccaacggtagccacgtgtgggattttcctttcggaaggattcccaatgagccaggaaaccatcgtcgcaatcgttgtcgccatcatcggcagcggaggcagcggcgtgttcgtcacctggattctgagcaaggtcgaccaacgtcacgatccactgcatgagggcgtcagggaactgttgttctgcaaactcgaggctctgcaccgtcagatggtcgatgcaggtggtgttgcgagcattccgttgaagcaaagcgcggaacgaatatatgccgcttaccacggtctgggcggcaatggaaccggaacctcgatgatccaagacatacgtgacgcgcatatcgcgaacacagattgaaagattcaaaagatttccacaccgtccgtacaaggcggacggtacggacaaaggaaaggagaggaattgaacatcctcaacaaaggcaaaccgagacacaagcacatgaatccacgccgacaatggcgcaagctactgaccgcgctcacggtctccatctccatggctgtcgcgccagccgcgatggccgacatgaacggatacgacatctcgaactggcagtgcggcatcgacaccgcgaccgtgccggcagatttcgtcatcgtcggcaccacatgggggtccggcggcgtatacggtggttgcctgtccaacggcgtcaacaccgacgcgaaccgtcagctcgccggcgccgtcaacagcggcaaggagaccggcgtctaccattacgcgtgcggcggcaaccccgagaccgaggccaggttcttcgtcgacaacgtgcgaggatatattcgcaaaagcgtcctgatcctcgactgggaggcgcaggacaacgccgcctggggcgacaagcagtggccacgcaggtgggcgcgcgaggtcaagcgactgaccggcgtgaaccccatcatctacacgatggactccggctactggcaggtcgccggcatggagaccgaactaaactgcggcatctggatcgcccagtacgccacgaacatggtcaccggctaccagactgcgccgtggaatatcggcgcccgcggcgaggtcatgcgccagtacacgtccaacggcagtctcagcggctggtcaggacgcctcgacctgaacaagttccgcggcgaccgcacggcatggcgcaagtacgcgaaccctgacgacaagggcgcggcggatctgccgagtgtcaagccgaaacctcagcccacgaccgctccggcggtcgacctgaacgctttggccacgcgcaccatccgcggcgatttcggcaatgatccggcccgcaggcaggcgttgggtggcaattacgcggcggtcatgcagatcgtcaacagtcgcctcggcggaggttccggcggaacggccgccacgggttcgcgtagcgtcgtggtccgttccggtgacaccatgagtgcgatcgccgcgaggaccggactccagccggtgtccgcctggcgtgtgccgagcggtgacatcaacaggatttatccgggacagatcgtcacctatggcggcgcgtccgtgtccaccgcttcgagcgtggtcggaggccatgtggtccgttccggcgaaagcctgtggagcatctacggctccggctggcagtcggctgccgcacgcaatggcatccgcagcccatacgttatctatcccggacagtacctgcgctgaaactcccgtctccacgactttaagcgttgtggagacggttgccgcaatgtttaaggaggtgaaaaatggatgaatccaatagcccgcaattcgattacctgctgccgggcagggtatacgacatactcaagtggctcgcgttgatcgctttgccggccgtcgcatggctcgtcggagcggtcggcccgcaatggggactgccacactgcggcgaactcgttacgaccatcaacgcgatcggtttgttcgtcggcgcgctcatcggcgtgagccagctcacggcagccaagccggacagttccaacgaaaaataagtgttgcacctgtttcaggcccaacacttaaccgtgagtgattcgtaccctcatgtaacacgcgcccctctctcagcattgcggcgatggtactgcactcgagagggtgtgggagagtagcacgccgccgcttcaaacgttgggggttcccgtcgagcatcctgctccgggaaccccattttttatccctgaacacaagtagggcgcaagcgttttatcgcaatgggtttatagactgggcaactatgcattacttcgtacccaaacgttgcaccgagtcgaacaagatcatgtatcacgacaaggcaacggctcagcaggccgccgaccagagttggcgcgaacgcggcactgagctttgggtataccgttgcgatttctgcggtacttggcatctcacgcatcgcgatccacaatccagctacatgcatgttccgcttaaccagcagctcaagccacattcccgcaagaagggctacaagccccgcagaaggtaatagcagagcaatagcagggcataacaggacaataccgagaacaaggcaacatataaaaccaaggcccggcggattcattgcaatccaccgggccttgtgttgtatcagcttcgtatcaatgatacgagcgctgccatgtatctaccgctccaaacggaagccctgtcgcttcgcctgcacggcaacggccttggcgttcacgccctcgtcgatcgcatttgccgcaatctggtcgctgaacgcgtccaccggccgttcagtatcgcgcaaatcgtaatacttgtgcacttcggcgtcgaacgaatccaagccggacagcagcttctcatcgctacttggatactcgttctcgaagaactgcatggaacgcggcatacgcggcttgacggccggctcctgatcgggcttgccgatcgcaatgcccagcaccgggtacgtgtattcgggcagattcagcaggtcgatcagcgcgggaacatcgttgagcagcgagccgagaatcacgcaacccaagccgagcgagtacgcggccgtctccatcgcatgcagtgccagaaccgcgtcgttctgcgcctgcgtgaaacgatagctgccattgagcgtgaacgcgtcggacgccacttccacgcccttgcgcgcggcgatcgcggcattgcgatgctcgtccagcacgaacacgtacagcagcggcgcggtcgcgatatacggctgcccgccgatttcggcaagacgcttcttggtggctggctcggtgacgcggatggcggaccagtcgttcaggaactggctgctcgccgcatgctgcgccacggtctccaacgtttcgacgacgtcgtccggcagcggcttcggcttgaatttgcggatggaacgacgctccagcagagtgtcgacggttgcgttatgaagaatgttgctcataccgccattgttgtccgcgcggcgcgattttgcaagggaatcgggctaaatccgtctccctgtgagaacatatctacttgagactgctttgcgatatttgcgacgtatttacttgcgatgcgcctgccgtgcgtgccgcctgtccacaatcgccttcgacccgcggccggacagttgcgatacgagcgcgccgaaaccggcggaaaccacggcgaatacgatgccgagcgccgcttccgcagcctcgttcttggtaccgtcggcacggacggccttgcggccgacgcttttcttccacaccatctcgaacgccttgccgagcaccagtccggccaacgtgggcacgacggacttgaaaatcttatcgccaaatgaatcgggatcgttcagtctctggtcgcgcatcgcattcaccttctcgtcgacggtgtgcagggccgccaccacgcggtccgcactggattccatattcggcatttcactcatgaaaccagtgtaacgcgtcggaaaacatgccggaatatgtgcgggacacgtggcggaatgggatgaaaacgcagcttgcgtcggctagagtagagacatgactgaaactcaactgggaggcaatgccgcttccgcaatcacccctggccgcttggtgctgctgcgtcacgggcagaccgtgtggagcgaatccggacagcacaccggccgcaccaatattccgttgactgacattggctgcgatcaggctcgtgccgccggcgaacggttgcgtgaggcgtttccccagggtttcgcgcaggggtgcatgttcgccagtccgttgcgcagagcccagcagacggcgcagctggccggatatggcgatttcgatgtgctccctgaaatcgcggaatgggattacggccgtgccgaagggcgtacgcgccaggaagtgagtgcggtgggcggtttcgcttgggatgtgtggcgcgacggtccgcaggcacttcccgaatcgttggaaggcgattggattgaaactttgccgaacggcgagcaggtgcccgtgcacaacggtccgggtgagacggtggaggaagctgcggcgcgcacacgtgaggcgatcgccacggtcaaaccgttgctcgacgctggaaacgatgtgctgctggtggcgcatgcgcacgttcttcgtatcttgacgtcgcaatggctcggtgttgatccgcatttcgcgcggttgctgcgattggacactgcgcattattgtgtattaagccaatataaaggtgacaatgtcatcgaacattggaattgctgaattattgaacggaactgtttgatatcgctgaatattatggcggtccctccttggaaccgcctctttattgcatgcatgacttgccactttgctgcggcgtgtcgcaaacgcttgcataaaagtatgctctctaaaagtattgaaaataaatgattttcgggatttctttcgatggtatgacgtctgacttttgaattcattttgcctacgtttgcaaaaatcgggggaatgcggcataatagtggttgttaggaatcgtgatgacgcgataccgcaaattgtttcccaacgagaagctgggaacaggaatggaagagaaaggttcgatgatgaatcgtactattaaggcagcagttggaatggtcgctatcgcggcaatgtctgttggcacgttggctgcttgcggtggttctagctcaagttccgataacggcaagggcaaggtgtacttccttaacttcaagccggaatccagcgacgaatggaagaagctggccaaggattacaccaaggaaaccggtgtcgaggtcaaggtccagaccgctgcttccggtacatacgaacagactttgaagtccgagatcgccaagtccgaggctccgaccttgttccaggtcaacggccctgtcggctaccagaactggtcgtcctacaccgaagacatgtccgatactgagccgtacaagcagcttatcaacaaggatgtcgccctcaaggatggggataaggtcgtcggtgttccgtatgccatggagacttatggcctgatctacaacaaggatctgctggccaagtacattgccactgacggcgccaagatcaagagcgtcgatgacatcgacaacttcgataccttgaaggccgtggccgatgacatccaggctaagaaggaccagcttggtgtcaagggcgcgttcacctccgccggcttcgactccagctccgactggcgtttcaagacccatttggctaacctgccgctttactatgagttcaaggatgacaacgtcaccaagcagccggagaccatcaagggcacctacctgccggaatataagaacatcttcgatttgtatctgaaggactccaccaccgagccgacccagctgagctccaagaccggtgatgattctacctccgagttctccctcggcgaggctgtgttctatcagaacggcacttgggcatggaccgatctgcagaaggctggcatgaaggccgagtccgtcggcatgatcccgatctacaccggcgtcaagggcgagaagaaccagggtctggccaccggttccgagaactactggtgcatcaactccaaggcttccgacgcggataagaaggccaccaaggacttcctgaagtgggtcgtcaccagcaagaccggcatcaagtctctgtccagcgacatgggcttcactaccccgttcaagtccttcagcgacgtcaagtccgacaatccgctggtccaggctgctgttgatgatcagaactccggcaagaccgcagtctcttggaacttcaccatgatgccgtccgaagagtggaagaacaagcttggttccgccctcctcgaatacgctcagggtaccggtgactgggatgccgtcaagaccgcgtttgttgacggttggaagactgagtacgacgcatctcactgagattgtgttgcaccatgagttgcaaatcgcaattcaataactgaataagctagctgcggtcgaggatttttcctttcctctcttcgccccagccggttgtggagacaacggaaggccgtcatcgcaatgttctgcgatgacggcctttctgtgtttcgtacgtttgccgtgtgcgcaatgtgcggcaaacgtcagtgacgcagtctggcggtggtcgatcggacgattagctgtgcgggaaacgtcttgaacggctcgtcaagcggctgcttgtcaatcagggcaagcgtcatacgggccgcctcgtgtgccatctcgaccggtgtctgacggatggtggtcaaaccgagatcgcgagcgtaggtgctgtcgtcgtagccaatgatggagatgtcgttcggtattgtgaaaccgttgcgttccagctggaacagtagcggaattgcgatgccgtcttcctgacaggcaatcgccgtgggcatgtggtccgagctgagcagctgcgtgacgactttgctgatgttgttcttgccttcgtcggtaacgaacacgcgcggttcgacgccattggacttgcagcacgtcatgaacgaatcgaaacggccctgcacgctgaagtgcagcgtcacttcacggtcggtacggatgtaagcgatatcgcgatggccaagcgttatcaagtggcgtgcggccaattcggatccctgcttgtcatcgatgcgcacggcggcgttgaagccgcgctcttccggcaagctcgaattgatgccgatgattggcacatcgactgacctgagttgcctgatttcgttgctgtcgatgtcgaaggaaatgacgattacggcgtcgacattgcggcgtaccggcagcatgtcgaagaacgcgcggcgttcctcggcgctggacatctgatagatcgagatgtcgtagccttcatcatggaaggattcgttcagtccttccatgatggacgaactgaaccacagattgagtcggccggaaatcagcaccgcgattcgtagcgcgcggccggttttgagtgctgcagcggagcgcgagatggaaaaatttaattcgtcggcggctttcatgactttgtcacgcgtggctttcgacacaagatcgggacgtgtgaaggagcgagaaaccgttgaaatggagacgtgcgcaagttgtgccacgtcttgaatgctgcttttcatggtgaccccttgtatagtagaactactgaatattcagcatactgtattgaaacactcttgcaaaagttggattacaaacgttttcatttgtgccacagttgttgcggggctgatatttacaatgctttcaggctgtcaatactatgacaacgatgcagaatatatgatttatgacatgtaaaaatgacaacgtttgacatttcgcgtcgcgctgtttattataacaactgtaaaaactaaaaaggcgaaaaacaatgcagtgattcgccgatttggggcagttggttttccatgccgcgttgctgcggtgttggaatggagaggaaagaaagcaggcaagctatgatcagcatggccggcaaagcgatacgaaagtggtgggctctgtttgcgctaccgacgttcgctgcatttatcatcgggtttgtaatcccgttcatcatgggtgtgtatttgagtttctgcaagttcacaactgtgactgactcgaaattcattggacttaaaaactatcagaaggcacttgcggataaggaattcctgcatgcgttaggtttctcgacggcgctgaccattgtcactacggttgtgatcaatgtggttgcgtttgccatcgcatatatgcttaccaaggccatcaagggatccaacatcttccgttcggtgttcttcatgccgaacctcatcggtggcattatcctgggctacatctggatgctgctgctcaacggcattctcgctcactggggccgcgcgttgacgtatagcgcaacctacggcttctggggcttggtcatcttggtttgctggcagcagatcggctatatgatgattatctacatcgctggtatgcagtcgctgccgaccgacgtgctcgaagcggcttccgtggacggcgcaaacggcacccagaccatgttcaagatcatcattccgctgatgatgccgtctatcaccgtatgctcgttcctgtgcgtcaccaacggcttcaagctgtacgatcagaaccttgcattgaccaacggcgctccgtcgaacatgtctgaaggtctggcaatgaacattacccgcacgttctacggccgtatgggctgggaaggcgtcggccaagcgaaggcagtgctgttcttcattctggtggccatcgtggcgctcatccagaacaagctcaccacgagcaaggaggtggaggcatgaactccggagaaaaagtcaagcacggcgcactgtggtccgtactgttcgcggtggtttcgctggcgtggatcttcccgatcgtgctggtgatcatcaactctttcaagcagaaggcgtatatttctcgtaacgcgttctccctgccgaccggtaaggcgttcgttggacttgaaaactatacgcgtggcctcgataccacgaacttctttgccagtttcggctggaccctgctcatcactgtcggttccgtggcgctgattctggtgtgcacttcgatgtgcgcatggtggatcgtccgcgtgaacaactgggctgcaaagctgctgtacacgttgttcctgttcaacatgattgtaccgttccagatggtcatgttcaccctctccaagctggccgatatgctcaagctcaacaccccgtggggtctgtgcttcgtgtatctgggcttcggcgctggtctggccgtgttcatcttcaccggtgtggttaagggcattccggaatcgctggaagaatccgccatgatcgatggtgcttccgtgccgcgtatcttcttccagatcgttgtgccgatcatgaagccgtccattgtgtccgtggctattctgcaggccatgtggatttggaacgactacctgctgccgtacctgacgctcgatttgagcaagtacaagaccatttccgtggcggtgcagtatctgaagggcggttatggttccgtggatatgggcgccatgatggcatgcctggttatggccatcatcccgatcatcatcttctacctcatctgccagaagtacatcgtcaagggtgttatggctggagccgttaagggctgatcttcgatcagcccttagggaacagcgcagtgcgctgttcccaggctccagcccgagcggctatgccgcgagggtaacgttgagcccgcgcgtagcgcggtccttaattgcagggccgaaggcggcgcggtgaagggctgattttcacccagaaaaatttaagggactgatgcgaatcagtccctttttcgtgcctaattacttgctgatgtacttgcggaagacgtgctcgaggatcggcgaatgaatcatcagcatggtgccgtagccgagcacgagcagcaggaacaggccctgcggcatgtagaaccagctggccacgagcagcgcgacgtacaccgcgtcaatcgcaatcaatgccaacgtatgcccgatgttgctcacgccgaacacaaaagcgttgccgagcgtgcgccaaaacgagttttcgaaacgtgcctgcaatgcccaaacccattcaaaaccgatcagccatacgatcgtcagcgcgaatttcggaatcagcagcggcgtgatctgcagcacgatccacgagtagacgcacagcgcgccggtcgtgccgaaaatcagccagtagccggttgatttcgcgaaattcgagcggaaggcggcgaaatagttgcgcgtcgccgtgccttcgccggacagcgtgcggcgggtggcgtcgtggccggcggtcagcgccgcgccgatcgtaatgatcggaatactggtgatgagcatcagaatgttgatccagatcgcgtcgacggcgtcgctcaggccgcgcataaagccggaatcgggggagaggaacttcataatcgcctttcgtatggcatccgtatggcaacgtatgcaagtcggatcttcttgcgattctactcgacgcacgccatcttgcgattggccggtttgcgccgtgcggtcgatcgtgtggtcggtcggtttgtgcggcgcgttcggctgtacgaacggcgatgcggctgaccggtttgtgtggcgcggtcggtcgtgcggtcggcgacacgatctgctggtttgcgcagcgcgaacgccggcacgaacgatcgcaccgccggccggtctgcgcaaacggaaacgcgattgcccgcgcgcccccgcagcggacgccctgcaatgctatcgttgtcagcggtacaacggttgcaggcacagacgaaaggggcataatgaccgcgaataacatgcgtgacgattggtggaagcaagccgtcgtctaccagatctacccgcgcagcttcaaagacgtgaacggcgacgggttgggagacatcgccggcgtcaccgagaaaatggattacctgaagaatctcggcatcgacgcgatctggctgagcccgttctacccgtccgacctggccgacggcggctacgacgtgatcgactaccgcaacgtggacccgcgcctcggcaccatggccgatttcgacgcgatggccgccgccgcgcatgaagccggcatcaaggtgatcgtcgacatcgtgccgaaccacacgtccaacaagcacaagatgttcatcgaggcgctcgccgccggccgaggttcggccgcacgcgaccgctacatcttccgcgaaggccgcggcgagcacggcgagctgccgccgaacgactggcagtcgctgttcggcggcccggcgtggcagcaggtcgatgacggacagtggtacctgcacatgttcgccaaggagcagccggatctgaattggaagaatccggacgtgcacgaggaattcaagaaaacgttgagattctggtccgaccacggcaccgacggcttccgcatcgacgtggcgcacggcttggccaaggacctcgattccgtgccgctggccgacatggatccggccgcggtgcagcatgtgctgccggcggacggcgcgttcagcccgctgtgggatcgtccggaagtgcacgacatctaccgcgaatggcgtcaggtgttcaacgagtacaatccgccgcgtttcgccgtcggcgaggcgtgggtgaaggccgaatcgcagcatctgtacgcgtccaccgacgagctcggccaggtgttcaatttcgagttcgccgaagccaactggttcgccgacgagttccgtacggccattgctgacggcttgcgcgccgccgaggaaacgcacggttccaccacgacgtgggttatgaacaaccacgatgtgccgcgcagtccgtcgcgtttcggtctgccgcaggtgaaggatgctccgtaccaccagctggcgcacgattggctgttgcgtgacggagagacctaccgcgagaatcgtgagctcggcacccgtcgcgcccgcgcagccgcgctgatggaactgggcctgccgggttccgcctacgtgtatcagggcgaggaactgggcctgttcgaagtggcgaacattccgtgggatcgtcttgaggatccgacgccgttcaacacccgtcgcaacttcaccgacaagggtcgtgacgggtgccgtgtgccgatgccgtggaaggctgccgattgcggcgaaccggcttcgtggagcccggacttcatcaccggcggcacgttcggtttcggcccggagcagggcgattccgccgacgcgcacctgccgcagccggcctggttcaaggatttcgcggccgacgtcgaggccgatgacaacggttccatgctgcacttgtaccgcaagctgttgcagttgcgacagacggtgctgacggcaaccggagacacgtccgccgacctgctggacatgggcgatacggtggtcgcctactcgcgtccggccacggaaggccgtcgattcctgtccgtcaccaatttcggcgacgagccgatcgccctgccggacgatgcggtcgccatcgcaaattccgtgccgttgacggacgacggcaagctggatagcgacgcctccgtatggctgctgctgggctgatcgaccgctgaatctggccgttgcactgctggctgaggttgcgattgttctcaggcggcctaaccgctcccaaatcgccttgcatatatgaaaaattccggccctccacaaggaggaccggaattttggtttgtaaggaaaggggaatggtaagtttaaacgctacttctcgccgttcatgatggcggcaagcgattgcacgcgcggcagatcgaacacctcatcggtgtgcaccaccttgaggtccgggcctgccagcggcacacgccagttggagtattcactggacgtgcccggctggttctgcgtgcgcgtctcgcccacgccatccaccagcgcggcctgcagcagcacggacggcgacttgagcagcatcttgtgcatcgcctcgacgatttcctggatgtggccttccacatcgcccgccacttccggcgtgatcaggccggactccacgagacggtccatcatcgcgtcgcgttcggcggtggcggaagcctggaactcctcgaccgggccggacagcaggtgcagctgttcgcgcagcttgacgtgctcgaactgcaggtagccggcggtcggcggcaggtcgtgcgtggtgacggaagccagcgcgtacttgcggtacgtggacggatcggcgtacgggtcgccggcgttgggggagtcgtccacgcgggcgaaccattccaccatgcagcccagcaggccgtgctcgccgagtaccgtgcgtacgtaatcaggcacggtgcccagatcctcgccgaccaccaaaccgttcacgcgggacgcttcaatggtcaggatcgcgatcatcgcctcatagtcgtacgtaacgtacgcgccaccgcgcgcgccttcgccctgcggaatccaccacagacggaataggccgagtacatggtcgatgcgcaccgcgcccgcgtgcgagaacatgttgtgcaccatctcgcgatacacgccataaccagttttggccagataattcggattgaacggcggctggccccaatcctgaccctgctggttgtagaagtccggtgggcagcccacggttacgctgcctactgcgaaacgttccggattccaccacacgtccgcgccgagcgagtgcacgcccacggccatatcctgcatgaggccgagtgccataccgctgtcacgggcggcgttctgcgcggctgtcacctgctcgtcggcgatccactgcagccagcattcgaaatcgaccatatcggcgtgctcgcgcatgagctccaccacttcaggcgaatcgcggttcgtgtccttgaaccacgtgccttcccacggcgcgccccacacctggaacgccaccgaccatgcggcgaacgcgcgcagatccggacccgcggcctccttgaacgcgttgaacgcggcctgacgctcgacggaacgcggcacgttgtacacaagctgcagcgcctggcgcttgtgccaccaagcggaattgatgtcgagcggctcgatactgtcgttggctggcgaggcttccgcgtgcagacgcgccacttcggcctggtccgcctcgttgagttccgcatattcagcgatatcctgcggacggatgtacgtcacattgagaaaacgacgcgattcgggaagatacggcgacggctccagcggcggcaccggcgcggtggcgtgaatcgggttgataagcatgaaatcggcatgcgatttcgttgccgcgtcggacagcagcagcttcagatcgccatagtcgcccacgccccaggattcagcggaacggatggaatacatctgtgccatccagccccaacgttgcttttccgctactgctggcggcagttcgatgcgtgccggtgcgcagatcagcgcggcttcggcgtgcagcgggccggcatcgacggccagcgtgtggtagccggcgggaatatcgtccggcagcgtcagttgcagcgagccgtcatctgcgttcgagcccgtcagatacgcggtcagatcgcccgcatattccgtgccgtcttccaacgtcagcttcagcgccacgtcgtttcctttcgcgcggattggcgtgacggcttccttgccgatgaacttcacgacggtcggctcaacaagtgtgtctgcgatgcgctgctgggtcgccgcataggaggcggtgatcgcttcgtcgctggatgcgtccacgccgagtgcggccaatacggagacgagcacttcgtcgcggatttccacataggtgccgagctggtcgatatacgacgtggaaatgccattgagcttggcgagctggataagaggccgtgcgatgcgttctgcgctttcggtctgctgggtctgtgtcataggtcccttctttccgcgccgtttgtgacggctgacatgctacattgcttgcgattgccgcagcttcgatgctggtggcattcgcaccaaagataactatatcacggtatgatatcgttttcaaagcgtgttttgcggtaagagagtgttgctatattgcgattttgctctaatttcaggaatatagataaccggaattgtttttccatattgactatcgtttgcaatacgaaggcgcagcgctccgcattgcaaacgattattccaacggggcattgctcgtctgctactcggcttcgagaattgcaaagctttgcagacctagacgcagcgaagtgccgctaatttcgttttcgccgatgctgaaaatcgtccgataactaccatctggtaactgcaaagctttgcaatcgcggcttggattgacggctatgatcagcttctgcaggtgggtggaacgctcgaaaacgaacactctatcgcgttcgattgcatggaacgtagcccccgaccgcaaggcgtcgcattcccccttgacgtggagtatggagcgcaccgtatgccacagtgattcggcgtcggcctgctgtgcggcgacggtcggggcgtcggcggacgggtcggcgggcaggtagctgccaccggtcacatcgccagcccgagtgtccgattctgcagaatcggacacgtgaagtgctccggatgcgtcgttcgcaccccactgcatcggtgtgcgcgaaccggtgcgcacgtagccgccttctttgccgggcagtgcgcggtatcgcatgccgatttcgtcgccgtaatacaggaacggcacgcccggcatcgcgaacagcgtgcagtatgccagggcgatttcgcgctgcgacagtcgcggcgccacgcgtgcggtgtcgtggttgcaggtgatgaaattaaaatttccgtcggccgtttccgcttcgcgcagacgcggctcgtactcgtccaggaattcgctgatcggcgtgccggaatcggcgttgaaatagctcttgtcgcccttgcggctcaacgggtcgtccacgttgcgcaacagcatgttgtagccgttgggaacgccgtcccaacgccaatcgagatagaaatccatgtcgaagccggcggccatcgactcctctggccgtccccattccgaaacgaacgcggcttcggggaaggccgggcggatccgggcgaacatgtactgccaggtgcggatggtgtaaggcttgccctcatcgtcctttttgacgaggctgtcggccatatccacgcggaagccgtctgcgccacgggaaagccagaaccgcatgacgtccaccatcgcgtcgcaagtggccttcgcgtccggaccaagggctggcttctgccagctacgttcggggtgcgcgaaaccgtagttgagcgccggctggcatttgaagaagttcaagatgtaggtaccgttgcggggcgattcgccgccgatgaatggcagtccgtcgccaccggagatccatgagtctgtccagatgtagcggtcggaataattgtttcgctcgaccttgcaactgcggtggaaccactcgtgttcctcgctggtgtggcctggcacgagatcgaggatcacgtgcatgtcgcgccggtgggcggcgtcgaacaacgcaatgagatcgtcgttggtgccgtagcgtgatgccacctttttgtagtcgcgcacgtcgtagccggcgtctttgaatggcgagtcgaaacagggattgagccagatcgcgttgcatccgagatccttgatgtagtccagttttaaagtgattccggggatgtctccgatgccgtcgccattggagtcgacgaaggactgtggatagatttcataaaaaattgcgtcggcaagccatttggggtgggggtgtttcgcggggggaagcatgagggtgtgtctccttgatatttcgcggtttgcggtgtttctttgaaacaatcataacgctgaattgcaaacgttggcagaaacgtgctacactaacaatcactgatacatttttggtggccccagtgttgttggtaatcatccaagaacgatgatgtgaacgtatgcagggttttggtccgtaccatttaaccggagatgttgaggaacacaaggttatgtgaggaaaggaagatcaatgaagatcgattggaagaaggcaatcggacttactgctgccgtttctatgctggttccgctcgctgcgtgcggtggctcctccgacggtggcgataagaacgcttccggctccaccgaggccgtcacgctgagcgtgtgggccccgcaggaagaccaggccaaggacaccaactggctgggcaaggtcgaagagaacttcgccaaggcgcatccggaatacaatatcacgtggaagaatgacgtggtctccgaaggcgatgcttccaagcaggtcagcactgatccgtccgcggcggccgatgtctatatgttcgcttccgatcagttgggtgttctaatggacgccaaggccattggccagctgggcaccgacgctgagaagcaggtgaaggaacagaacggcgacctcgaagtcaactccgtcaccggcaccgatggcaagctctatggcgtgccgtacaccgacaacacgtggttcatgtactacaacaagtccaagatcaccgaggatgaggccaaggacttcgataccatcctttccaaggccaaggtcgcgttctccctgcagaattcttggtacatcaacggcttctatgatggcctgagcctgttcggcgagaagggcaatgatgctgacgcaggcatggtcttcccgaaggacggcgccgatatcacctcttatctggttgatgtggtcgccaacccgaacttctccaacgacgatggcgcttccggcctcgcagccatcaaggatggctccgccgacgtgctgttctccggtacctggtccgctaaggacgtgaaggaggccctgggtgacaactacgccgccacctctctgccgaccttcaccgtgaacggccagaagaagcagatgaagtccttcgccgccaccaaggccgctgcttacaacccgaacgccaagaacccgaaggccgccgctcagttcgcggcttacctcggctccaccgaagctcagaagctgcactacgagatgcgcgccatcccgccgaccgacaagtccctgtctgatctgaccaccgacgacgtcgcagccaaggcccaggccgacaccatggccaacaccgccctcctgcagtccggtctgtctggcatgaacgattggtggactccggccgaaaccttcggcaaggccctggtcaacaaggaaatcaccaaggacaacgctgccgccaagtaccaggattgggtcaagcaggccggtggcaagatcgctgagtgaaatcagtaattctaaaaatccaataactgaagaatgcaggtggttggcactgccaaatccccccagccatcctgcagctttgagagacgcttcgagtcgcggtgtctctctccactttgcatagtggctcactcctcctccgagctttgcattcccgggcaaggtttttaaattctccttccccttgtccgggagcaaagctttttttatctttcaatatccatatgagagggcagtcgaaatgacagcaacaactctttccccgcgggagatgaagcgccttcggaagcagggtgctgattatgtttctccgtcgccttacacggtaagggcggcgttccggcgtggtgacctgttcactaagctttccgcagtggtgtttggtcttggcgatatcgtgcgcaagcagtatgtcaagggcattgccatgctggcgctggaaatcgcatacttcgtgttcatggcaatcaatggtgtggactatctttccaagttgccgaccttgggcaccaatgcaggcggcaagaagctggtcgacggcttctgggtctacaccgaacctgaccgttccgtggtcatcctgttgtacggtgtcgccactctggttatcaccgctgccttcatcggcctgtgggtcatgtccgtgcgctctgcatacaagtcccaggtgctgctcgaggagaacggcaaggctccgagcttcatggacgatgtccgcgagctgctcgatgccaaggctcacgtcctgctgatgttcctgcccacgctgggcattgccgtgttcactgtgcttccgttgatcttcatgatttccatggcattcaccagctatgaccacaagcacctcgtgctgttccactgggtcggctttgagaacttcgccaaggtcttctccaacagcggcggcaccgttaacgccgcactgttcggacgcgtgctggtgtggaccttggtctgggccttcttcgccaccttcctgaacttcttcttcggcatgttcgtggccatgatcatcaaccgcaagaccacccatttcaagggtttctggcgtgcctgcttctccatgtccatcgccgttccgcagttcgtgtccctgctggtcatgcacaccatgctccagccgcagggtgcggtgaaccgcatgctgcagacgtggggttggattgacggcccgctgccgttcttcaccgacgccacttgggcccgtgtcaccgtaatcgtcatcaacctgtgggtcggtattccgtacaccatcatgcagatcactggtattctgcagaacattccggccgatcagtatgaggcggcgaagatcgacggtgccaactggtggcagatctttactaagatcaccatgccgtacattatcttcgtgctcaccccgtatctgatcaccaccttcacgggcaatgtgaacaacttcaacgtcatttacctgctgtccggcggcgatcctacgccattgggcgattccgcaggctccactgatttgcttatcacctggctgtacaagctgaccgtggacaagcaggattacaatctcggtgccgtgatcggcatcatgaccttcgtcgtgttggccatcgtttcgctgatcacctaccgcaattccggctcctataagaatgaggaggcattccgatgagcaacaagcattccgcaaccaaagtggaaagccacggccttctgcacgaccagaagatccgccgtatcaccggcgacgtgttcgcccacttgttcctggccattctggccgtcatctggctcgtcccaatcgtatgggtgttcgcggagtcgttcaataagaacaccgccccgtacaccagctccttcttcccgaaggagtggactctggacaactatagggtgctgttcaccgaccgcaacgtgttggacttcccgaagatgttcggcaccacgttcatcatcgcctgcttcacctgtgcgatttctctgatcttcgtgctctccgtggcatactgcatgagccgtatgcgtttccgtgtgcgcaagactttcatgaacgttgtgctgattcttggcatgttcccgggtatcatggccgtcaccgccatctacttcatcttgaaggccttgggcctgtcaagcggcaccatgactaccgtggcgttgattctcgtgtactccgccggttccggcgctggcttctacgtgatgaagggctatatggacaccattccgacctcgctggacgaagccgccctgctcgacggttgcacccgtttccaggtgttccataagatcatcatcccgatctgcaagcccatgatcgtctaccaggccatcatcggcttcctgaccccgtggctcgactttgtcatggccaaggtgatctgccgtacgcaatccaactacaccgtggcattgggcctgtggctcatgctgcagaaggaatatatccagaactggtttgcccgcttcgccgcggccgcggtcgtgatctccgttccgatcgccatcctgttcattgtgatgcagcgcttctatcaggagtccatgtcgggctccgtgaagggctgacggaaaggtaacgcaataatgacgctcgtagacaactttgcacagccgaacacgagcgtcgccgaaccgttcccgctttgtttggaacggcctctgggtgccgtggttgctcaatccggcacccagttcgctctctgggctccttccgcacaaaaggtgaccctgagactgttctcgcgtggctccatgggggaaagcggcgacgctctgattggacagtacacgatgcgtccggaatccgatggttcctggacgtacgatttcgccgacaacatgcacggcgtgtattacgactttttgatcgaacgcgattgcggttccgtcgaccgcatcgccgacccgtgggcgcgcggggccggtgtgaacggccggcgcagcatggtcgtggacttcagccgtaccaatccggatggttggtaccgcgaccatatgccggacgtgccgcttgcgcagacggtggtctgggaaacccatgtgggcgatttcagcaatgatcccgccggcggtttccccgaatcgcatcggggcaagtatctggcgttcaccgacgacggtacgtctctggacgggcatcccgactttcccacgggcatcgcatatctcaagaaacttggcgtcaccgcggtgcagctcatgccgatttacgatttcggttccgtggacgaagagacctgcgatcgctacaactgggggtacgatccggtcaattacaacgtgccggaaggctcgtattccaccaatccgttcgacgggtcggtgcgcatccgcgaagtgaagcagatggtgcaggcgctgcacaacgccggcatcaaagtgatcatggacgtggtctacaaccacatgttctcgcccgataattggtttgagcggtcggtgccggactatttcctgcgccgtaagcccaacggcgcgctggccaacggatccggctgcggctgcgatatggccaccgaacgcaagatgttccgccggttcatcgtggaatccgtgacgttctgggcgcgcgaataccacatggacggcttccgtttcgacctgatgggtctgatcgacgtggacaccatgaatgccgtgcgtgctgctctggatgagattcccggccgtggacgcgacattctcatgtacggcgaaccgtggtccgcgggcgccaccgcgccgctgcccagcgacaccgtgctggctgacaagtcaggcctgtcgaagcttgacagtcgcatcggccacttctgcgacaccacgcgagacaccatcaagggccatgtgttcttctcggaccgcccgggttatgtgaacggtggcatgcacgagaacgtagcggctgcgcgtgaggccgtggacgcgtggcgtcgcggcaaacattcggaaggagtggcaggccaggtcattcaatacgtgtccgcgcacgacgacctcacgctgtgggacaagttgtgcgcgagctttgcggctggttcgttgggcagcaccgtggccgaaggcgttaacgaaaataccgtggatgtgccaaaagtcatgtatgacgccgatttctcggcggaagggctggccggtgtcggtccgcagattgcggccgcgctgaccgacgtgatggacgccaacaagctggctgtgggtatcacgcttacctccgctggcatcccgttcatgctgtccggcgaggagttcgcacgtaccaaattcggcagctctgattcttacgattccgccaaagagcttaactggctcgattggaaccgtgcatggcagaagcgcgatttgattgagtattacgcgaagttgattgcattgcgcaagtctgatccacagtggttcgacggcaatcgcaatatcgtcgatacggaaggcgacgaactcgtgttccgcgtcggcgattatctgatggccgccaatccaggcagacacgtcggcgttattgacgtggccgtaacgggtttggaaccgattggcggaatacggagatactggtgtggtctcggctcgtccgtcagtccggtggaaggcaatgtgagcgcaggtgatggcgattatttgattgttccaccgcatacgtttgcaatctggcggttgcagtaatactctcagtagggaagctacaaaacggcgaccgcaaagctgcggttgccgtaacagatacggcaatggggcaggaaaaccagaaaggatacgacagtgggaatcggagcgcgcaatccgcggtacgaggtggtgtttttcgacctgtacggaacgctgatcgacattcgtaccgatgagcagagcgaggccgcatggcaggcgctgtacgattgcgtgaccgaattgggcgcgcagtacgaatccgtcgacgtgatgcgcgaccagttcgaaaagctcgaagcccgcgaaatggtccaccaagccgaccgtgcaatcgttcgcaacgggtgggacgaattcgacatcctgccggtctaccggtccctgctcatgaatcgcagcgaggaagcggaaaagaaactcgcgctaccgcaggccgcgctgaaagccgcatgggcgttccgccaaggcagcaccagcctgttccggctgtaccccggcgcgctcgacatgatcgaacaactgcaggacgccggcatggtcgtggcgctgctgagcaacgcgcaagcctgctacacacgccccgaactggaagagaccggccttgccagcatactggacgacgtgatcatctccagtgaagagaaaatccgcaagcccgcacgcgacctgtacatgctggcgctcgaccgtgaattcgtcaccgccaagcacgcgctcatggtcggcaacgacgagcgcaacgacatcatcggcgccaattccgccggcctcgacgcggcatacttccgcacggaaatttcaccggcggacgacccggacgtttcggcacatgcggtatgttcgtttaccggagccgactacgacgggctgctgaaattcgtgctggacgcataaggcgcgcggtgggcgctgagcttaaatcgcatgggacgtgcgggaagccgctgtggcgtgcgggaaagtcgcaagtcgtaaaaggcatacgtgcgtaaggcgtgcgtaaggtgcacgtgccacgtgcgacgcgcggaaaaatcgcaataggaggacatatggaaggctatgccgagcagggagctcgaaccgattcgaccgaccaaatcggattcggcggcgctcgccgcaacaggaaaaaacgtcgcggactgacggtgttccaacttaaggtcatcggcgcggtggcgttggccttgtccgccggcagcaccaccatcgtgccgctgttcttcggctccgataccaacaatatgacgtcgctgacggcgatggtcctgagcgaagtggtgtcctggttcgccattccgatctacgcgtggctgctggtgcagggtttccgtgaaacgcacagccgggtcgcgtacggcctgcagctgttcattctcgccgtggtgtgcgaggtgccgtacgacctcgccacatcgcataaggctttcgacctgggctcgcagaatcccgttttcggcctgttcgttgcgtttgttgtgcttgccgcgctcgactgggtggcgtcgcgctatcagaaggccatgaaggtgctgttgtcggtcggactggtggtgattggtctgctgtgggacctgctgctgcgtatcggcctacgccagcacatgatgagcatcggttcggtgacgcttggcttcgtgctgattttcgctctgatgcgccagtatgagaattcgatgatgttcacagccggcctgttcggcgccgtgatgatgatcgcgccgggcgtgggcgtggcgttcgtgcactactacaacggcaagctgggctataagcatcagtggacgaaatgggctttttacgcggtttacccggttattttgataatttgtgcgatttgtgcaacactggcgtgatttttgacaacgttcgcagtatgatagaaacagattgagagagcatcgccgctcaagcgagtgtttccaaggctgggaacgtttgtgattatgatgcagaaaccgcaaaggggttgagagatggatagagcaggcattcgcgaggtggccaaggccgcgggtgtgtcgatttccacggtatcgcgcgcgttcacgcggccggaactggtgtccgaacgtacgcgccgcaaggtgctggaaacggcggacaagcttgatttcaacatctcacgttccgcgacatcgttgaaatcgggtcaatcgtaccgtgtggcgatgctgatgaatgaagagatcactagctggttcaatacggaagtgttcgctggaatcgaatccgtcatgcataatgccgggtatgacgtatcgctgttccagcacgtcgacaccgccgaaaaccgccgcgacttcttcacgaatctgccggtccgccgcaacgtggacgcagtattcgtgacatcgttcggcgtggagccgaaggaaatccagcagctcaagcgcatccacgtaccgattattggcatcaatacgccgacgcaaaacggcttcgacgccaccatctccatcgacgatgaggacggcatgttcaccgccgcccagcatctgatcaatctggggcacaagaatatcgtgtacgtgtgctccgatgcggtcgattccattaattcctccatcgatgcgcgaggacagggcttcatccgcgcctgcaagacgatgggggcctcccatgacttcaagtggcgcgtcgtctctgtgccgcgtggcaagaccttcgccgactcggcgttgaccgcgctgcttgcgttggacgagttcccggacgcgatctgctgccagatggatatgatggcgattccgctggtgttgcgtttggaacgttacggccaccacacgccgagtgactattcgattatcggcttcgacgattcgccgtacgccgacactgtgaacctgaccaccatgcgccaggatccgtatgcgatgggtcgcgcggccgcacaaaaggccatgaagcttatcgaaggcaagccgcttgagaacgcgcatgagattgtgcgcgcccagctcgtactacgcggcaccgattccgtgtacggcactggccgctgagagccgagtctcattacccttccgcagcccgtcaatgccgacgggctgattgtgatggcctggggtggattgataagggatacccccactgtagtcacggtgtgtggcatacgttttcaggaaaaaaaatgaaacaatttgcagtgatgtgtttcatgacacgccaatcgggggctgatgaatgatgaatttcattcaatgatcagcatgtgttttttgattttgcaatcgttgacaaaccgttgaatatcaggctttaaagcgttgtccccgtgagaggggacgaaaaaacgtatcgggggagggggtgtgggttctttctgtttcattttgttttcataactgcaaaggttatcatagtaaaccgtaggtcagagaaaaagggaaaacagaggtttccggctgtgttgccggagatgggaacagcgcagaagctatacgtaaaacagaagtgataacggcattatgcaaaggatatcaaccctcgagttgagggactcagaagggtgaacactttgcggataggggacaagatgaggcaatggcgtaatggtgtcggcaacgcaccacgacactatgcaggaacgcgatcggcaaccggtcgcgtgctttcgcgtacccgctccctgaccgccgccgccatagcggtagccatgatggccaccgtagcagtaacttccctcctccccacctacaatgccaaagctgacgaaagtcgcaatgacggcgcaatctgcacacctaccacagaaccgttaggcgatcagacctccggcggcggtaacgatgaaggtatcgctactttcgttggcggtgacatgtatgtaggtggcaagaagtcgggcattacttctgccaataacaacaatgcgcctgagggttcttacgctgttgaggccgaaggcttgaccgctgtgaacggaaagcttttgcttcatccaatgaagcaggcttggaacatctggaataaggatggctcattcaatcgttcgcgtggttttcgttggggcatcgtcggttttggttcgcagttccgtccgaaggacggttcgactgtgctttcggttggcggcaatagcaccaattccgagttgaattggttcggtggtgctcagggctggacggatgacgctaatcagggatccagctggcttggaaccggagcggggaatggcgctaccggcgagacgaatgaccataactttaacgcgaacattgctggtaatcagaccacagtgcaaagccgcaacacttggaagaacggtgaacagtattccgtgtacgacatgggcggcaacggcaaagtcaactggaatcagagcaacaccgttatttccggagtgaagaacccctcgacgggttcggattacacatattccgaatataagaattatgtgactacgctgtctggcaagctcgcgaagatttcctccagcaacactgttacgaagggcaatgaggataattacacaggcaaacgttattcatacagctacaacacttacgcaaacaacgtttaccggttcgatattgagaacaactcccgtcagacggaaatcacgctgaccggcgatggcaaagacgagttgcaggtgttcaatttagacgcatcaaagctgaatagcattggtgatgccggcgtggtgttcaacttcaagaacatctccgacaatgcttcggtcgccatcaacatcaacggtaatggcaatgatgtgaagttccgtaatggctggcagttcaagtggaacgacgttgatatctccgacggctacgtcatgatgaattcgacgggcacaaaccgctacaacaatacgcatgggcaggagtacgtcaagcgcgcaagccagctgatgtggaacttctataacaccaatacccttacgattcttggtggtaaggggtcggggcgcatcaacaccggctggtacaaggatcagaagcatggcgacaaggaagactggtatggcgtcaatgtaactgatgatccgtctgccgcatggatgggttccgttatggtaacgggcaatgattttggtgccaagggcaatttccagtcgcatgtctccactaatggtcgtgtgtggactactggcgattttgaaatgtacaacaaggatgtcgttaccacaaacagcggcaatttcgtcaacgccgaaggcaaatattccacctctgcagtggatatggatcaggaacgtcataacctgtcttggtatgggcagatgaccacctcctgcgccgcaatcaagtgggataaggtcgatgccgagggcaaagccctgaaaggtacttcgtggacggtgtacggcacgagggataatgccatgaatggcacgaaccccatcaccacggttgccgatggcggctggaatgatgcggatgatgcggataacggtagcgtcactttgggcagtctcgcaaagaaggccacatactacctgaaggaaagcggtaccggcagcagccagtatgcgttgaacacgaacatctatcgcatcgtcacgcacgacagtacggataccgtttcaaccatcgacaaggtgtacagcgctactggcgctgaaatcaccgatgacaccgccaagcagctgcacaatggcgccattgtcaacgtgagtgccggtacttccatcgcatggtcgaaggttgacgcagaagaccagaacacgttgctcgcgggttccacttgggaattgaccaagaagggcgatcccgaccagtcgtggactattacggatgatgattccgacagcgaaatcgcaaacatcgtggtcaagatcaatgaaactgaagttagttcgtggagcttcacgaattccactccggtaagcatttcttatgttgccgtggataaggatggcaaggagctcgccacgaaggtgcagtggaagtccgaaagccctgccgttgcaggcattgccagcgatggcacgcagttgcagccgtatagcaacggcactacgaacatcgtgttcacagcaggcgacaagactctgaggttcccggttacggtaaacggtgtgaccgtggaaagtgctgtgagcatcgataagtataccgaaggccagaaaatcagcctggaacaaggcaagaccatgacgctgacggctaccgtggcacctgaaggcaacacggtgaaatggacttcgaacaatacggatgaggtgtccgtaaatcccacaagcggtaccgcagtcaccgtaactgctaagaacgtgacttcagactatgtgaccatcaccgccaccgaacagtgtaaccagaacacagccactgtgaagatcaaggtgacggagccaatggtctctgtgtacttcaagaagtcgaatgtgtcttggaacgaatactggctgaaatataagaagagcacggacagcaataactggagcggtgatgtacaaagttccagcgcgtgcggtgactatgtgcgtttccagctgccgaagagttctgttataacaaattaccagttctatcttggcaatgctaaagggttcgatctgcccaatgacgataagtacaccgccgcgaatcacggtatgtttacctttacgggtaaggatgttcaggttgtggaggcgtggaatgatttccaaaaagaaacagtcccctccggctgcacggtgaccagcgcatacgtggagaatcgtttccgtcgttccgcggtgaagaatgcagtgttctacgatcagccggtggtgcgcgctattaccaacacgactgccaaggcagctgacacgcggcaggatgaggatccgaagggcggccagttcaaggtgtccgatcttacgaatggtacctacacgctgaaggaaatcatcgcgccgaacggtttcgatgtcagtaagacgaagacttacaccatcgttattgagaatgggcaagtcacgagttccaatcttcctagcgcgggcaacattgagaactcgcgtcttaccggtacggtgaactggaagaaaaccgacgagactgacaccaacaagctgctggccggttccgaatggaagctgtacaagactaggaacttctcgtgggataacggcaacgcggtttataccgagaccggcagtactgatccggtcgcaaccatcaaggattgcgtgaatagcagtgagaagacctgctccgcgcagacggaatggtatacggatcgtgatggcgacgccggtaagttctccatcgttggtcttgagtggggtgaataccagttaatcgagtccaaggctcctgacgggtacaacatcgatacgactccgcacgtgttccgcatcgggccggccgaaggcgcgaacgtgaaaggcacgtggtacacgtcttccggtttcaagccggagactaccgccgactatcagaagtctgccgcattcaccgttgacggtggttccattaccaacacccccggcgtcgttctgcctggtacaggcggcgagggagtaaacaagatgtacgctgcgggattcctcgcagtggcgattgccgtggccggtctggccttgagcctcaggaggcggcaatgatgaactcgtctagggcaggggggctggaccgtagcgtagcgacccaatgcccactaggcaataactgaacacacataactgaagattcaagatttcaaacaagaaagaaagggagaacaatgaacaaggttctcaagggcctcgtcgctgtggcagccaccgcggcaatggccgtcgccggtttcgccggcgcctccaccgcaactgcggctgaaaacaactacgacatcaccgtgccgacgaccgacacgcacacctactccgtgtaccaggtcttcaccggcgatctgagcgaaggcacgctgagcaatatcaaggccggccagaacttcaacaagaacaatacggcgaacaagtccgctgccgatgctgctgctgagattgctcagggtacttatgctgacaacacggcaaagctggcagccatcaccccgtacgttgatttggctggtactgcctatggcgaggtttccgccaagacggctttgtccgctcctgctggctactacctgcttaaggataaggatgctgtgaccggcaacgacgcggcaacgctgttcatcgtccaggtcaacggcccggtgaccgtgaaccgtaaggccgacaagccgaccttcgaaaagaaggtcaaggacgtcaacgactccactggtgataagaccaactggcaggattccgccgattacgatgtgaacgacgaagtgccgttccagctgaccgctaccctgccgacgaccgaagcagacttcgcagcctacaagacctacaagctggtcttccacgatcagcagtccgctggcctgaccttcaataagaagtccgtggtcgtcaagtacggcgacaagactcttggcgctggctcctacactgtcactgagaatcccgaagataaggacaccttcgacatcaccatcgctgacgcgaaggccgtcaaggatgctgaagacaacgcaatcaccgttgccgccggtggcaagttcaccgtcgaatacacgtccacgctgaacgagaacgctgtgatcggctctacgggcaacccgaatgaggcttcccttgagttctccaacaacccgaatgttggcggcgaaggcgaaaccggcaagaccccgaccgacaaggtcattgtgttcacctaccagctggacatcaacaagaccttcaacggtggcaccccggctgagaacgatctgccgaagttcaagctctacaagttcgatagcaccacgaacgattacaccattgaccgtggcgaggtgaccatcaccaagaccgagggcggcaagtacaccgcttccttcaagcgcgttgatgacggcaagtacaagctcgtggaaaccaagactccggcaggcttcaacaccgccgccgacacgctcttcgaaatcaccgctgaccatgacgtcgagtctgacaacccgcagcttacggtgctcaagatcaacaccactcccggcaacaccactaccggtacggttaccgccgatgttgtgaaccagaagggctccaacctgccgtccaccggtggtatgggcactgtgatgctgtacgtggctggcatcgccgtgttcgtgcttgctggcgcgaccctggtgatggctctgcgtcgtcgcaatgcctgatcctccggattccataagaatctgaagtaaccatgcaaaacccgtgagccgcgttgacgcaagtcagcagcggcttacgggaatcgcaatacataatttaaaaactgaaaattaaataataactgaacccacatatgctgggctggaccacctcaatcccttgtacactgcctaattttcttgagtatccagcctggctccatatattttccggtttgccgttggggggggcgaatcaaacatgcttactttccaatccacagaagaggggtcggcaatgaaggaacgcacgatcgcaagccgcgtcatcgccgcatgctgcgcaatcgccgccacattcgccgcggcagcctgtgcattcactactcgcgatgccgtcgcggctccaacaacagactctgccagcggcagcatcgccatttcgtaccaccataagagctcggactccgaaactggcgacgattctaccaacttcgccatttcggacgccagcttcaacctctacaaagtcgggcagatcccggcaagcggcggcgccaccttcgaacccgtcgcaccgttcaccgactccaccgcctaccccgtcgactggtcgaagatgaccggcaaggacgcgcaggtgtggcgagacatggccaatacgctcgccggactcatcgcggtgaacaaacccgacgccacggcaaccggcgtcaccaacgcttccggacacctgaccttcaccggactgtccgacggcttgtacctggccgtgtccgacagtgttgacgtgaaggtcaccaacgcttccggaaagaaccagacatggacgtgctcttccggcagtatgctcgtcgcagtgcccgaagacggcgtctccggcgggtcgcgtgtgctgagtatcgaaccgaaaaccgaatgtgtggcgcaaccgccgaaaaccgtggaacgcactgtgcgcaaaatctggaatgaccggaacaattccgacggcaagcgccccgaatccatcaccgtgaaactcctgcgcgacggcgagcccgtggaaaacgtgaagctgaacgagtccaacaagtggacgcattcgtggacggatctcgacgcggaccacgaatggaccgtggtcgaagcggcggtgcccgacggctacaccaccatctccgatgtggaaggcgactccactgaaatcaccaacacgcacacgccacccaccacgccggaccagccgcacaccggcgccgacgtgcagcaggccgcttggattgccgtggccatcttgggcgcgggcttggtgctgctgatcgttgccaagacggctttgcggaagcgggcgtagcataaataacgtgacggatgaatcggacgccaagccagctgcgcaagtcgaattggatgcgcaggttaaaccgggtgcgcaggttaaaccggctgccaagcataagaaatcgaatgcgctgctcaatgtgatgattgccatctccgcaatcgccatgatcggtgcgctgggcctcatcgcgtatccgacattcagcgactggtggaaccgcatgcaccagtcatactccgtggcaggctacgtggaacagaccaaagacatgtccggcgccgaacgcaaggccatgctgaaagcggcgcacgaatacaatgaacggctcgccgcgaacggcgaccggtggcacatgaccgacgcgcagaagcgcgaatatgatgaaacgctcgacgtgaccggcaccggcatcatgggatacgtgaccatcccgcgcatcaaagtgaaactgcccgtctaccacggcaccagcgacggcgtactgcagatcgccgccggacacctggccggaacctcgctgccagtaggcggagcgaccacgcacgcggtagtctccggacacaccggactgccatccgcgcgactgctcaccggcctcgacgaactgaaaaaaggcgacacgttcgcattccacgtgctcgacgaaacctacacgtaccaagtggaccagatctcagtggtgctgccgagcgaaatcagcaagctgaatattgagtccggggccgattacgcgacgctgattacctgcacgccgtacggtgtcaactcacacaggctgctcgtgcgcgggcaccggattccgaatccgaaagtgccagacaagacgcaatacgacgagccgggcgaaatgacagccgtggcggctgcggtgatcggactgctcgtgtttgtggctggctgcgcttttgtggggctcgcgcggctatggcgacgctcctggattgtgcggcacgggttgtgcgccggggccggcgcgcgccattcgtctggtgttcgggggtagtgtctagcctagcgccgccgcaggccggtgacatcgcttctccggtgtgcgggggtgtgcgtctggtcgtgctcggtatgtggtgcgtggtgtttgtgtgcttgtggtacgtgttgcgtttcagtgtgtgtacttgtgtttgcgtgcgtgtgcatgtctgatgttgcgcaggggtgttgttgcggtgcgcatatggcctgaatcgtgctgaagcatgggttgtgagcggatggggtattattcggcctgtttcggacgcttttgatgccccttttgctcatgacttgcggttttgacggttttggcgcggttgtgagcggatgggggtacgattctggatgtttcgggctgttttgatgttgggtggcctccccttttgctcacgacttgtgagttgggctggttttgcttgtctgtgagcggatgggggtgtgattcggcctgtttcggacgcttttgatgccccttttcgctcatgacttgcgattttgccggtccgcgcgcggtcgtgtgcgtacgggggtgtgtgcaatgggtcttgcgtgggtgtgggcgtgcgggtgtgccggtgtaggcgtgggtgtaggcgtgcggtcgtggttttggctgggtatctggcttatagatggcggattcggccgggtgtccggtggtatctcgcttataggtggcgggtcggtttgggcaataggtcgttagggggtagcatgcatgccccctagatgtcttgtttccgcaaggggccgccatctataagcgagataccatccgtcgatcccgcgaatccgccatctataagcgagaaagcgcgtgaaccgggcgctgcggcggcgaaatcgcaaaattatggaatcggctgattgctgcgcgcggcaggtgggtagtatcgggcgcggaagacgtggaaggagctgccatgtgtgatgaaggggaaactgcggatcgggcggatgccgtacgaacggaatcgcaaaagatggaatcgcgagcgggggagacggcgcttgacgggtcggcgcgcagcatcatcgtgctgattgtggtcggcatgttggtgggggtgctgtcgggcacgttcggcatcggcggcggcacggtgatcgtgcccgcgctcgtctggctcggcctgtcgcaacgcaacgcggccgccacgtccacgctggcgatcgtgccgacctccatttccggcgtcgtttcgtacgcgaccggcgggcacgtcgactggctcgccgcggcgttgctgttttgcggtatgtttgtcggcgggcagatcggcagttggctgctgtcgcggctgccggaattggtgctgcggtggattttcgtggcgtttctcgtgtttgtggtgatcaatcaggtgagttttgtgccgtcgcgcgaccaccagatcgtcatgacggtggtgaccggcattggcttggcgttgctgggtgtggtcatcggcacgctggcggggctgctgggcattgggggtggtgcgcttgcggtgccgtcgctgtcgatgctgtttggcgcgtccgacctggttgcgcgcggcacttcgctgttggcaatgtttccgaattcgatcacgaccagcgcggcgaacttgaagcgcaggctagcgcatgtgaaaaccgcgctgattattggcgtgacggcggctgtgaccgcgccgctcggcacgtggattgcgggggaggtttcgccacgagttggggcgattatgttcgcctgctatctgtgcgtgctgctggtgcggtccgtgttcgtggccgtaaaggccacgcgcgcggcgcgggttgcgcggggctgagtggcgcgggcatttttcccagtggctggatgatttagtcgcgtgagtggtgcgtcagaggtggtttttatccagtcactgggatttttggcgtgtgagtggggtctgagaggttggatttatccagccagtgggggattttggcttgtggggtgcggtgggggtgttgtttgacggaatatggcgattttattggccgtattccccctgttcatgcggtggatatgttgcggtcatcatatggcgatgagtgttcatctgtcgttcttctgtagtgcggtgtgcgttggcttgcggcgcatagcgtgggcggtggcatcgaaagatccaagcaatgcagccgcggaaaggttccgcgcagccggaaaacatggtcgaaacgggcgttacctaacgggcgcaaccgaaacggcaggttggacggcacggaagaaactgcatggaagaaagaagaaacatgagcaagcacaaggctctcacgggcgcaatcgcagcactcgcctccgtcgcaacgctcggcgcgctcgccgcaccggcgctcgcagctgacaccacctacagccccaacggcaagccggtcgcggaactcgccaagcatggcggcgcgcagcgcatcgccaccatcggcaacaagaacgcgaagaacgtcatcctgttcctcggcgacggcatgggcgattcggaaatcaccgtcgcccgtgactatctgaagggcgccaacggccacttcgacggacttgacgcggtcggccagccgagcgcgcttgacgacgtgcaggcgggcaccggccagtacacgaccttctcggtcggcaacggcagcaaggacagcgctgtcggcaaggatggcgacggcaagctggtcgccaaccccaatccgggcaagcttacccccgtaaccgattcctccgcatccggttccgcatgggccaccggcaccaagacctacaacaacgccgttgacgttgatatttacggcaatccgcagctgaacctcttcgagctggccaaggcggccggcaaagccaccggcaatgtgaccaccgccgaaatccaggatgctaccccggccgtgctggaatcgcattcgtccgaacgtgcctgctacggcccacagggcaagaccgacggcacgtccaacaatgcctccaagcagtgcctcatcaaccagcttaaggaaaacggcggcatcggctccatctccgagcagctgctcgacacccgcgccgacgtaaccatcggcggtggttccaagtacttccgtcagaccgtgcagggcggtgaatacaagggcaagactgtgtgggagcaggccaaggaaatgggcttccagaccgtcgagaacgatccggccgcgatgaacgccctgcagtacaaggacggccagccagtgctcgccctgatgagtgacggcaacatgccgaccaagttcaacccgtccaaggccaccgccaaggatccagctaaggacgccaacccgaccgtgtgcaccccgaacgccgactggctcggcaatcagggctcctcgctcaaggacatgaccaagaaggcgctcgatttgctgaatgacaacccgaacggccagaagaacggcttcttcctgcaggtcgagggcgcctcgatcgataagcaggaccacgcaggcaatgcctgcggccagattggcgagaccgacgacttcgaccaggccattgcctacgccatgcagaacgtggacctcacgaacacgctggtgatcgtcaccgccgaccacgcgcacacctcccagatcctcaacgcccagccggcttacgcactgtccaccgtgctgaagaccgctgatggcaacaacatggtcgtctcctacggcaccgcccaggacgattctcgcgatgcagacggcggctacaacggcggcgacatggagcacaccggcacccagctgcgtatcgcggcttccggccctggcgcacagcgcgtcatcggcctgaccgaccagaccgacaacttctacaccatcgctggcgctctgggactggccacttccaccgaatcgcagaaggcactgtctgacaacggcactgtgaaggtctctgctgccgacggtaaattcaccgcggacgtcgatggcttcaacggcgacgctgtgctcagctacgagctgaaggacaagaacgacaagaccgtggccgcgtccgattcctccactccgctctccggcgtgcgcgtcaagaccgcacagaccactccgatcgcgctggacggcgtcaccgaaggttccgaatacaagctcaccgtcaccggccgccagtccggcaaggccgtgaccgtcgacttccaggctccggccgccaactccgccgataagaacaacggcaagccgggcgctggcaacgctgacaagaacggcgtgatcgcttccggcaaggtcaacaacgatacgaaggccggcccgtttggcgccgcactgctcggcaagaccggcaccgctgtgctggctgcggctgttgcgatcgccatgctggttgccgtcgcgatgctcatcaagaccgcgaaggccgccaagaacgaccgctgattggctgaataacctccgataatccccgaaaccgctgccgctgagatgctccccagcgccggcggttttgggttttgcgcaaagttgagtgaggtgtgctcaagaatttttgcgatttcgggaataataacttgcgattcaaagttgagtggtgtaggctcaagttttggaaagcatgagagacggcaatccggaaacggcgatccgaaactcgagcgaagaacgaaaagaacgtatagcgaacctatctacaaaggagacaagttatgggacgcgcagttggcatcgatctgggtactaccaattcctgcatcgcaactcttgaaggtggccagcccaccgttatcgtgaacgccgaaggcgctcgcaccacaccgtcggtcgtggcattcagcaagtccggcgagattctggtcggcgaagtcgccaagcgtcaggccgtcaccaacgtcgaccgcaccatcagctccgtcaagcgccacatgggcaccgactggaccgttgagatcgacggcaagaagtggaccccgcaggagatttccgcccaggtcctgatgaagctgaagcgcgacgccgaagcctaccttggcgaaccggtcaccgacgccgtgatcacctgcccggcatacttcaacgacgcccagcgtcaggccaccaaggacgccggcaccatcgcgggcctgaacgtcctgcgtatcatcaacgagccgaccgcagccgcactggcctacggccttgaaaagggcaaggaagacgagcgcatcctggtcttcgatctcggtggcggcaccttcgatgtgtccctgctggaaatcggcaaggacgacgacggcttctccaccatccaggtgcaggccaccaacggcgacaaccacctgggcggcgacgattgggaccagaagatcatcgactggctcgtcggcgaagtcaagaacaagtacggcgttgacctgagcaaggacaagatcgccctgcagcgtctgaaggaagccgccgagcaggccaagaaggaactgtccagctccaccagcacctccatctccatgcagtacctggccatgacccctgacggcaccccggtgcacctggacgagaccctgacccgtgcccacttcgaggaaatgacctccgacctgctgggccgctgccgcaccccgttcaacaacgtgctgcgcgacgctggcatcagcgtctccgacatcgaccacgtggtcctcgtcggtggctccacccgtatgccggccgtcaaggagctcgtcaaggagctcaccggcggtaaggaagccaaccagtccgtgaacccggatgaagtcgtggccgtcggcgcagccgtgcagtccggcgtcatcaagggtgaccgtaaggacgtcctgcttatcgacgtgaccccgctgtccctcggcatcgaaaccaagggtggcatcatgaccaagctgatcgagcgcaacaccgccatcccgacgaagcgttccgaagtcttctccaccgctgaagacaaccagccgtccgtgctcatccaggtctaccagggcgagcgtgagttcgctcgcgacaacaagccgctgggcaccttcgaactgaccggcatcgctccggctccgcgtggcgtcccgcagatcgaagtcaccttcgacatcgacgccaacggcatcgtgcacgtgtccgccaaggacaagggcaccggcaaggaacagtccatgaccatcaccggtggttccggcctgccgaaggacgagatcgaccgcatggtcaaggaagccgaagcccacgaggccgaggacaagaagcgtaaggaagacgccgagacccgcaaccaggccgagtccttcgcctatcagaccgagaagctcgtcaatgacaacaaggacaagctctccgacgatgtggccaaggaagtcaccgacaaggtcaacgagctcaaggaagccctgaagggtgaggacattgagaagatcaagtccgcccagaccgagctgatgacctccgcccagaagatcggccaggccctctacgcacagcagggtgccgccgacgccgccggtgcggccgacgctgctggcgcaggcgctgccggctccgcttccaacggctccgacgacgacgtggttgacgccgaagtcgtggacgatgacgacaaggacaacaagtaatcatgtccgatttcaacaaggacgagtacctgaacgacctgcccgacatggatgacctgtccgggcaggccgccccggccgccgcttccgctgctgacggcgcttccgccgattccgccgctggcgcaacgcaggaaggtgcagctcagccggctgccgcgcaatcgcaagaaaatggcgattccgctgccgctgacggtgctgacaaggcaggcgctgccgacggcaaggccgacgatacgctgaccccccttggccaggccaagaaggaagccgccgaatacttggaggcactgcagcgcgaacgcgcggagttcatcaacttccgcaaccgcgcgcagaaggagcaggaacgcttccgtcagcacggcatcatcgacgtgctgaccgccctgctgccggccctcgacgacatcgaccgcattcgcgaacacagcgaaatggacgattcgttcaaggccgtcgccaacaagatcgacaaggcgttcgagaagttcggcgttgagaagttcggcgaaaagggcgaggatttcgacccgacgaagcatgacgcgatcctgcacaagccggatccgaatgccgagaaggaaaccgtcgacaccgtggtggaagccggctaccgcatcggcgaccgcgtgatccgcgcggcccgtgtggtcgtggcttctccgcagaactgatcgcgcattcgcacaatccgcgtatccgcgcgaaacgcatgtgacgagtaatcgggcccctctgaaaaacgaggggccttcgattacctgaaacaacggttcaacgacaactgtttgaaagtttgaaaaactgtactttttactgcatgaaaacctcacgaaaggaggcacatcatggctgagaatgaatggctgagcaaggatttctataaggtcctcggtgtctccaaagacgccaccgacgccgaaatcaccaaagcgtaccgcaagctggcgcgcaaataccatcccgacctgaacaagacgaaggaagcggaggagaagttcaaggacatctccgaagcgtacgacgtgctgagcaacaaggagaatcgtcagaaatacgatgcgattcgccagttcggcatgggcggcgcgcgtttcgccggcggttccggccagggcggcttcgacgcgggcgcgttctccgacatcttcggctcgatgttcggcggcggcgcaggcatgggcggcaatggctcgcgtatccgcttccagaccaatggcggcggcaatccgaacctcaacgacatcttctcgatgttcggcggcggtgcgggcggcccgggcgcaggctccgtctacgaacgctacggcgctgacgattacgagcagccgcagccggaaaacggcgaggaccgcaactccaagatccgcctgaccttccgccaggccgtcaagggagccacggtttcgctgtccgcggacggcaagaagttcaagacgcacatccccgccggcgtgcgcgacgggcagaagatccgtctcaccggtaagggcaagccgggccgcaatggcggcaaaaacggcgatctgtacctgcatatcaccgtcgccgaagacccgaaattcaccctgcgcggacgtgacatcatcatgccgctgcccatcaccgtcagccaagccgtgaacggcgcgaaagtgacggccacggatatcgacggaaacgaaatcgccttcaaagtgcctgccggctcgtccagcggcgcggaagtgcgcatcgcaggcaagggcgtggccaatccgcacgagaacggcgatttggtcggccgtgtggagatccgcgttccagagcatccgaacctcgttgccaagcatgccgcgaaggaattcgacaaggcgtgcggtgacttcgccgacgagctcgttcgggagcgctgaccgccatggcacgctcatcgcggacttcccaagcctcccaagcgcgcgccgcacggcagatcaagcggctgtatgaaatgtgcgccatggcgatcgtggccggccgggccgacctggacggtgccgccgaagtcggtttcgacatcgagctgcccgtcttctcggtcggtgcggccggcgagctcgccaacgtgcatccgcagacgctgcgccagtatgatcgccttggcttggtcgtaccgcaacgtacggaaggtggcgcgcgacgctattcgctgcgcgacatctcccgcctcgcgcaagcgcagcaactcagccaggaggaaggcatcaacctggctggaatcacgcgcatcctcgaacttgaggaagagaaccgcgagctgcgccgccaagtggagcggctgcgcaagccggccggttccagcgtgttcgccgcggacgcggacggtggcatcgtggaagtcgagcggtcccagcgcgcgcgcatgtggcgcaggcagctgcgagccgatgcacggcagcttccgtcgcgcgaatccgtacgggcggaacgtgcggaagagggggacgatatgggctccaggtcagtggtagtttggggaattcgctgacagcccattcgctgactttcctgaaaagcgctggaaaaccctaaaaaaatctaaaaaaacagcaaaatcgggcatatatcgcgggggtatgcccgatttttggtatgcaactactcataacgccgcatctgtctcgcaatgatgtctctattgtgaggaataatattacgtatccgcgttgaagttcgcatttcttccggctggcctacagcttcgatgaaatatgactgcttatttccgcgaagaatcgggggagggcatgcggtggatacagaaaggttaggagcgtacagtgccaagagttgcgttcaccgcaaagacccgcaaatacctggggtctctcgatgctgtggaatcagtcactcagtatcgaatttgctattccaaggaattccgtgacgactgcatgcgcaggtatgccgagggtggctcgcctgccgcgattttccgcgaggccggcttggatccgaagatcatcggctacaagcgcgtcgagcgttgcatcgcccgctggaaggcggagaatgccgagaaggccgctcaggagcaggaggctcaggagtagtcgcacgcaagtcttgcgattcgtctaaaaggggtctatgacggattgctgcgattgcggccgaccgatttcgtcggatgcgttgttcgttgcggaggcacttgggggatttccaagtgcctccgttgctatgggttggttgctgcgttggcttgcgcgaattggcttgtgcatgagtcggtttgcgtgaaccgattggtgcgagccgattggtatgaaccgattggcggaccggcttgatggaaccgtcctgtttttttctgcgcgctgaagcgcttccgtcgtgccgctctgctgaaatggtcgtagctgacgaagaatgtagctatcggagaacgaagcgtaacgattgcgaggaaacgtaatgaccgagctgaacaacggtatccagaacggcgcccaggaagtttcgaagctgatgctcaaagccgtgttctgggacatggacggcacgctgatcgattccgaaccgtattggcatgaaggcgagctgaaaatcgcagccgaccacggcggatactgggatgaggacctcgcttggcagggttccggaacgccggttccggacgtggcccgccgcatggtggagcacggctgcaagctgtcgatagaggaaatcggcaaaggcatgatcgattacgtggcgcagaaggaattcgagcgcattccgtggatcaatggcgtcgaagacgtgctgctgtcgctgaaggaggcgggcgtgccgtcgatgcttgtcaccacatcgccgcgtcatctggcggaaaacctgatcgcgcaggcaccggccggcacgttcgccggttacgtgtgcggcgatgacgatgtcgagaagaagccgtcgcccgcaccgtatcttgcggcgggccgcaagcttggcatcgcgcccgaagacatgaagtattgcatcgcggtggaggattccatgtccggcctgcgctccgcggccgcatccggtgccaccacgctcggccagaccggcttcatgcgcatcgacaattccaacggcccgcaattcgcctcaatcaacggctacgacggcatcaccgccgccacgctcgacgcctacgtacgtagccgcaacgcctgacgcctccgcaatgcgtgtggtgcgtctgcacaaccggcgcgccacacgacataatcgccattattaatgtttaatcgaagtcgatatcgccgtcgttttgcagaaattccatgagattgaggtgacgtacgccgtcgcgctgcaatggtagcggatccaatgtgaacaggtatttcggatacccgtccgccaatttgctgaacgggcgatattcgcgttcctcgacctgcggatcctgaacgctcatagacacttggatataggcgtactggttgcgctttcggacaatgaagtcacattcaagtttgccgatggtgccgacgctgacgtcatagcctttcgaccgcagatgcgtatatagcgcgttctccagtgacggaccgtagctgactcgcgtatcggtattacgggcgaaccggataccgggatcggcaagatagtatttttccccgcccctgagcgacttgcgggatttcagatcgaagcgaggacacttgtagaggattttggcgctttccagcaaacggacgtagctggcaagcgtttcgcgtttgatgctgatgccttcgctgtgtttcagatacgcgataatgccggaaagattcgtgggcgctgcgaaattattgatgagatagtcctgcacacgggtgaaagtatcgcgattgcgtacttttttgtgggcggtgatgtccttgttgaagatctgcccgatgacgtcttgaatatatgcggcttttgcgtcgggatcgtcatattccagcgatttcgggaacccgccgtatgtgagatagtcgcggaaggcttgcgataccggaatttccggtttgtttaggaaattccgcatgccgaggtattcctgaaaggaaagggtgaacatttccagcttgatatagcggccggtaagtttcgtggcaagctctccggacagcagataggaatttgagccagtgatgaaaatggagcaattaccttcctcccgccagccgttgatgacggtttcgaagcctttcacgttctgtacttcatcgatgaacagataacgcagtcctgcaccgtaggcattcgacatggcttgttcgatgagttgatcgagttggtccggagtggtcacattacggtattcgcggcgatcgaggttgaggtagatgagattggtttcagggattccctgctcaaagagctcgttgagaactgtgatgagcaggctggatttgccgcatctgcggatgccggtgattactttgatgagaccggaatcgttgtagaaaggacggagcttggccaaatagtgctctctgcgataggtgctcatgtggtgctccttgtgactttttagataccgataatccctgagatatggtttaacggggtcaaaattgcgaaaattgcaaaaatgaccccgttaaaacgctagtttaacgtatttttgggtttgtgtggactgtttgacgtggactatcgtacgggttttgcgaaaaatgcgattttaacggggttaaaatcgtaaaaatcgcgaaaatgaccccgttaaatggtttttagaagtcggcatgtatggcgattcggctgggttgcgtttgcgtggccggtgcggacggcgcggtgcgtgcgtgcggacgggcgtatgcacggtgcgaagagcgctggaaagtgcgtatgggaatcgcaagaaataccggaaacggcggaaaacaaaagaaaaagcccgctgcggtggaatgaatgcagcgggcttcgtggagctgacggtagtcgaaaccgcgacctcttcgatgcgaacgaagcgctctaccaactgagctacagccccatgtgcgtcaccttatttagcaagacaactctcgaaatattagtacggagtgtggaaaaatgcaattccacactccgcgtgttgtgcttgcgttgtattcgccgatatttttacgacgattgaacgctgcttattcggcgtcggcggtttccgcagtgtcctcggcagccggcttcttcttgccgaacttggccttgagcaggccgacgatcgttggaatcagcgacagcacaagaatcgcaataatcaccaattcaaaatgcttctgcacggccggaatgccaccgaagaaatagccgagcagcgtgaacagcgtcgaccagcacaggccgccgagcaccgagaacggcgtgaaacggctccaacgcatgccggaaataccggaaatgaacggcatgaacgtgcggatgaacgggaagaaacggccaaggaacacggccagcgggccccacttctcaatcatcttctcggttttctcgatgcgctccggggtcatggccttgactttgccggattcaaggatgcgacggccgaagaaatggccgatccagtagttgcactggtcgccgatgatcggcgcgcaccagaccaccggcagtagcgcgaacagcggcagcgcggacacgccggtcttcgcgtcgggcgcggcgaagaagccggccgcgaacagcagggaatcgcccggcaggaacgggaagaagaccacaccggtctcgatgaagacgatgaggaagatgaagccgagggtcggggcgacgcccatcgcgatccagctggcgatcgcggtacgggggtccttgatgaggttgacgaagaaattgatgatattcatgggtctctctgtgtgtttttgcgcggttgcgcggggtcggttcgtgtggcttgcttttccatcgtgcgcaacgaatgtgccgttgcgaaccaatcacagactaccaacgggtctatgcagtgtgcgtcgcagtgcgacgacgggtggcaaatctgcacaaatcgtcaatatgtgcctatgggagcctatgtgcgtgtgcttgtaggtggtgttcggccggtggtgcccggtggttgttcaatggttgtccggcagctgtccagcgtgctcagcggctgtccggtgcgtccggcgcgtccggcgtccgcgtggggcacgccggcgaatcctggcctgaactcgttgtattacggcgatcgtcagatggtgcacgagtcgcgttccgtctgattttggcgattaggtggcgcgaaacgtcgcacgtctttgatttttggcggttattttcaagtcgtgcgacgccaaataccccctaagtgccgttttcgaccggaaaatgccggttagggggtatttttactcgattaaatatcgcacgacttgttttttggtccgaaaagcgaagtcgtgcgacaaaaaagacgtgaaaagacgcagaaaaaacgcaggaatggcgattattcggcaatcgcgtcggctgtggcagagccggtcgtggcagcgtcggtatccgcaaatgtacgacgcatccacgcgatcgcaagttccggccagacctgcacgcacggttcgatgccgttgaccccctgccatgcggtttcggcggtgccgagtgacaggccgtggccgccgctggggaacaggtgcgcctcgacgctcacgccggccttcttgcaggcgtcgacgagcatcagcgtgttctcatacggcacgcaatcgtccggaacggtatgccagacgaacaccggcggcgtcttcgcgtcgatatgcttttcgatcgaaacggcgtcgagcgcttccggatcggccttgcggtcgccgagcagcgcatcgaaactgccgcggtgggcgagcgggccggacgtgaccaccgggtaggcgagcatcaggccgttcgggcgcaccgcatccgcatcgtaaccatgtgccgcgagcacgtcgtcgctggcggaagtcgcaagattggcggcaaggtgaccgccggcggagaagccgatcaccgcgatcgcgtcggcatcgcaatgccattcgtcggcatgcgtacgaatccgccgcatcgcttcagccgcttccagcaacgcgaccgggaagatggacggtttcacggaatagcgcagcacgaacgcgttgaagccggctgcaaggaattgcatggcgattggttcggcttcgcggtcggacgtcatttcgtagccgccgccgggaatcaccagcacggacgggcgcttgcgattcgggtcgatttcgctgctgttgtcaaggcagtagccgacgaacgtggccgtgctgccgtcgattccggaaatttcatcttcaaaataacgcatgattccatgctatcgatggcatgtccaaagtcgtgttgaatcgccgtctcacccccgtctgagaaaatccgaatcctacgcaaaggaaaatccgaatgtcgtacgaagaaaaatccgaatgcgtggcgggtggaaacccggatgtgtgaggggtgcattttgatttaccggtgaggacgtgtggcgtcgtcggtggtttggtcgggtttcgattggtcggttgcgaaaggcggagaaatggcgggggctgatggtttggggacgctgtgggcgatactggaaatatggagaacttgagcgaacagactgatgccgagaaggctggtaacgccgtgaaacaaaccgtgaaaacaaatattggtcagattgccgaaatcggcgagaatgcggaaaatgccgaggaaaccgcgcaagccacggaacgtgccgaattcgggctcgacggactggtcgccgacgtcaacattccgcgcggaacggtcgtgctcgcggccacgccgatcggcaacaccggagacgcgtccgcccgcctgatcgctctcatggaaggcgccgacatcgtggcagccgaggatacgcgccgcctatacgcgctcgcgaaccgccttggcatccgcgtgcccggccgcgtcgtcgcctaccacgaccacaacgaacgcgacaaggccgacggcctgctcgaccaggtcgaacaaggcgccaccgtgctcgtcgtatccgacgcgggcatgcccaccatcaacgatccgggactggcgatcgtccgcagggccatcgaacgcggtctgcccgtcacctgcgctcccggcccatccgccgtgctcgacgcgctgtgcctgtccggcctgccgaccgaccgcttctgctacgaaggcttcctgccgcgcaagcacagcgaacgtgtgcagcacctgcgcgcgctcaaatcggaacgtcgcaccatcgtcttctacgaaaccctgcatcgcatcgacgagtccatggccgacctgcttgacgtgttcgggccgaatcgcaaaatggcgttgtgtcgcgagctgaccaaggattacgagcagatccgccgcggaaccatcgccgaaatccgccaaagcgtcgtcgacgatccgctgcgtggcgaaatggtgctcgtcatcgccggcgcttccgaggaggaggccgacgctgccgcgcccgcaacgctgtccatcgatgatctggcggtgctgtcagtcgaccgcgcgcaggaagacaacctgcgtatcaaggacgcgatttcacaggtcgtcgccgaacatccgctgtctgacggctcgctcgccaatcgcaagcaggtctacaatgccgtgcttgcgatgaagggttgatcgcttccggaaccgttcatttccaacgatttcagcaatatccgcagcgcttcgggaacacccggcccgccgacctgcgcaagatattccagcatcgcaggcgtcgccgaaggattggcgaccagccacttgcgcaatcgcggcgcatattccgcgatatgccacagcacatcttgcgcggtgtcggcgctgcacgccaccaacggcgtcaattcgatcggcggcgcaggcggttcgaccaatgcccgctgccgcgcgtgcggctgatatttcggcggcgcgcgacgtcgttcgtggcgtttgccatggtgtccatgctgttcatgtcgttgcccatgacgtttgctacgtttcgtgcgctcttcatatctcttgcttgccgtgcgccgcgactgtgccgacgtttgccgtgtctgtctcgtttgccgtggtttttccgacggccgttgcgattcgcgcatatccgtcactgctttccgtcaatcgtccggaaaaactggcgtgcccgtggcgcgttgcgaatatgggtggcctcctgcatgacctgcaggcaatcgtcggggcggaaccggaattcctgcatgagcatgcatacgatttccgtgaccggcgactgcgtttccggcgtgcagttcatggcaaggtcgcatgcggtgcgtgtgggcgtggtgacggtgatcgggccgacgtcggtgacatgttcgtcgggcgcctgtcggttgaaaacgctgactttgcgaccgtacctcgccgttcggtaatgcgcttttgcaatgatgtcgatcgtgttgggaaacatgccacccaaccacacccacgcagcggtgccggcgcacgccacggaacggctcggcatcagcgttgagatgatgctggcgcggccgtacagcgtgcgcgaatcgtgatacgagtaggcgttgtcgttgtcaagtttgcataccacgcctagggaatgcaaacgattcaaacaaatggggccgggcaggtcggcgtcgcccaaaaggggaggggaggtatccatgcggggtaccgtagctgatacggaaagcggcgtgccaccggcttcgcgaaaaaagtggataagtggacgatgattgttgcgtgatacaacaatgtggataaccttgtggactaccgtagcctgatgcaggccggtctgcgagaacgtcatcgaccccatccgcccgttttccgccaatcggaatgcgccgaaaacacgggatatggcgctttgtataatcgggcaccatgagtcatattttggtgaatgttgcatggccgtatgccaacggcccccgtcatatcggccacgtcgccggcttcggcgtgccgtccgacgtgtacgcgcgctacgagcgcatgaagggcaatgacgtgctgatggtgtccggcaccgacgagcacggcaccccaatcctggtggaagccgacaaggaaggcgtgagcgcgcaggagctcgccaaccgctacaaccgcgtgatcgccaaggacctatgcgatctcggcctgagctacgatctgttcacccgcaccaccaccggcaatcacgaaaaggtcgtgcaggaactgttcaaacagtgcctcgaaaacggctacatctacaagggcacccagaaagtcgccatctccccgtccaccggacgcaccctgccggaccgctacatcgaaggcacctgcccgatctgcggcgccgacggagcccgtggcgaccagtgcgacgcctgcggcaacgaactcgacccggacgagctgctcaaccccgtatccaagatcaacggcgaaaccccgcgcttcgaggaaaccgaacacttcttcctcgacctgccggcgctcgccgaagccaatctcgcgtggctcaagacccgcgaaggctggcgcaccaacgtcatcaacttctccatcggcctgttcaaggaagtcaagccgcgcgccatcacgcgtgacatcgactggggcattccggtgccggtcaagggctggatcgacaacccgaacaagaagctgtacgtgtggttcgacgctgtgatcggctacttgtccgcatccatcgaatgggcccgccgcaagggcgacccggaggcatggcgtgcgtggtggaacgatccgaccaccccgggctactacttcatgggcaaggacaatatcacgttccactcccagatctggccgtccgaaatgctggcctacaacggccagggctccaagggcggcgaaaccggcaagctcggtccgctgaacatgccggagcaggtcgtggcctccgagttcatgaccatggaaggcaagaagttctcgtcctcccgcggcatcgtcatctacgtgaaggacatcctcgcccgttaccccgtggatgccgtgcgttactacatctccgtggccggaccggaaagctccgattccgacttcacttgggccgagttcgtgcgccacaacaatgaggagctcgccgcatcctggggcaacctggtgaaccgcgtggccaacctcatcaacaagaacttcggcgagattccggcgttcgacgaggcttccgccaccgacgaggaccgtgcgctgctggccgaaaccaaggccgcgttcgaaaccgtcggcggactcatcgaaaaccaccgccagaagaacgcgctgtccgaagcgatgcgcgtggtcggcgacatcaacaagtacatctccgccaccgaaccgtggaagatcaaggacaatccggcccgcctcggcaccgtgctgcacaccgccgcccaggccgtgtccgacgccaaccacctgctggccccgttcctgccgcactccgcacagaaggtgtgggaggccctcggcggaaccggcgtcttctcgccgctgcctcatctggaagaggttgaggatctcgacaagccgggcttcacctacccgatcatcacgggcgactacaagctgggcgaaaccgtgcatccgtgggcttccgagccgatcgtggccggcacctcggtgccgaagccgcacccgatcttcgcgaagattccgccggaggccgtcgaagaggagctcgcccgcttcgatgccgagctgaaggcccgccgcgaagccgaggccgcccgtctcgccgccgaaaaggccaagctggaaggctgattccgtcgcataacccccgtacgcgtcgcacgactttgatttttggacgatttcttcaagtcgtgcgacagctgcggtgcgataagtgccccctaactgctgtttttaggtcaaagtgaccggaaaatggcggttagggggtatttgttttgattgccgtgtcgcacgacttgaaaaaagtgccgaaaaatcgaagtcgtgcgacattttgtgccgtttcagcgtctcattcccgtatcacgtttccacatgtgcgacgttttgtgcgattggcgggcccggcggccggttgaggtatgcgttgacggcacactcaaggccgttcggccaagcctatggccttacaacgcatatacgaccgaccgcatccttttcgtaggtatgttccggttgctttcgcattgttttgggtagaaatgcgtgcgatttttcagctggtcttggcggggtgtcgcaagacggtactgcaaaccgcggtacgaatcgttaaaaaacgcaagccgctcagtataataaaacgcagagacgtgcaaagctgcaggaagggggctctccatgctggatatcaaacgcgtactgaaggccgcgcctacgaaaatgcgctcccgtgagccgctgcagcagttgtggacgctgtggggcgaacgaatcgagcacgaatggctgtccgcgcgcgccggcaacaaggcgttcaatcccgccgaggaaggcgaacgcacgctggacgagggtcgtacccccatactcggcgagcacccgcgcccgaccatggtacgcgacaactgcaccatgctcaatggctggtgggattacgcgatcgcgtccattccggaagacgaaaccgcgccgaaatggcgcaaaacggcggcgatgctgacccgcgacgaagcggtccgcgcagtcaaggaaaccgccattccgcaaacgttcgacggcaagatcctcgtgccgttctcgccggaatccgcgctgtccggcgtgcaccagaccatttaccccgacaacctgctgtggtaccgcaccgtcgtgcatcccgtcacgctcggcggagaggaaacggtccggcagatcggcgacgcgaatcgcctcatcctgcatttcgaagcggtcgattatgtctgcgcctgctatgtcaacggccagctcgcgggcacgcacgtcggcggctacctgccgttcgacgtcgatatttcggcatttatcgaccctgatgacgcgtttgaaatcgcgctgtgcgtctacgatccgaacgattcgggcacgcagttgcgcggcaagcagaaaatcgagcgcgaaggcatctggtacaccgcgcaaagcggcatttggcaaagcgtctggctggaaatcgtgccggaagcctacctgcgcacgctgacactcaagggggcatccgacggcaagttgttcgtccgtgcggaaatcggcggcgacaagccgaacgcgaaactgcacatcgtcgtcaccgaccctgcggacggcacggtggtggcggatgagacgctgccggcgggcgtgcgcaaggtgcgtgcggaaatcgcaacagctgccgaacatctgtggtcgccggccgatccgtatttgtatgacgtgcgggccgaattgcgatacgggtcggcgaaacccgcggaaacggcgggtgatgcggcggtcgcgcaatcgcagccgatggatgtcgtaagttcctactgcgcgttccgttccgtcgaaatcaaaccggatacgaagggggtggcgcgcttccatctcaacggcaagccgctcttcgtcaaaggtgtgctcgaccaaggctactggccggacggcctcatgaccgcgcccgacgacgaggcgctgacgcatgacatcacggccatgaaaaacgccggcttcaacatgctgcgcaagcacatcaaaatcgagtcggcccgctggtactaccattgcgaccgcctcggcatgctcgtctggcaggacgcggtgtccggcggcggcacggacggcgaatacaatgcgtggaccacgaatcgcaagccgacgctcatccgctccacatggaacaaattccgcgacgacaccgccaaacatttcacggcgctcggcgcggacgacccgatctaccggcgcgattggtcgcgtacgtgcgacgcgatggtgcacatgctcggcgggcacccctccatcgtgacatgggtgctgttcaacgaaggctggggccaattcgacgcgtgcgatgctgccgaacgcatccacgcgctcgacccgacccgtccgattgacgcgaccagcggctggtacgaccagcattgcggcgacttccatagcgtgcacaactatttccggccgctggaaatctacccggacaagggtccgttgcgcggatacgtggccgaattcgagaagaagcaccgccgtcgccgcagggccgcgcattacgtggtgctgccggtcgcacggcacggcgtacgcgcgttcgtgatttcggaattcggcggattggcgcagctcgtaccggagcatgcggcggtgtcgcgcgcctacggttacggtgaatacgattcgatcgacgattggcgggccgccgtgcgttccgtgctcgcctccgcggccgcactggaatcgcgcggacttgcgggatacgtgtatacgcaggtttccgacgtggaggaggagctcaacggcctgctgacctacgatcgccgcgtcgacaaattcaccgagtgagatgcgcgattgcgtgtgagtgcacggcgtcgttgagcggcggtgttgtatagcggcgtttcatgacggtgtcggcagatgccgtgcaatcgtctgttgccgcgctgaacaagctgcaggaaggccgttggggcgatattcagtgggataaacccccgaattcgcaccgtcgtgacatttccgctacgaaattctcagggaattgacaggaacacacatcgttcctccaagggtcgggcggttatatagaacatgtcaacggttacggctgttggcgaggttctttcaagaatcccataactgaacccttcttctctcttctctctcagccggcggccttctctccgccggctttctttttgccggcttgcttgtggatggtttgacggcttgattcggtccgcttgctcgtggatatccgaggaggctctccgcacgagggaaaagcatgtgccgctggcctgtgcttcacgctttcctgcactgaaaaataaccggtaaacgttttctaaaaaatcggagtgtcgcatgtcgccatgacctacacttgaatgcaatatacgcagcatacaagcgcggcagggttgctactcaatgcgaggcaagacctggaacgacgtcactatacgtcgttccaggtcttttttgtttgctgcgattgctgcatctcatatcgatgaggatcgatgggaatggaaggtggaatcatgactgcggtgcagacgtccaatccagtacacgacgccgaaggtgcggtggaagccggcatccatgaggtcggcgcgacgatcgacgccgtcgagcgggaggtggggcgtggcgtttccacacgtttcccgctcaacagcgcgttcatcttcacgttcggcgcgctgggaggcatgctgttcggcttcgacaccggcatcatctccggagcctcgccgctcatcgaatccgatttcggcctgtccgtggctcagaccgggttcatcacatcatccgtgttgatcggttcctgcgcgggagccctgtccatcggcgcgctgtccgatcgtttcggccgcaagaagctgctgattctggcggcgatactgttcctgctcggttcgggcatgtgcgcgggatccacgggattcctgatgatggtcgtggcccgcatcatcctcggtctcgccgtcggcgcggcctcctcgctgactccggcatatcttgccgagcttgcgccgaaggaacgtcgtggatcgctgtccacgctattccagctgatgatcactttcggcatcctgctggcatacgcgtccaatctcggcttcctcggccacaatatcgccggcatccgcgattggcggtggatgctggggtcggcgctcgtgccggcggccctgctgctgatcggcggcctgctgctgccggaatcgccgcgatatctggtgagtcgaggcaaggatcgtgaggcgttcaaagtacttacccttattcgcaaggacgtcgatcagacgcaggtgcagctcgagctcgacgagatcaaggccgtcgccgcgcagaacaccaagggcggtgtccgcgagctgttccgcatcgcccgtcctgcgctcgtcgccgcgatcggcatcatgctgttccagcagctcgtcggcatcaactccgtgatctatttcctgccgcaggtgttcatcaaaggcttcggattccccgaaaaccatgccatctgggtgtcggtcggcattggcgtggtcaacttcgtggccactatcgcggccacgcttatcatggacaaattcccccgcaagaagctgctgatcttcggatcggtgacgatgaccatcgccctcgcggtgctggccgtgcttaacttcaccggcgatgtggccacgctggccgtgccgaccatggtgctgatcgcctgctatatcctcggcttcgcgctgtcatggggtccgatcgcatgggtgctcatcggcgagatcttcccgttgagcgtgcgcggcatcggcagctccttcggttccgctgccaactggctgggcaatttcgtggtctcccagttcttcctcatgctgctggccatgttcggcaacaacgtcggcggcccgttcaccatctttggcgtgttctccgcgctgtccatcccgttcgtgctgcgtttcgtgcctgagaccaagggcaagtcgctcgaacagatcgaagaggaaatggtccgccgctgatacggcgtcgcggcatcgacggccattgaatggggcgggcactccggaggagtattcaccccattcacgttattcaacagcgttcgtatgagaagcggcggattcgatcaaggcattcccggctttcctcaagccatggcatgccgatgacgaacacatgccccaacgtctcatggcggcgcggcttcgggtcgaacaattcaaaatcggcgcctttgcgcgacaaggcggcggccaacgccagattgtcggcttcaaggaaatcgtcgccgcaggtgatgatgagcaagggtggcagatcgacgttgaacgccagaccctcagcggtgaggaacttcggatcggcggcttcgagccccgcaaagaaatcgacgcccaacatctgctcaagaccgatacggcggttcgggtcatacccgaccgtcagcttgcggcccatggtctccaacgacgccgaactgtacgcgccgcacaccggagcggcacccgcgaatcggatgccggacggcttgtcgacgccaaacgcagccgcggcttccgcattgttttcaatggccaaggtcagtagcgtcaacgcgccacctgcggaatcgccggtgaggaacaccgcgttcggattgaccggataatcggccatatgggctgcgatccaacgcaatgccgcctggatatcggccaattgcccacgcaagtcggtctgcggcgccggacgatagttcaatgaaaacaccgcgaagccctgttccgcgagatgcacgttgaaattccggttcagctccttgtatccgtaagtgaatccgccgccatggatatcgatgtacaccggcagggtgtgcccaccgcgcaataccgcgtcatgcggcagatacaggtcgagcaaatggccgcggcacgctcccgcggccgtatcgtacccgccatccggcaggtaggcgaggtcggcgattacatcgatgtcttccggcgtgctccagcgttcggaacgcggcgtatcgatggcgatcgcgccaaatcgcattcccagaatgcccggcagcaggttctcgggaaccccttcgaggtcgcccgtggtctccgtccaacgttccgcgttcctgagcatgtcctccgacaggccatattccgcagcgaacttcgcgcggatgcgctccaagtccgtcatccttgccgtcctttcctcgacgtgcgtcgccgatgcttgtatcgatagttcgagcttgattccattatcgtgcgatgttccgatgcgatgctccgattccggcgagccaggctccgatgacggttttcgcagcacccgcaaaccagtggtatgtaacggtatatatgttgattttattatgattgcgacacgccgaaaacgcatctgttgcatcggcgtacggttcgtttaaaataagtcgagtttgcgaatccgaacaggggtttcggccggcggcggcatgccggtgacgggacgctcgacacacgacggacgtgaatcgtggcggcaacgaatggccgcaacaccacaacccaacaacaacccaaccaagacccaagcaaacaattcgaaggaacgctacgtatgtatgtcgatccgaaacgcaaccagcaggcgggcaaccttgcatggatcctgccgtactgcaaacccgacctgccgcgcgtggccggcgcggtcgtactgttctgcgtgaacaacaccatggccctcaccatcccgctgctgtccggactgatcgtggaccgcgtcatcacccaaggccatgtggacgaactgacccgactgtgcgtcatgatgctcgtgctcaccgtggtgcgtgtcggctcccgttacggctgccaaatgtggatggaacgcttcggacagaactccatctatcgtctcgtcagcgacgaattcgaaaaactccacgaacttgacttcacctacttcaaccacactcgcactggcgacatcatgagccgcatgacgtccgacaccgacgccatccgccacgcactgagctgggtgagcctgcaagcgcttgactgcgtggtcatgttcatcggcgcgctcgccatgatgttttcgattgattggcgacttgctcttgcgctcgcttgcgtcacgccaccactgttcattttgacacgcggtctgtcgaagcatgcacgacccctgttcttcgatatccgaaactcgctcgccgaaatgaattcgatggtcgaggaaaacatcgaaggcaaccgcgtcgtcaaagcgtttgtgcgcgaatcgtacgaaaccgaaaaatttgacggacgcaacgacgactatatgcaacgcaacatggcccaggcatacaacagccgcaaatacatgccctggcttgacggtctcggcttttcgctgcaacttatcacactcggtttcggcggctttctcgtcatcaaagggtacatgactcttggcaaccttgtggcgttcaactcatacctgtggatgcttgacagcccaatccgccaatccggatggcttaccaacgactggcaacgtttcaacgcggcatgcataaaaatccgtaagctgctcaccgccgaatcgcgtattcgcgaaaagccggagtttgcggggaaagccacgcaaagcactacgcgagtcggtacgcaaggtacgcaaggggcgcaagccgccgataaatcggctagaatcgcaggaaccatcgacttccagcacgtcgacttcgctttccccgacgatctggggacgcctgtgctcagcgacatcgacttccacgttcccgcaggcgcgaaactcggaatcctcggcgaaaccggctccggcaaatcgactctcgtcaaccttatctcccgtttctacgacccaaccgccggtcgtgtgctcatcgacggcatcgacgcgcgcgactggccgctcgccacgttgcgatcgcaagtctgcatcgtcgcgcaggatacgttcctgttttccgatacgatcggcagcaacatcagctttggcgcgggcgaccgaggcaaccgacttgagtacaacggtcagtacgacggccagcgcagacgacgtggttacgacgaacagtacgtgcgccgcatggccgccattgccggcgcggatggcttcatcagcagcatgccggacggctacgataccgtcgtcggcgaacgcggcgtcggcctgtccggcggacagaagcagcgactgagcttggcgcgtgctctcgccgacaatccgtcgattctgattatggacgatacgaccagcgccgtcgatatggaaacggaagcagagattcagcggcacttgcgcgatttggacgagaagaagacgattgtcacaatcgcccaccgcatttcgtcggtcaaggattccgacttgattctcgtgctggagcatgggcgcattgtggaacgtggcacgcacgacgaattggtggcctcgcacggccgatattggcagatttacagcaagcagttgggcgtggatgccggccgctcgcagggattcgaagcgtaagacgcgggggaggataacatcatggcacaacgcaacaccttccgtgacgatgaagaccttgaagagaagatcaatatgcgcgacctcgcgcgcgtcggcgtctacctgaaaccgtacatggcccgcgtggtctggatcctcatcgtcgtggcggcaatgggctgcatcaacgtcgtggaaccgtatctgacgaaaatcatgatcgacagtgtcattccggcgaaaaaccttgcgctgcttggcgagctggtggcactgctggcggtgctcatcgtcatttacgaattcggtttgcgctaccgtactgtggaaatcacgcgcgtcggccagctcatgcttaaagacatgcgccgcgacctgtttacgcacattcagacgttgccgttcagctatttcgactcgcgtccgcatggcaaaatcctcatccgcgtggtcaactatgtgaacacgctttcggacaccctgagctccggtctggtcaacgtgatttccgacgtgttcacgttcttcatcacgctagtggtcatgttcgtcgtggattggcgtctcgcgctgtacagtctcgcgttgttcccgctgctcatcgcgtgggtgctgggattacagcatttccagcgtcgcgcgtaccaggtgctatccaataagcagagcaatctcaacgcgttcatccacgaatcgatcgccggcgtgaagaccacccagacgttcgcgcgcgaggacacgcagttccgcacattccaggaacagcagggcgctgtgcgttccgcgtggatgcgtacggtgcatatccagacgcttatgtggccgggcatccagacgatttccgtcatgacgatcgcgttcatctattatgtgggcgtcaccggtttcggcggtgtggacgtgaccacgggtgtgctgatcgcgttcgtcggctacgcgaacaacttctggaacccggtaatcagcatcggaaacttctacaaccagctgatcacctgctccgcgtatctcgagcgcatcttcgagacgctggatgtgcagccggagatccgcaacgcgccggacgccgtcgatctgccgcagatcgagggccgcgtcgacttcaacgacgtcgtcttccgctatgagccggacggccgcaacatcctgaacctggtcgacctgcatgtcgagccaggcaagacgattgcgctggtcggtcctacgggtgccggcaaaaccacgatcatcaacctgctgtcgcgtttctacgacgtcgccgaaggctcggtgacgatcgacggccacgacgtgcgttccgtcacgttggaaagcctgcgccggcagatgggcgtcatgctgcaggacacgttcatcttctccggcaacgtgcgtgagaacatccgctacggcaaactggacgccaccgacgaggagatcgtggccgcggccaaagcggtgcatgcgcacgaattcatcatggaactgccagacggctacgacaccgtggtggaggagcgcggctcgaccctgtccgcgggccaacgccagctcatcgcgttcgcgcgcgtgctgctcgccgacccgcgcatcctgatcctcgacgaggccacgtcgaatatcgacacgcgtaccgaggaggcgctgcaggccggtctgaaccatctgctcaagggacgcacgagcttcatcatcgcgcaccgcctgtccacgatcgagaatgcggatgagatctgctacatcgaccacgggcagatcgtggagcagggcaaccatgccgagctgctcgcccgccatggcgcctactaccggctctacgaatcgcagtacgccatgatcaaggtctgagcagccgaccgccagccccggcggctagctgctctgccccttagcccgtatatccgcaatccgaaatgcctgtccaacggtcgcgcagccaatgcgcggccatcttgggccggctgccgcggtgggattcccgtcggacatgccgccatgcggaatgtactttggagcaacccgtggaataatggattgtgagcgttaacaagacaacgatgcactaaggagcgcttgcactcatgactaccaccaatcgcaccagccatccaatcgcattgcgcgacgccaccgtcaccgacccgttctgggcatcgcggcaggaactcgtgcgcacccaggtgattccctaccagtggaacgcgctgaacgacaacgttcccggcgccgcacccagctactgcatgcacaacttcaaggccgccgccgcgcagaacgcagaacaccacaaggaaggcaaggccttcgtgccgccgaaatacacgttccgcggcttcgaagccctgccggacgacccggcgcaccccgatcccgacaagttctacggcttcgtgttccaagacactgatttctccaaatggatcgaagcggtcggctactcgctgacccaccacccggacgctgaccttgaagcgaccgccgacaccgccatcgatatcgtctgcgcggcgcagctcgacaacggctacctggacacctactacatcctcaacggcatggaccggcacttcaccaacctgaaggaccaccatgagctgtactgcttcggccacctgaccgaaggcgcgattgcctactatcaagccaccggcaaacgcaagctgctcgacgcggcctgccgtttcgctgattacatcgatttccgattcggcaccgccgacggcaagctgcacggctatcccgggcacgaaatcgccgaaatggcactcgtcaaactcgccgagaccaccggcgaacagcgctacgccgacctcgccgaatacttcgtgcgccaacgcggccagcagccgctctacttcgagctcgaagatcgccgccgtgcccatgagggcggccgcgactacgagccgcgcgaacagaactacgcctactaccaggccgataagccaatcacggaacaaacggaagccctcggccacgccgtccgcgctgcctacttctacgccggagccgccgatgtggcacgcctgaccggcgaccccgacctgctggcatcctgtgaacagctgtggcgcaacatcgtcgaccgaaagatctacatcaccggcggtatcggcgccacacacatgggggaggccttctccttcgactatgatctgccgaacgacaccgcctattcggaaagctgcgccgccatcgcgctcgcgttcttcgcccgccgcatgctggaaatccagccgaaatccgaatatgcggacgtcatggaatcggcgctgtacaacaccacgctcgccggcatggcactcgatggcaaaagcttcttctacgtgaacccgctcgaagtggtgcccgaggcatgccatcgcgatgaacgcaaggcgcacgtcaagccggtgcgccagaagtggttcggatgcgcctgctgcccgccgaacatcgcacgcatcgtggaggacgtgcagcagtacgcctacacgatcggagacgactcatccaccctgtatgtgcatctgtatatgggcggcggcgtccatgccaggctttccggcaccgatgtgcgccttgacgtcatgtccgatatgccctggtccggcaagggatccgtcgcggtgggctttgatgcaggcgattctgcttccgatgcatccaaggacgcggttttcacgatcgccctccgtctgcccgcttgggccggtggcgaaaccgcttccgatgcggtcaccgtgcgcggccgcgacgacatctcccgcgtcatcagagacggatacctgtatctgaccggcgcatggcatgacggcgacgtcgtcgatttcgatttcccgatgccggtccacatggtcgccgcgaatccgctcgtgcgcgaggacgccggaaaggtggcgttcgtgcgcggaccgctggcctactgcgcggaaggtgtcgataatggcgcgaacctgcatctgctgcacgccgataccgcgcgcatcgcatccgatccatcctgcgtgtccgttgatcgcatcgtcttccatgccggcgccgtcgcgcaggacgagcaggggctcggcgaggtggacgccgtcgatatgccgatgaccacgctggcgattcccgcttggcgtgaagtggaagactccgcgcaaacctccgcgttgtaccatgattggcgtcccgccgaacgcaagacgacgacggccacgctgattccatacttcgcatgggccaaccgtggcgagaacgagatgacggtgttcctacgcgggtgagcatgacgagtgacgaagggactgcccgacaaaggggctgtccttggtttcggcaacatcgccaaaaccaaggatgcgccagtcgagttcatcgcatatctccgcttcgagtagacacgcacgtgcgatttgccccatttaccgcttaagctagtaccaggtacgtcaatcgatgcatgtcaatgatcaggcggtatctgaacacggttgaggagtcgaagatgataagcggtgccggtgcaatgaaccccgtatgtccccgtgaggacgggcgtctcgaatggggcaatggcgtggtttccatgctgttcgacacggcaggcgattcccccgtccgattgtgcaacgttgcaggccgcggcatggggcccatcggcggccgtgttgccgacgatggaagaaccgtgctggaacgtgatccgcgtccgatcgtcgaagtgcgtgccgccaacaccggatcgcaggacaatcgcctcaccttgatcgccacggtggcgggcagcgtattgcgattcgtctcggccgccgcctccgagccggaggaagggtccgccgaaccatatcgtttggagatcgtccaattcgcttcgtatgcggaactggagccgcacgggcgcgcgttcgaaccgaccgccgccgaacgggccgaagccgccgcgcagccctcgccggaaaccgtccgccatgccgacgccacggctgggctggtagtcacttccgtattcgaagcgttcccgggtctgtccgcagtgcgcacctacgcgcggttgagctccgcgcgcccgctgcctatcgaggcggtgtcgtcgttgaatctgacggtgccgatgcgcgtcaactgcggcaaaatcgaccattcccgcgtattctggggagactccgcgtgggcggtggaaaacgattggcgcagccgtccactgcgcgacgtatcggtgcgcaatcgcaatcaagtcatcaatcccggccaatccagctcgcgattcgccatgagctccgcctccacatggagcaccggcgtgcatgagccggccggcatcgtacaggtcgagggctcgcgccgccaatcgcgcgacttctccgtaatgtggcagatcgagcacaacggcccatgggaatgggagatcggcgaggatgatcccggtttgcacatcagcgcgttcggaccggaatatcaggaccaccattggtatacggagctgggtgaaggccacgatttcgaatcggtgccggtctccttcgcgatctcggccggcgattggcagcagtccgtcgccgaaatgacattgcagcgccgtgcgttgcgtgccgccaaggctcgcgaattgggtcgttccgagcagttcgaacgcacgcagggactcgtcatctacaacgattacatgaacaccctgttcggcgacccgcgcttggagaaggagctgccgctcgtcgagggcgcggcacgcgtcggcgcggacatcttctgcatcgacgccggctggtacgacagcacggacggcggttggtgggacatggtcggagaatggcaggcctccacgaaccgtttcggcgaagctggactcaagggtttggccgacaccatccgcgcgcatggcatgggcttgggattgtggctcgagcctgaggtgatcggtgtgaaatcgccgctcgcccaaagtctgcccgatgacgcgttcttccagcgccacggtgtgcgcgtctgcgattcgggccggtacctgcttgacttccgctcgcccgccgcacgcgagcacgtcactcgcaccgtcgaccggctgattgacgatttcggcgcggtcttcttcaaattcgactacaacaccgtccccggcgtcggcactgatctcgacgccgaatccgccggcgctggcctgctcggccactgccgtgcctatttggattggctggacgacctgcgccgccgccatccggacgttatgatcgaaaactgcggttccggtgcgatgcgcgccgattacgcgcagttgcaacgattggacctgcaatccacctccgaccagtgtgatccgctgatttacgccgcgatcgccgccggcgccggactgacgatcctgccggaacagcaaggcaactggggttacgcccagcaggagatggacgatgagaccgccgtcttcacgctggccacgggcatactcggcaggttgtacctgtccggattcattgaccgcatggacgagcatcggcttgccttggtgcgggatgcggtggccttgcaccgccgtgtgctgaccgagcagcaggaattggtgccgttctggccggcccgtctgcctgatttcgatggcgattggctcgtcgtcggtctgcgccatccgtcattcctcccgtcggaggacgacgattcgtgcgattacatcattgtctggcgtcgcggcggcacgccttccgtgaacgtgccgctgtccgaggactgccatatcgagcagatcttcccgaatccggccgttcccgagcatgcgcccgacgccaagccgtggaccgtcgagcgcatggaccccgagacggtccggctcaacgcggccacctccaagcagccgtccgcccgcatcttcgccatccgccgcgcctgagcggttgcgacggatgggcaatcgcgccgcctacagggcgaaggcggtttcgatggcgtcgtattcggcggccgtgatcggcagaatcgcgccgtgacgcttcttcagcgcgccgaaatcgatatcgtctgcgcgctgccaatcggccggatcatgcgaggcgagcgaggcggcgcggaacgacaggtagcccttggactccgcgtactggtcgcacatcaggccgaatggcatggtcctgccgttgatcaccttcacgtcttcgtcgttgtaacggaacagttccggcccttccaagtagtgcatggaataccggccattgccgaagatgtcggtgagcgtgcccacatacgaccactcattcgggtcgtcggtgcgcagcacctcgtaggtcgtcgcatacgggttacgggtgcgttcgatggtgatttccgagtccttggacgcgcggtaccaccagccgtcatcgtcgcgcagcatggtcgaatcgatgatcacattcttacgatcgatccacttgaccggatcggagaacaccctgaaatcaacggtcgtcgcataatacacattcgtcggatcgccgagctcgttggccaacggatccgcggagctttcggcgttgctcttcgtggaccagaacacgatccactgcccgcgatccggatcccaattcgcctccggagcccaagccatgccagcgtccggaatcttcgaggccacgtccaccaggcgcggctcgctccaatggaccaggtcaggggagtcccagatcaccaggccggtcgatccattcgtggtggcgccatcgttcggcccccagccgccacggtaatagatgctcaaatcggtggccacaatgtggaatccatcacgtgggtcgcgcacaatatgcgggtcgcgcacgcccttctcgccgcctagccacgtcaacgccggactgccggccgggcgcagatccctccaatgcacgccgtcgcggctcagcgcgaagtacagctgttcgtcggtgggattgcgttcctcgccgacgaaatgcacgaacagataggcctgggtgtcgatgctcatgatgctcctagagattccttgatgaatgatggcgattgattccgattgagtgattccgattgagtgggattggccgcgaaggctgctgcctatggcggattgcctgccataggggcgtcatcctcagaccgcggtcgattcccggtccaccagctggtagccgatgatggcccgtcttggcggcaacgcctcgtctgctccatgatcgatacgctcggacagcatgtcgaccgagaatttcgcaagctgcgtgaaatcgacctggatggtgctcaacgccggcgtcgtgtacgacccggaggtcacgccgtcgaaaccgatcaccttcacgtcctgcggcacgcgcagtccgcggtccgcgagcccgcgtatcacgccgaacgccgcgaaatcgttggcgcagcacgcgccgtcgaactcggtgccaccatgtccgctccgtgcggcgagaatacgttccgcaatcgcatgcccggcgatgatgccattggccacatccccggcttcgaacaccatcgactcgtcatagggcagtccggcgtcggacagcgctccgcatgcgccgcgcaatcgcagagcgaacgcgttctgggcatgcgccagatcggcgcggggggcgaaccggtggccgacgatcgcgatattgcggcatccacggtcgatgagatgctgcatcgccgcgcgttcggcctcctcgttggggaagttcacggcatcgacggtcggcgtctcctcgcaggcgtccagcagcacgaatggtctgccgccattgagtttggccagcggcacatttgtgcccaagcctgtggcgtgcaggatctcgccatcgaacagctgcccggagaacggattgctgctcagcgcgtgctcggcagcgtccggcgaatactgcgtctgctcgatgaatggaataagtccgcgggacacgatttcgttgctcaacgcctgcgtgagctttgaatagaacggcgaatcgaattcgttgacgatgacgtggatgatgttgctgcggcccgatttgagcatgctggccgtcagattgatgcggtaattgagtttcttcgctgcggcgatcactttggcgcgggtcgattccttgacgcctggcttgccgcgcagcgcgttcgacgcggtcatgggggagacgcccgcttccgcggccacgtcgcgtagcgtcggtgtgctgctggtcatatgccgctccttgaaaacttatgattgatatgtaacgatattatattctcttgattctgtaaaatcgttgcaaatacaaagactcaccgatatattgcctccattgcggatgattggatttgcgctagtatatgtaacgatacatatacggttcgcatgacggcgtcctgctttccgcgacacagcccccatagcgatcccgaacgaaaagagaggttcgatgacgatcccaaccaccgtttccgtcgccccggctgacgaatatccggctgacggccacaccatgaccgacaaactcaccgccacactcgacaaagcgggcgtgcgcgccatcagcaccgacctgtggggcatcttcttcgaagacatcagctactccggcgacggcggcctcaacgccgacctcgtgcagaacggcgccttcgaatacaaccgcgccgactccatcgattggagcaactacagcttctggcgcaaaatcgtgccggaaggctcgttcgccgcgttctgcatccatgacaacgacccggtcgccaccgaaaacccgcattacgcgacggtggaagtcgaacacgcccctgccgcgctggacaacaccggctgggacggcatggtgttccgcgccggagaaacctacgatttcaccgcctggatgcgcgtgcgatcggaaagcgcgatgccggtgacggtctcgctgcgcggagacgacggcagcatcatcgccgaaaacaccatcaccgtctcagcctcggcatggacgacataccaagcctcgctgaccgttcctgagcacggcgatgccggctcgagcgtggccacacagggcacattgcgtctggccttcgccggcgaaggcgtcatcgacctcgacttcgtcaccttggagccgcgcaccacctaccacggtctcaagcacttccgcccggatctggtggaggcgctcgccgacctcaaaccacgattcatgcgattccccggcggctgcatcacccacggcctcggcatggacaacatgtaccactgggaccgcaccatcggaccggtcgagcaccgtccgcacaacttcaacctctggggctaccaccagtcattccgcatcggctactacgaatacctgtgcctgtgcgaaactatcggcgccaagccgctgccggtgctgcccgccggcgtgagctgccaaaacaccagccaaggcccggtgccggtggcgcaggaggatatgcccgcttacatcgatgaagtgctccacctcatcgaattctgcaacggcagcaccgccaccgaatggggtgccaagcgcgccgccatgggccatccggagccgttcggcctcgaatacctcggcatcggcaacgaggatcttatcgacgacgtgttcaagaaccgcttccagcagattttcgacgccgtcaaagccgcatatccggacatcgtcgtcgtcggcaccgtcggtcccgcccccagcggtcaggattacgaggaaggctggaagtacgcgcgcgaagcgggtctgccgatcgtcgacgaacattcctaccagtcgtccagctggtggttccacaacctcgaccactacgaccacacggaccgcaaggggccgaaggtctacctcggcgaatacggctcctggaacacccaactgatcaacggcctgtccgaagcggccttcatgggacgcatggaactcaacggcgatgtggtggccatggcctcctacgccccgctgttcgccaagaatgggcaccatagctggaatccggacctcatctacttcgacaacgaacgcgcctaccatccctacagctattgggtgcagcagatgtacgccaccaccacggccgacaccgcgtggcccgtcaccgtcgaaggcccgtccacgctgcgccgcaccctgccggacaccgtgagactgcgcatcgcgggcaacgccaaagccgaccttaacaatcttgtcatcaccaccgcatccggggagacgattaatctcggcaacgtggcctacgatggcagaaccatcgacaccgccctcgacctgcacgctgattcctacagtatcgacactaccgtcgtctattacgagggacgatggggcatggacctcatctgtggcgatatcgacggcaagaaccacaacatcatctcacttggtcgaggacacagcgtgcgcgtggtccgcgacggcaccgcctacgcgcttgccggcaccgaagtctccatgaacgaagtgcgaccgggcaccacttggcaggtgcacgttgacgtcaccgatcgcggccaagccatgaagctgtacatcgatggaacgctgattgcggatggcacggaggttaaggacgagccaaggcgtaccgtcaccgtatcacgtaatgacaaagccggagagacctacgtgcgcgtggtcaatgccatggacgcgccaataagcgtcgacctacgtcagattcttgccgagttgaatatttccacagcatcggcggcatccgccacggccaccgtcctagccggagacaatccgtatgcgggacaggtcggtgaggaatcaccgaccaggccgcggcagaccgcgattgatctgacagacggcgactacacggcatcggcatggtcgttcaccaccatcacgattaagtgacgtgtatgccgcgaaacgggcggaccctcgtttgaaccctcgaacgagagttcgcccgcagtgcagggccaatcgggactaatctggaaaacatgagcaagcaccaccgcaatcgtaattgggccccggccccacagccgctgcccgaagacgcgcacgtcatcgacaaccacacccacgtcgcatccgtcgtgcccttctcccaagccatgagtcacgaagccatggaaaaaggccaaggcgaagtacccgtctacagcgtcgacgaactgctggaacaagcccagaaagtcggcgtcgaaggcgtaatcgactgcggttgcgagctgcccaacctcatgaccgccatcgacatggcccgcgagcatcccggaaccgtgcacgccgcaatcgccatacaccccaacgaagccgtgctgcacggccaccgcggcgcacccggccccgacggcctgcccatcaaatacaagccctggcacgacatccccttcgacgaagccatggccgaagtgcaccgcctcgccaccacctaccccaaccaggtcgtcgccatcggcgaaaccggcatggacctgtttcgtaccggcgaatccgccaaggaactgcaacgcgaggcgttccgcgcccacgtcgcgctcgccaaggaactcaacctgcccatgcaaatccatgaccgcgactcgcacaaggaagtcattgaaacgttgctcgccgacggagcccccgaacgtactgtgttccacagctactccggcgacgccgaaatgggcgaaatcgcccgcgaaaacggttggtatctcagcctttccggcacatccagctacaaaggcaacgacggaatccgcgaatcggcgaaactcgtcggcatgagccacgtcatggtcgaaaccgatgccccctacttaagtccgatgccctaccgcggccgcaccaacgcgccgtatatgatcccgtacaccctgcaggcgctcgccgactatcttgacagaccgttggctgaaatcgccaaagccacgcgcaatacgacgcgtgtggtgtacggcatctagtgaagcgcttcataatccaagtaaaacaaacaattaagcttacttgaattgctgacaagacatgccagatgtcatgtgaagatttgacaactgtttgtcaggctcctagtgtcacaccttgcgttttattttggggagcgggttggaaggcccgccacttggaggaagcgttatggctaacgagccgaacgaagaagaacagccgctgcttcacgcagcgacgtacacgcaggcgccaaaggtctcgcacaaggtcctgaccaaggaggagcgccagacgctcatcaaggagcacgaggcgcagcagcaggaagccgcgaaacttgacgaggccgccagcaagggccgcatcggccgctggtggagccgtctccagtccggcccggacaaaatcacgccggccatggccatcgtggcgcttggcgtggtatacggcgacatcggtacctcgccgctgtacaccatgcagacgttcctcaacggccaaggcggtttggcgcatacggatcgcgccgcggtgctgggcatcctgtcgctggtcttctggtcgatcacgctgatcaccaccgtcaaatacgtgttcatcgccatgcgcatcgacaacaacggcgaaggcggcatcttcgcactgtattcgctgatccgcaaatatggggcatggcttgcgattcccgccatgctgggcggcgccgcgttcctcgccgattccgtgcttacgccggccgtctcgatcagctcggcagtggaaggcttggaaacactgccgctgctggaaccgatcatgagcgaaaacaaagaactgacgctgatgatcaccattgtgatcatcgtctgcctgttcgcagtgcagtcgcgcggtaccgaacgcatcggccgcacgttcggcacggtggtcatgatctggttctcgttcctcgccgtcgtcggcttggtgaacctgagctccgattggagcgtgcttgaagcgctgaatccggtgtacggcgtggagttcctcttcagccaccacaatgcggcaggcctcgccgtcatgggcaccgtgttcctgtccaccaccggcgccgaagcgctgtattccgacatgggccacgtcggccgcggcaacatctacttcacgtggccgttcatcaagatcgcccttgtgctctgctatttcggccagggcgcgtggatgctcaaccattgggacgacaccgcgtacaaccacatgcacggcctcaatccgttcttcgaaatgatgaccccgtccgtacgctacgtggcggtgctgctgtccgtgtgcgccggcgtgatcgcttcgcaggcgttgatcaccggcgcctacaccatggtttccgaagcgacgcgactcaactggatgccccacctgcaggtgcgctatccggctcgtacccgcggccagctgtacattccggtggtcaacgccgtgctgtgcgtctccaccctgctggttttggcgatgttccgcgattcggagcatatttccgccgcgtacggcttggcattgaccgtcacgatgatcaccacgacgattctgctggccgtctacatttggcacgatggcaagcgcgtcggcgcggtcgtgttcacagtggtgttcctggccatccagttcctgttcttcttcgcttcgatggcgaagttcctgcacggtggctggttcaccatgctgctgacattggcgattctgctgattatgtacacgtggaacgaaggcacgaagctggaacgcgcgcaacgccggcatatgcagcccgccgattgcgtgccggttctgaagcagcttcatgaggacgattcgattccgtatttcacggacaacatcgtctatctgacgtccgatccggaaatgaagcgtgtcgataccgacatcttcttctcgattttcgcggaccatccgaagcgcgcccgcgcatggtgggcggtgtcggtggaaacgtccgacaacccgttcacgcgcgagtattcggtggagaatttcggcacggacttcctgttccgcgtgcgtattcgcttgggcttcaaggtgtcgcagtcgattcctgcatacatccaccagatcatgaacgatctgtcgaagtccggcgatctgcccaagcagaccacccgctacccgaagctggatgccgatccgaacatcggacctatccgctacgtgctgattcacaaggcgttgatgcccgagtcgaaggtgtcccagaagggcgcgatctcactgcagatcaagtacgcgattcgtcatttggccggctctccggtcaaatggttcggactcgctccctacaatccgctgattgagattcagccgctgttcctcgccaccgagcgtccgccgcgtctgaagcgcgtgtgaatccgctctgcgagcacggcttatctacgcaaggagggctgggacatttcgtttgtgaccgtaggcttggccgaacggccttgagtgtgtcacgaacaagatgcccccagcccttttccttttgctgaataccgccaagtccgcaggaggaccgtcatatcctattaccgacacgctccgggccgctcaggccgagtttttacggtctgcaacaggatatgtcggtcctcctgctcgtttgcgggacaacttacgttcgtgacgtgcgttttgcgacgtgcgatgcgtatgaatcggcggctgaatcgcaggctataaccaactccgataacggcacgcgcgcgtcgaaacctgccgtcgctaaagtaatcaaccatgtgcagattacttggattcgcgacggcaggcagcaacaccaacctcaatggcgtgctcggcatgcagaacgtgcgcgatttccgaaatctgagcgagatccacaacgacggctggggcgccgcgctgatcaccgtgccagacgaatcgccataccgtcgcgacggcggtgcgccgactccggaaaccggcaccgcgatctacaaaaacaccatcgccgcccgtcatgatccgattttcgacgagctcgccaacactccggcgcgcggcggcctgtggcacctgcgcctggccagctccaacctgccgctgattcttgagaaccagcagcccttctatgcgaacggcctgagcttcatccacaatggcgacatttctgacgaccagggccgcaacatcattacgaaccgcgcgttcccggtcgatccgagcatcgtgcagtccactggcggccgttccgattccgccattttcttcgccgtcatcctgcaatacatcggctttggcttcgcactcgacgaggcggtggcgcaggccgtgcgcgaactgcgcaaaagctatccgaagtccagctacaactgcatgatccaaagccaggaccagttcatcgccctgtgcgcggccggccgtgaggtcacttccaagcgcatcgtcgaaatctacgaccagtacggtcgtggcgagcaggcgcgcgactaccgcgtgctgcgctaccgtgcgctcggtggaaacgacgatgcccagccgaagggcgtggtcgtggccagctccggcttcgaccagcgtgccgaagacggctggacccgcctcgaaaacgaccagatgatcgtggcttccaaccgcaccggcgaattccgcgtccgttccatctgattttccgcacataacgtccccgcgtatcgtgccgttcgctgcgggcagctgatgaatgctcgttttaaggcggcattccttggaacatcgttgacaagacggggaaaccgttgaatccgtgtccgttccgggatttatctggcgtggtgtatgaatcccttcggctgttgggaaccgttctggaaactgcgtcaggaaccgtatgctgggcgtgatggaacgtgcctaagatgggcgtatgacgaacgaatcgaacgaaacaaccgaatcgaacaagccgacgaccggctatatccccactcttgcgcaagtggatgagctacatcgcaaaattgcgcaatcgcaagccgcatacgaccttatccacggccattgcgtggtcgtggccgacatcgcccgccgcatggcccgccggcagaacgcgctgttcacccgccgctgcaccctgccgacggacgctcccgaaaagaccggcgacttcgggctggaactgacgaaagacaataccggcgaggaatcgctcggcatgttgcacatgcctgcggtgccgtccacggaagggctgaccggaggtaccgttccgccgcggctcatcgacgagcatctggtggtcattggcggtttgctgcacgacatcggcacgtatttcctgctcaagcaggacggttccgacggcgaaccgctcaaattcgacggtccgcactatgttcagcacgggctcaaaggctacgaatacttgctgaacgagggcgttgacgaatcgatcgcccagttcgcacgcaaccacacaggtgtgggcctcacccgcgaaaccgtggaatcgcagggattgccgttgcccccggccgactacgtgccgatgaacctcgagcaggaggtcgtcatggtggcggacaagtacaacagcaagtcgattccgccgaagttcctgaccgccgaagcctacacgcgcaaggccgcccgtttcggcgaaagcaacaagcgcgaatggctgcgccttctggaacgttacggcgtcctcgacgtcaaaccgctcgccgagcagtaccacatgcgcatcgccgagtagcgaacctacttatctcgcttatgaatggcggatttcggtgtctgccggatgctatctcgcttatgaatggcgggtgtctcaggaagactaggtgttagggggcaagttcaatcccctctaagtctcatgcggcaaaaccatccgccatctataagcgagatagcacgcgtcgagcggaaaaatccgccattcataagcgagatacacccgaaaattcctcgaagcctggctgccgcccgagttttgcgcactgaaaaccgctatctgtggcacttctcttttcccgccatacattagggggtataaaacagaccctctaactcacgaggcgtcaaacgatctgccacacatagcggtttgagattccaaagatgaaagagtctgccacacatagcgcatatgacatgtttttagcggtgtgtcaccgcaaaccagcgcgaatcggcacgaaccagaatcagcacgaaaaaagccttgcggactggcatgcaacaccagtccgcaaggctttcgcctcgcagaacgccgctcgctactcaagctccgcgcaatgttccatctgatcggcgacctccggattatcggtcaccacaataatcgcacgcttacgatcttcatcgcgcttggccttcttcagcagccccagcaccacggcggcgtcgtcacggttcaatccagcggtcggctcgtcggcaataatcacctccgcctcgcagctcagcgcacgcgcgattgccacacgacgctggtccaacgcactcatcttgcccaccggcagaccggaagtcacttcctcgaatcccacgcgcttgagcagctcgcgcgcaatcaccggcttgggctgcaggaaattgcggttcgacgcgtccatggcgtacagcacgttgccttccgcgtcaaggtcgccgcgcacggcgaaccgctgcggaatgaaaccgatgcggtgtccaagcacgtcgaccggtgtcgcgtcggcgaggttcgtgcttttgtgcatcacgttgccgctggtcgtccgcatcatgccgaccatggtggccaccagcgcctgatgctgttcgacatcttcggcatccaccagcaccgcgtgggtcgcgccggcatggaacgccagggaaacgtcgtcgagcacgtcacgtccggttttgcggttgtgcaccgtcacatggtcgagcgcgaatgtcgggttcgccttgaagaagaatgcgtccttcttgcgatgatgtttgatttcgcggtcgatttgcgatgacacgctggttgcggagtccgcctgtacggtttcgtgctggtcgagcgactgttcgtcgtcggtcgcgcccaatgcgagcgtttcgttcacgcgattcgcgttgtcgctggcaacgctgtcttccgtggcgatgccttccgtattttccgcgttttctgccgattcggttgcgatggaatcgcctccatcgtcatacaccaccgcgaaatcgaccgattcgatcgacgtggccatatcggtttcgcccgcctcgatgtccgcgttttccgcagcagcgttgttcaatgcttcggtttcgttgtctttcacgtctttctcgctcatgcgttcacctccgtacgttccgtcgactcgactgtttcctccggctcgtctgcgttcttcgcttcggcagattcgttcgaatcgtcagaacggcctgcgaacagctgacccaaatcgaagaatcccacgcgcatgaacgcgatgatgcccagaaccaggcaggcgcccagtccgtaccagatcatgttccacgcggatgcggatgtgatggccacagcctgtccaccggcccatgcggtgccaagcggcttggccagcagcgcgccggcaatcaatccgattgcccagcctggaacggtcatcatgaacgtttccagcatgaattgccatcccaaacgtcccttggtgacgccggaaaccatcgccatgccgatttcgtcacggcgtccaccgatcgcggcccacagcactaatgccagcagcgcgagcccgccgacgatcagggtcgccaacaacgccgtgcgcgcggccttggcggcggcgtccagcggtgcgatgcgcttcttgtacgcatcaagcgacggcgatgagattgtgaactttgacgtgtccagcttggcctttgtcaccagtcgcacgaacttgttgtatgtggccggatcggtcagcgtgaagatgatgttgaggttcgggatggcccagcccttggtgccggccacatccagaccgctttgcgcgaagttgatgtacgacgtgtacaccacgttctcgcggttgtctttcgcgtatttcgcgtcggaaccgtatccggccggcgtctcgccggtgtactcgtagatgccgctcacggtgaatttgtaggtttcggaagccttcgtcggattgccgacggtcaccttgtcgcccactttgagattgttcttcttggccactgcctgagagaccagcacgccgtcgttggccgtcttgtagttcagctgcttgcccttgaccactttgaacgtgccgtagtcgttgattttcgccgcatcgttcgtgtagaaggcttgcaacgtcaggttgccgccggtattgtcctcgctcgtgtcgcttttcgccgcgatcgcctgcagcgacttgctggcgcgcaccggcaccgacgtggcgagcgtgtattcgaacgtcaagttgttcttctgcaccgcttccgcgtacttggtgtacatgtcccacgtcatgtaattggcggtgtaattggagtccgcgccgtcgcgtttcgcagtgactttcgcgcttggccgaattaccgccgaagctttctgcgattggtatgtttcgttattcgccttgtcgtcggctctcagcaccgccagatccacggcggctgagaacgacaccagcagtgcaagcaaagccgtcagcgcggtacgccatttgacgcgaccgagcgcagcccatgcgttcttgagaacgaacatgcggtacttctccagttctctgtagttacgcgtcgacgcatgccgacgccagcgttggccgggacgcacacagtcaagcaacgacagcgagtacgctcacagcgcaatgcgccccgtgcaatcatcctgcccatccaacgtgattgttttcttgcgcaacactgttatacctctgtgtgaagtctgaatacttcctgaaaatcgaaggttggataagcggcgattttgttcctgctcgcgctcgtctccgctctacgtccgcctattcttcccgcgttccgcgtccgtcttgcgcccatcccgcgcatgttccatccgtttttagatgcctttccagcttttgttgccgcacggtccagttttgaattacaaaatgcaggtgcgattgcgatttgtggcttgctttcgcggcttcggctacgatggatggcgatgaagcagcacagcacagacaatacgattcccacagcggccggcgacgcagtcgatgaagccgacagcgcagtcgccgcaagcaagacgacagacgaaacgacggctaaaacgacggacaagatagcaaacaagacgacgaacgatacttctcctttgccttgcgattccgccgttccccgcctatcccgcatcgcactgccggtctgttccgtcatcggcgtcgcgctcgccgccgcaatcgtatgggcctggtttccgcacggtcccgccgcttggacgaacccattgcacgaaatcgacgcgcccgcgcactattacttcatccgcaagatcctcggcgaaggcgtcggcgcggccacccacctgtggccgaacgacgaatactatccgccgttgttccatctgcttgcagccggcatgattaagctcgccagcttgttcggcgtcaatctgtcgatttacgccgcgttcaacacggtctggctggcatcatccggcttggtttggccgattgcgattcagctgtacgcttcctatttcacgcgtcgcctgtcgcattcggcacaatccgtatgctccccccgatttgcgaacgcacgaaagtcctcggcccgcaatgtcgcgtctgtcgtagttccgctattccccgcgatactcgcgctcatcatccccccgctcgccgtcgcttccgcctcgcaccccttccaaatgctggcttccggtccgctgatcgccttcggcctggccgccacgcttctgccgttctggctgtacgccacacttcgcctgctcgacgcgctcgccacccgcgaacacctcgtcaaatggatcatatggttcttcgtcactgccggcgtctgcatgttcgcccatccgcgcatcgtgttcacctggctcctgctcatggcccccttcgtgctgacgcgactgccatggaaagccatcgcaggccttgctggcgtagtggttctcggcgccgccgtgttcctcgtatacatgatgtccagctacgaatcggaccgctacttcaatcccgccagctggttccacaccttcgttccgaaccgcacggtgcccgaagcgctcaaaatctacgtcaccgacaatatcggcggcgtgcaaggctggttcatggccgcaatcgtgctgatcgcgtttgccgtcaccgtcgcagccatcatccgcccgcaatggttcgccgccaatcgcgccgattccgctactgtgcccggcgcttctgcgattgaccgtgcatccgatagcacgtcagcgcaaccgcacgaacaggttgccgattttgcggctatgcctgccgatcgtaggaatcgcaagacttccgtcagctaccgcactccacgttccgacgcctcgcaactccgccgcgacgcgatcgccattctgctggccttcttcctggtcggtctcgtctacgtctgctcgaccgcgctgaccggctggttccccaacatcgtggccgccgcctggtatcgcgccgaaacccgaccgcttaccatgattccgttcggcgtgctgccgctgatcgtcttcgccgccgtcgtattgttgcgtgccggccgtctgccgaacgtcacgaaaatcattgcgattgttctgcttgcggcgctcgccatttcctgccaattcggcaatactgttcgttccgccctgtcggatgccgtctatgcgaatatgacgattgacgatgcgcggccggacgagcagctcactgccacgaaggagaagattctcaagaaggtggtgaaggagactggtaccgattcggtggtggtttccgatccgctgaacggttccatgtatgcgacggcgatgtacggcgcggatatgctgttcccgatttacaacgcgaaggccgagaagaatggtgcgattttcggtcagacggagaatgcgttcgcgtcgggcgacggcaaggtgctgacgaataccgtctgcccgctgagcgcggatggcgatgcatacttcctgagcatgggcggccaggcgccgagcctgcagatgttcacgttcaagcagcagtacgacacgttccacgatcagaagctgatcgaccagtacgccaaagatggcacgatgcgcaaggttcaggattattcgaatatggcttcatatgcgaagggctgggcgttgtaccagttcaactgccagtgatcacgtgtgttgcgtggctgcgtggcgtcgaaatgggcgattgggagaacaagaggctctgatttgtcaagtttcgacacgccgatggaacgttggatttccaacggttcacgcgttgttcatgcggcccgggttgcgcggatcgcgatcgtgctgtaagtttatctcttgctgccgctcagcgagtggtccggatggttccggtccgcgaggtgggtgagtggtggtggtttgagaactcaagagcgtatttgtactacttctttatagtcaatgattgccagttcatcatcggctccttgcgagtggccgggaggccttgaaggacggtgaggtttttgtgcgatgcgcctttccttataaggcgatcgtcaattttcttatttcgcgaaataagaaaattgacgatcgccttataaggaaaggcgcatcgcacaaaaacctcaccgtccttcaaggcctcccggccactcgcaaggagcggacgatgaactggcaatcattgactataaagaagtagtacaaatacgctcttgagttctcaaaccaccaccactcacccacctcgcggaccggaaccatccggaccactcgctgagcggcagcaagggattaacttacacgaacccgtccacttgcgcaaatcggcattccgcaaaccccgtaaaaacccttgcggcgcaacgcattcatcggcgtgtcgaaaaccgcctatcgcacgccacatcatcgcagaaatgcttcagacaagcctcaaaacggcctgaaattcatcagaaaaacctgtctacgggcgtgtcgtgagcctgcaacgatttccaaatacggtcggaaagccgaaaaagacgcatacggaggaaaccgcgcggtggtatgtatggaggtatgagcaaaaaaatcgcagtattgacgggcgcaggcatctccacgtccgcaggcatccctgacttccgcggcccggacggcgtctggaccaaacatcccgagcaaatgaacgtgtacgacatcgacgcgttcctagccaataaggaagaccgcgagtattcctggcgctggcaaaaggaatcgccagtatggaacgcgcagccgggcaccgcacacaaagcgctcgtcaagctggaacaggcagggctgctgacgctgctcgccacgcagaatttcgacgcgctgcacgagaaggcgggcaatagcagcaacgtcatcgtcaatctgcacggaaccatcggcacttcgcattgcatgaaatgccatgcgaaatacaacacggcggacattatggcgaatctcgacaacgagccggatccgcactgtcatcgcaagctgccgtacagcggcaatatgccgtgcgacgggctcatcaaaaccgacgtcgtctactttggcgaggcgctgccggatggtgcgatcgaaaaatcgtaccgtctggcggcgcaggccgacgaattgtgggtgatcggctccacgctggaagtgatgccggcggcgagcattgtgccggtcgcggcacaggcgggcgtgccgatcaccatcatgaacatgggacgcacgcaatacgatcgcttggccacacggcttatccgcgacgatattgcgaccgcgctgccgcagttggttgatgagacgatcgctgaagaacagggcaaataacaccgaatgaacaagcaaggctcctcaacctgattgggtttgaggagccttctttgatgcggaagatatgcgagaatccgcgcttatccaccgtgggaaatcagtagatgcgcttgggctggaaaccggccgcgcgcatcgcgtcaaggatgcggtcgatgtgctcaggaccgttggtctcaacggtgacgcccaaggaaaccgaatcagtgtaatggctggaagccttgaactggtcgtgatcgagtgcgatgacgttggcgcgctgctcggccagaatcgtggccaccttgaccagctggccaggggtatccggaagctcaacctcgaagttcatgatgcggccacgggcaatcatgcccttctgaatcaccgcgctgatggagacagtatcctcattgccaccggaaagaatcggcaccaccacatgcgggcccttcgcctcggcgaacttgcgcgagcgcagattcaggtgctcgagcgcggccagagacacggcaccggcagcctcgaccaccagcttgtgcttctccagcatgagcaggatcatctcgttgatgtcgcgctcggtgacggtgaccagatcgtcgaggaactcgttgagcagcgcgaaggtcaggtcgcccggacgcttcacggcaacgccttcggcggaggtacgcacctggtcggctgcgacgacgcgaccggcggccaacgaattcttccatgccgggctgccttccggaatggcgccgatcacgcgcacttccggcttgaacgtcttgatggcgagcgccacgccggcgcccagaccgccgccgcccaagggcacgaccacgtcggtgacgttcggcacgtcttcgaggatctcaagaccgatggtgccttggccgcacagcacctcataatcatcgaacgggggcacgtagatcatgccttcgttgtcgctcagttcctgcgcgtgcgctgcggattcgtcgaacacctcgccgcacagcaccacgtccgcgccgtacgctttggtggcatccaccttcagcggcggagtgatctgcggcatgcagatggtggccttcgcgccacgttcacgggccgcgtacgccacaccctgcgcatggttgcctgcggaagcggtgacgatgccatgcgcaagctgctcgtcggacaacgatgcgatcttgttatacgcgccacgaatcttgaatgacccagtgacctggagattctccggcttgagcagaatctcatgtccggtcatctcggacagcaccggggacggaataatctccgtgtggcgtgcggtgcccttcagtcgttcggcggccagtttcaattcagcggcatgatcacgccgcaatgctttgagcacctcgttttgttccatggacgttattgtaagcgcacgtctgccgaaaatgccgtgcgattgccgaatcgcaatcgaatcccggccgtgcctcagaatcgcacggaaaaagaaacgtccgacaggtttcgtgatgaacctgccggacgttccgcagagagtttatagggaaagatcgatcagagctgaatcacgactccctcccagcgagcgagctcgccacgagcgatcgatttaacactatgcatagcatcataggtgctgagcagtacttgcggatcggacacgccgtcggaaagcagctccgccacgtccgaaggcagcgccgcggacctgtcggtgaggttgaccacgacaagaatcgtgtcgtcgccattggtgcgcgtgaaagcatacacctgatcgctgtcggcggcgagcagatgccattcgccagtggagatggtggcgctgttgtgccgcatggcgatgagcttcttgtagaacgtgtacacggaatccggatcgtcgaattcctcggccgcgttgatttccacatgattcgggttgacgctgatccatggttcgacgggcgcgtctggcgcggtgaagccggcgtatttggaggcgtcccactgcatgggggtgcgcgcgttgtcgcggccgatgagggcgagggcggccatcatggattcggacgactggcacttggcttcctccacgcgctggcgatagccattgagggcctccaaatcgcggtactgttccagcttggtgaagtgggcgttggtcatacccagctcctcgccttcgtaaatgtacggagtgccacgatgcatgtgcagcaccatgccgaacgccttggcgctcagctcgcgcgaatcgcggtcggagtcgttgccccaacgggagaccacgcgcggctggtcatgattgcagaagaacaggctggcccaaccggccttcctcacggcctcctgctgctcggtcatacggtcgcgcaggtttttgacctcgaacggcacggtattccacttggagccttcctggtcgatgccgacatggtcgaacaggaatagcatgtcaagttccttgttggccggatcggtgacgtgctcgttacgggccggggtgatgcccggagcctcgcccacgttgatgtagccttcacggccttcgaatacctcacggcgcatttcggcgaggaactcgtcgatgcgcggaccgtcggagcagaacgggaacgggctggaatagccttcctcgccgaccggcagatcggcgatttcggaaccgtcctcgcccggcagcctgccgttcttgtcgacggtcttggagatctgggtgatcacgtccatgcggaagccgtcgatgccgcgatccatccaccaattcatcatcttgtagacggccttgcgcacctcgggattctcccagttgaggtcgggctgcttcttggagtactggtggaagaagtattcgccgcgcttcgggtcgtactcccatgcggagccgccgaagtaggagccccactggttcggctcggcgcccggagtgcccggctcatggcccggcttggcgggacgccaccaataccaatccgcatgaggatcgttcttgtcgcgggaagcctggaaccaggcgtgctcgtcggacgtgtggttcacgaccaggtccatgatgaccttcaggccgcgcttgtgcgcttcggcaagcagctcgtccatatcggccatcgtgccgaacagcggatcgatgtcctggtagtcggagatgtcgtagccgttgtcgtcctgcggggacttgaagaccggggacagccacagcacgtccacgccaaggtcggcaagatagtcgaggcggctggtgatgcccttcagatcgccgatgccgtcgccattggaatcctggaaggaacggggatagatctggtagaccaccgcgttggcccaccatggattcggggtggcgccattcgaacggacggtgtcaggaagagtggaacgattgaaattcgtcatcgcgattgagctcctttgcctaagtggaatggatgaactttgctatatcccatggtacgtaaagcgttttttctttcttgcctgcggcgcgttttgcaaagcaggaaatgaaagatatattgcaagcgggatgcgcccttcggaatcacatcaatgcatacgaaaagcaggaatcctcgaaaaaggggaaacgaggattcccgctcggcgctgtgaagttttacttcacaagcagacggcctacggccgcgttgttcctgccttcgctcgcctatcggctcgctcaggaggaacctatgaacagtccacaggactgttcacttaacggctcctctcatcacaccaccgacgacccacttttgggcgaagatgtagacgatgaggaccggggccatggccatcaggtaggaggcgaaggccatcgggtagttcgacgtgaactggctctggaacacgtactgcgccagcggaatcgtctgattgctctggtcggtcagcgtgatcagcggcagcaggaagtcgttccacgcccacagtgcggtcaggatggcgattgtggcgttgatcggtcccatcagcgggaagatgatcgtccagaagatgcgccaggtcgaagcgccgtcgatgcgcgccgcctcttccaacgaaatcggaatcgaacggatgaagccgatcgcgatgaacaggttcgtgccgatgccgagaatcgtgtacagaataatcagaccgagctggttgtccaggtgcagggtgcccatttccttggcgatcggcagcatgacgacggtgaacggcacgaacatcatggccaggaagaagtagtacaggaagcggaagaaccgcttatccatgttccttgccacggcgtacgcgacgaacgtgttcgtcagcagcgtcagcaccacagcgcacacggtgatgatcgcggaattgagcgcggccttcggatagttcaccttgttccacgcgtccgcgaaattatgccattcccacgtggtcggcaggctgaacgtgcccgcttcgcccggcgtcttcagcgcggtgacgacggcgaagtacagcggcacgagcaccgtcaggctcagcacggcgacgaccgccgtcagccaccagttgatgctgtggtccttgcggatcttctccggcttcgcttgcgattgtccgctttgcgcggcggccggcttggttgcaacagttgcgctagtcatgatttcttccccttactctcagaccttttccttgccgctgaagaacttcagctgcacgaatgcgaggattgccagcacgatgaagaacgtgaccgcgttcgccatctggtaggagtattcgccgttgcccaggccgttctggaagatcaggtaggagacggtttcggtcttggaatccggaccgcccttggtcaatgccatgacctggtcgaacgcgccgagcgagttcttgaggctcagcaccatgttgatggtgaagaacgggccaatcagcgggaacgtgatctgccagaagttctgccaggcgttcacgccgtcgatggacgcggcctcatagatttcgttgtcgatggtctgcagacccgccaagtacagcagcgtggagtaggccacaccctgccagatggacaggaacacgatcgggaaccatgccagatccggattggagatcatggatgtggacagccaatcgatgtgcagcgcctggccgagggccggcagcggggtcatgaagatgtacttgaacacgtagccgatgaccagcaccgacagggtgtacggaatgaagaagatggctcggaagccgttcttgaaggcgattttggagttcagcagcaccgccaggaacatgccgaggatgttcgtgccgagcgtgatcagaatcgcgatgaaaatcgtgaacagatacgcgtggccgacgcgtgcgtcctggaacatcgcgatgtagttcttgaagccgatgaacttgtaatcgccgtaaccctgcgaattggtgaacgagtacatcgcgccctgcaggaacggcaggtacaggaagatgcacacgagaatcatcgcgggaatggtcatccagtagaacgccggatcgaccttgcgcttggagtatttcgaaaccttcttcggcttctttgcggcggccttgtcggccttggccgagatattgccagtcattgtcgttcctcccctcacctaaagttcctggcttcgatcttgtcgtattccgactgcatgctgttcaggaatcgtttagtattgcccgactgcaccaacgtctgcaggaaaccggcgaggttgatgcttgccggcacgtagtggtcacagaaatcagccagcttgccggccttgtagaagtcgagcacgccattcaacgcttcatcgccgacgtacgtatccttgtacggggtgaacgcagactgctgcttggagtaatcctgcacgttctcctcgctcatcaggaagtcgacgaattcgcgagcctcggtgtaatgcttcgtatgcgcgccgatcgtcagcatcacgtcgtcgccggcggtcagctgctgttccttgacgttgtcggtggccggcatctgcgcgaaccgcagattggcgtccttgttgatcagacggatctgcggaatcgcgtacgtgccgagcggcagaatcgcggccttgccggaagcgatgtcctgcgtagcctgctggtaggtgacggccggattcttctgcgtgtagttctggtaaatttcaatcagcttgccgctgacgggcgtccacaagtcggagaaggtcttgctgccgtccttgagatacgcgtattccgattccggcaccagcgtcgaattcagcgatgcaagcggcgcctgcaacgtccacggatcggcggtgctcgcctcaaccggcgtgacgcccttggccttgagccgcttgagcagcgcgatgaattcgctccacgtctgcggcggattgtccggatcctcgccggcctgcttccacacatcggcgttgatgatgtagccgcttgcgttgcccgcgtacggaataccgtacagacgcttcttggacttgtcggtggtctgcacgaggctcttcgcgatgttcaccatgcccggattgagctcgtcgacgatctcgtcgtcggtgaaatcgtggaagacgcccgcttcggcgagcatgccgtaattgatgtcgccgttgatggtgatgacgtcgggttcgcggttcttcaccagtcgcgtgcgcagatcggtggtggcgtccgacgaattgttgacattgactttgatgttggaatgggttttctcgaattcacgcgccttggcggtgaaccaatccgccgcctcggacttgaattggaagaaatccaaggtgaccgtgccggcggtgctgttgccgcagcccgcgagcccaaccgtcagcacaatcgcgcatgcagccgtaatagcacggcccgcgatccgcctgaaggtgcctgtgttggcattggaatcaggtttcattctctcgactcctttgtattttcctttttcacggcaggccggcttcattaccagcctccgttgctttttaattgtagaatcggcttgttttcattcccagtttccgcgcgcccgcatcgaacggaaataaaaaacggttattttgttatgcttggaaagaaaatagacggtaaggacggtccgatatggcgatttccccgattccacactggtttgaaggctcggagtacacgcataaggttgcggcctgcattatgaagtacggtccgatttcgcgcatcacgctggcacagatccttggcctttcgcaaggcgcggtatcgcgcatcaccagtgatttgatttacgctggcgtgatcgaagagacgccaatggcagcggggcatggcggcaagttaccgaaagatttcttgcggaaatcggcacaaaagtcaatccagaaagaaaatacggaacgtcgcggccgtccgcagaccggactgcgcatcatcgccaatgcgcgcacgttcgtcggcatgaaaatcaacaccacccatatcactgccgtaacagtaaacgcgcttgggcagattgtgaccggctgccatgacctgccgattgaggacgattcggtggaaacggtggtcgacgttattcggcagctgaccatggactgcgccgacgaggcgataatggcgggattgccttcgccatgcgcggtcggcgtctcgttgggcggacacatcgtggatgattcgatggtgacgttcgcgccgttcctgcattggtcgaagcccgtggagttttcggcgttgatccaggaggcgaccggcctgccgaccggcatctacaacgacatcgactcattggtggtggacgcgtgcatgttcggctcgggcgtcggattgaacagtttcgccgtggtgacgatcggcatcggcgtaggatattcgctcaccgtcaacggcgagccgatcgacaatcccgacaaaagctatggcctggtcgggcatattctggtcgaccccgacgggccgcgctgcatttccggacataaaggttgcgcgacgtgcctaactgacaattcaatcgcaacagaatattcggaaataatcggacatccggcgacgttcgacgaattcgcagccgcagcgcgcgccagcaaaacgcaggccacgaatctggtgaaccgcacctgtttccgtttgggtacattgatcgcgaccatcgccaatcttgccatgcccgacaaaatcatgatcgctggcgaatcgtcgttcattgcgaaactcggcatagacaacctgcgtaacggcatcaatatgtatcggcatagtcaagccgcgccggtcgatttcgaaatcgccgagcacgactggtcgctgtggagcaaagcggccgcagcgcaagccattcgccagtatgtagggtaagtcgttcggaatcgctgtcgcagtgtgaggccggtacgcgaaagtaccagcctcaccatacaaaacagatactcagatgcggactactttgaaaaggacggcctgtgcgggatgcaatgccggcggacggatgccataggcggcgagcgcacggccggtcatcttcacaccatcggcggtccaccagccgagcgggctttggccgttgccgatgtcctgcttgactaggtcaaggcttacgtcaagcggggacaccacgtacacggcgtccgggtcgaggccaggcagacgtacgggggcggacggataggtctgcgatgtggtcagctgtgtgaagcggtagatcgcggcggccttgttcggcatgacgcaaccgtccacgcgcacggccggatcagccgcgtcggaatgcacgacggtgtcgacagcgaaccattcacgatgcttcttgaattcggcagtccattcggagagcttgtcgatatcctcctgcggttccttgagcagattccattcgatgcccatgtgtccgaagaaggccgtggccatgcgcatttcctgcgaagtggcgcgatgcgtggaatgcgccggggaagcgcccacgtgctcgccgatcatttccggcggcacaagcagcgacgtgtagcgctggatgtcggcacgttccaccgggtcgacgcagtcagacgcccaaacgcgatcggctacttcaagaatgcccaaatcgatacggccgccgccggaggagcagctttcgatttccaggccggggtgcgctgccttcagatcggtgaagatgcggtatacggcgagcgtctgcgcgtgcgctgccggacggccggtcagcggcgagacttcttcggtgacgagcttgttgtggtcccacttgatgtagtcgatgcccagctcgctgacgagcttgtccatcgcaccgtaaatgtagtcgtacgcgtccgggttggtcaggtcgacgacctgctgggtgcggccctgcatcggcagacgaccggcggtgggcttcagcacccagtccggatggttgcggaacatgtcggaatcggggttgaccatttccggctcgaaccacaggccgaattcgaggcccttgccgtgcacgtagtcggcgagcgccttcagggacttgtctccgtcgggccagacgtcctgcgaaatctgccagtcgccgaggccggcggtgtcgtcacggcgggcgccgaaccagccatcgtccacgacgaatcgttcgacgccgctttccacggctttgtcggcgagggcggtcagggtgtcgtaatcgtggttgaagtagacggcttcccacgtgttgaggatgaccggacgcggcttgggcgcgatgccatggtccacgagccagtcgcggtgcacacggcggatgtagccatggaagcgggaggcgacctcgttgagcccttcgccgtaggaaccgacgagccatggcgtcgtatagctttcaccgtgttccagaccgacttcgccgccgaagagcacttcgccgccaccgatcacgcctgtggtgtagggcagtcgttccgcggacagcacgctgttgccactccatgccacgtgcgcggagtagacgttgccgtgggtgaaaccgaagccgtgttcgccaacgctgagcagcagggtggcgtcgaagtcggggcggccgatcatggaggatttggcgaagcgcccgatggtgaagtcctggcgctgtggggaacgctcacgcagatggtgaccggtggtggtgaggatctcgttggcgtcggcgggcacgctgaatgcaagttcgatcttgccgatctcgagtcgtccctcgccggtgttcgtcacctccgcatgctggcggatgaggccggtttcatcgagctcacaggtccacgtaagtttcacgcattgttccacgtcctcggcagtgacggtgacggtaggcgtctgcttgggctcggaggccacgctccagctggggtagccgtctttttcggccatggtgtaggttttgccggcggccacggtttcggctttgatgtcggtgacctggaacttgcagaacagttccacgccgtcacggcgcacgtcgaaacggtcagagccggaccacgcttcggactgtgtcggcagcacgctcggccatgcggtgtagtcgagggctccggaaacacgctgcggagcgagcgcgtcgaacgtgttgatcacggtttccggtgcggtgagcgggcgaccccaatgcacgaatctcggcaaatcgctgccggggaacaccagagcaaaagctgcggcggcagccggctgctcggcatacacggcggtaaggggtgtgccgttggaagcggtgccgtggaaagtctgaatgagcgtcattgcagcatccttttcttgcgattcttggttggtatgacgctttgatgatactgcataccgcttttcttcccatcgccctgcgtgtttgtttctttcggaaagtaattagcgtcggcgcgcgaagaaatcggtcatcaatcgcccgcattctgcttcgcgcacaccgccaatcacttccggtacaagtccgacgtgcggatcgcggggaatatcccataccgaaccgcatgcacccaacttggcatcccacgcaccgaacacaatacgtccgatatgcgtctgcaggcaggcaccggcgcacatagggcacggctccaacgtaacgacaagcgtgcaatcagcgagattccaagtgccaagcgaggcggccgcttcagccatcgccttgacttcagcgtgggcaagcggatcggcatgcgtctcacgcaggttccgcccgcggccaatcacccggccgtcagcggcaagcacgacagcaccgaccggcacctcgccatccgcggcggcttcgcgggccagcgcgaccgccggttccatatcatcgtcccatcgcatacgccacagtgtagcggcggccatacgaccgctccgcacgactggtccgcacgtccgacctgcatgcccgacctgcgcgcccaaccgaagcggcacgaacgtcagcccatagcgaaacacgctcataaccgcctcttggtaggctggaaaaggttggaaatacgcgcaaaggaggcacgttggcggtattcgagttgattctatgcatcatcgctgccgtcgtactgtcctcgttcctgagccgattcatacccaaggtctccacgccgctcgtgcagatcgcgttgggcgcgctggcatcacaactgccgttctttccggacgtaacgctcagccctgaactgttcatggtgctgttcatcgcgccgctgctgtatttggaagcgcatgagattgacaaaaccgagctactgaaatccgtcaaactgtcattgtcgctggcgatcggcctggcgatcgcgaccatggtggcggtcggtttcgcattgcacaccgtctggccggcgattccgctcgctgcggcacttgcgctcggtgccgcgctcgggccgaccgatgcggtcgcagtgtcgtcgctcggcaaggaggcggcgctgaccgaacgccaaacgagcgtactgaagggtgaatcgttgttcaacgacgcttccggtatcgtcggcttccagttcgccatcgcggcggcggtcagcggcgtgttcgaagtgggcgaatcggccgcgcaattcgtgatctcgttctccggcggcgcgatcttcggccttgtggtgggcaccatggccgacctgctgttcgaatcactgcgctccctcggctgggaaacgactaccagccgcattctcatggagctattcctgccgttcatcctgtatctgggtgcagaggcggtccacgtctccggcattctgtcggtcgtggccgcgggcctgatcatccgattcgaccgcaccggcatcggaccgaatgtggcacgcacgaacatcgtatcgtcaagcgtgtggggcgtgctgtcgttctcgctcaacggcacagtgttcatcctgctcggcatgctgctgccgaacgcgatgtcggccagctgggatgatccgcacatcagcaacggcctgctgatgtgcgcgatcctcaccgtctccgccgtggtgatcgccatgcggttcctgtggatctcgctgatgctccggctcgcgcgcgacaccaccaccggcaagcggcgcaaaatgacggcgcagcgctggcgttccgccgcggtcatgacattcggcggaccgaagggcaccatcacgctgtcgttgatgttcacgatcccctacacgctggcggccggcgcgaacttcccgatgcgcgacgaactgatctttatagccgccggcgtgatcgtggtgacgctgctgctggcgaatttcctgctgccgctgctcgcgccgaatcgcgacaaggacacgtcgacggaaatgacggagatcaccatcgaagtgctgcggcggacggtcgaagagctgtcgggccgtgtcacgccggacaaccgtcgggcggtgcttatggtcatcgattcctatacgaaacgcatcacgcggttgaaacagcgcaccggcgaaatcgatccgcaggggtatatgcagctgcagatcgacgcgctcaactgggagaaggagtacgtcaagaaccgtctggcgggcgtgcgcgcggcaatcaaggcgaatcccgccgagaaccgcgccgcgaacgatctggaggccgaggcctgcgagcgcctgctcgaccagatcatgagctcgctgcgccacatcgaaaccgcacacaattcaggccgtatgatctggcgcgtcaaaggccggtacaaggcgctgcagcggcgcatgggcacgttggcgaaacgcgtgaacagccgtatccggcgcacgaccccgctgttcagcgacgatgagctgttcgcgcatacgcgtgtggtgcaggtggatgcgatcgaacatgtgatcgaccgactgtatgaggagatgggcggcgacacgtacaacaccgagcactgctccggcctgctgttagactaccgacgcagcgaatccgcgttgagggcgcgtccgaatatgggcatcagcgccgaagcgcaggaacaggccgaggaggtcaagcgcgaaagctacggcatcgagctgggcgtgatccaggacatgtatgaggccggcgacatcacgcgtgcgcaaagcaagcagctgcgacgcaacgtgtatgtgatgagcgtggatgcggacgcgcagatctgacccgggttgcgcgctcaggatacacgtttccctcgcacgttcatcgtgcttagcggccacggcatatacctgtattaccagcgcgaacagccaatcccatgtatccctcctaccgaggaaaaatacctcaaggaacggaagagcagggatcacgcgtccgcatccgaaaatcatcggaacagaacccaagagcgcttttaaaacttttgcatatgataacgcatgaatatttgagacaaagtaggtatcttggaataaagatgaggtttttcacttcatccggtcggaaataagccgaagtgaaaacaatgtggataactctgcaaagatgagaattatctgtttcatttagacacgaatgctcctttcgaaaagatgattgacaaatacccctaatagcctattgtttagtcatgcttcatcggcattgtaaagaaaggggattgaatgaaaatagtcaagagaatatctgcccttttcattggtctagcacttatggtggctctgcctgtcaccgctcatgcgtctacaaacgatgatcagcaagacatcgcatcattggatatgtccgtcatcgacgtgcacatacaatcacgcggcgctatgaccgcggaagatctgtacgacttcctccaatccgatgcagagaaaactgttgacatcgatgctgaaacagggaaaattaccgccgtgagcgaaggtataacgaagcctaggattgcggtcaacaatatttgcaatggccatgactcatgccttatccacaatcgtgttccttatgcggacttcggatttagcgggaccggaacgaagaccgggaattggccctaccgcatctcttgggagactggttctcatacggcaaaagcttggtacagacatggctatgacgttgttggatggggcactaagttcggacctcacaccaaggccaatatgaacgctcctgtcacggctgttcaagtcaccaattactcgtgatcctgcatgagtttctgacgcagaagataaagacggctcatcagaattctgatccgcctggacatatgccgccgaattctcaggaagttttcagaaaacaccagacatgtgctcagcatcaggtgtttatatatgaattgtcagcagaaacaagccgaccaggaaccttgaagttcccgacaattgaaccctttcttcttctctctcctttctctccccggtggccgatcccaccggggtcttcttttttcacgaccaccttctcacgctatcgacgcacgctatattgggaaggtatgagcgacgcaatcgaacatgaaattccgcaaaccgcagacaacagcaacaaaacggagctgatcggacgcgaatcggatgtggtgccgggccgtttcggcgaaccgctgcaggtgacgcacgtccagtattcgcgcggcggcggcaacgcggcaccgaaacggccgctgttcctatgcctgcatggctggggatcgaatgaggctgaccttgccgatatgatgcgatacatcgcaccatacaacgattacgcttcactgcgcgcgccgctgacgctgcaggaggccggcacgttcactccaggcgcgtactcctggttccatgattgcgtgccgtccggcgaagacctcgaccgcgacgcgttcgccgcatccatggctatcgacgattgggtgtcgcagaacgttcccgaagaccgtgccgtcgtgccgatcggcttttcccaaggtggcttgctggcgatccatctgctgcgcatgcatccggaacgctaccgtgcgtcgatttcattgtccggattccttgcgcctgggctcgtccgcggcaccgcgcctgccgacgaccgtatcgcgccgctcaatattcccacgttcttcggttacggcaacagcgatacggtgatcgccaagccggagcttttcgccatgagcgcctggctggacgagcacacgttcctcaccgcgaaaagctaccgtgggctcgaccattccgtaagtatggaggagttcagcgatttgcgcgattggcttgccgcgcacaacatcgcgccgggaatcctgtagatccgggtcagttagaacagtcggattagtcggtgatgtcggccttatagaagttcacgtaggaacggctcggggtcggaccgcgctggccctgatagtgcgacccggtggtggcggaaccgtacggatgctcggccggcgagctcagctggaagaagcacatctggccgattttcatgcccggccacagcttcaccggcagcgtcgacacattggacagctccagcgtgatgtgcccttcgaaacccgggtcgatgaatcccgcggtggagtgagtgaggatgccgagtcgtccaagcgaactcttgccttcgagtcgtgccgcaaccgtcgaatcaagcttcacatactcccacgtggagccgagcgcgaactcgcccggatgcaagatccacggctcatcagaccggacttcgaactgctcggtcagctcgccctggttctccgccggatccacatacgtatacgcatggttgttgaacaggcggaagaaacggtccaatcgcacgtcgatcgacgccggctgcaccatttccggggtccacggatcgagtgagatgtgaccgtcggcctgtgcggcgagaatgtcgcgatcggacagcagcatcgaaattcctccaaacatcaccggaacaatcgtcatatgagcgggcgcgcagccaacgcgcgcccaccaactgtcgtccagtctagcccgtcgacgctataagccagcatcaccgccgatgcatcgcacgcagcacgcacttgcgcagctcggaggcgacgagcacaatcatcgccaggccgaggcattcgacccacgcacccgcggacagcggcacggtaccgaacgcggtgttgaggaacggcacgtagaccaccgcaagctgcagcagcgtggacagtgcgatcgcaccccacagccacttgttggcgaacagtccgacgaacacggactggtcgtgcgaacgcgagcacagcgcgttgagcatctgcgcgaagaccaggatggtgaagcccatcgtgcgcgcctcagtcatttgcgcatcatgtccgacagcatccacggaacggtccgtgaacagacctccggcgaggtgcatgtccatgccaatcagcgtgacggcagccataatcaaaccgatgaaaatgatgtcgccccacatctgtccgtcgatcacgcgatcggtgagtttgcgcggtttgcgtgccatcacgtcgtcggtggacgggtcgacacccatggcgagcgccggagctgcgtcggtaagcaggttgatccacagcagctgcgtggcgagcagcggcacggtgacaccttggctgccaggctgggtgatgccgaggaatccggcgagcatcacaccgccgaagacggtgaacacctcgccgacgttggagctcagcagatagcgcaggaacttacggatgttgtcgaaaatgccacggccttcgcgtaccgcctcgacgatggtgctgaagttgtcgtcggcgaggatcatcttggcactctgcttggtaacttcggtaccggtgatgcccatcgcgacgccgatgtccgcggttttgacggcgggagcatcgtttacgccgtcgccggtcatagccacgatattgccttgccgttgcagcgattcgacgattttcagcttgtgttccggcgcaacgcgcgcgtacacggagatttcgcgggtggccttgtcgaacgcttgctcgtccggcagctcgtcgagttgaacgccggtgagcactttgctactaaggtcggcgctgccgaccgagctgccgtctccgtccgtttcaataatgcccagatcgctggcgatgcgtgccgcggtaagcggatggtcaccggtaatcatgacggtgcggatgctggcacgatgcgcttcggcgacggaatcgcgcacttcggtacgcggcggatcgatgatgccgaccataccgacccagatcaagtcgctttccagcacatcgctttggtcggcgatgtcggcgacgtgaccggcggcgttgatgcgcacgcccggcactgcggcgagcgacgcggtgccgagtggccggtacgcctggcccagcgtacgatacgcttcggcggacaggcgttccacggcggcgaggatctgctggcgatcgccttgcgtcatcggtcgtacggcaccgttgaccgcgatgcggctgcagtagccgagcagcacgtcgggggcgcctttagcaaagacggtgagacgcccggcatcagtgttatcctgcgcgacgacggtcatgcgtttgcgatcggaagtgaagggaatctcgcccacgcgcgtgtagttggcgtatttgcgatcggccttcaccttgcgtgcggcgacgataagcgacacttcggtcgggtcgccgacggcttcccacgttatgtcggaagcagcggaaccatcgccggcatctgtgttttcgcgcagttcgccgtcgttggccagcgtgcccactgcgagcgtggcgacggcttcgacctgtgcggcggaagcggcggaaccagacagagcagcgtcgggaatcgcaatcattctgccttctggcgcatagccggtgccggtcagctgcacctcgccgctcggcgtgaccacgcgttccaccgtcatctcgttgcgggtgagcgtgccggttttgtcggagcagatcacggacgcggaaccgagcgtttccacggaatgcagtttcttgacgatcgcatgatgttcggccatgcggcgcacgccgagcgcgagcacgactgtcagaatcgcggcgagcccttccggcacggccgcgacggccagcgaaacggatagcagcagcgaatcgattacgtcgtggatgtcgttgaagccttcggtcagtgcaagcgccaccagcacgaccgccgcgataatgcacaccgcgatgccgagaatcttggaaacgtagttcatttccttctgcagcggactgtcatcatcatccgtggcctgcagaaggtccgcgattttaccgacctgcgtgcgcatgccagtgctcgtcacgattgcgcggccggtgccttgcgtcacggacgtgccgttgaacaccatattggcgcgatcacccaaggccttggcttcggcaagtgtgtcgacgtttttgccgaccggtacgctttcgccggtcaggctcgcttccgccacgcgcaggctggcggcggcgagcagacgtccgtcggcgggaatggagtcgccttcaccgagcacgaccatgtctcccggcaccacgtcgacggtgttgatgcgtgcgattttgccgtcgcgcagcacgttggtttgcggcgcggtcatttgggagagcgcttcgacggcttcttccgctttcgattcctgaatgtagccgagtaccgcgttgacgataaggataagcacaatgacgatggcgtcgaacggcagtatttcgccgccttccgcgcctggcgcagcgttggctttttcgatgaaccatgcgatgagcgagatgccggtggcagcgagcagcaggtagacgagggggtctttgaactgcgccaggaacttcttccattttggcacgggtggtgcggatgcgagctcgttcggcccgtattgcgcgagtcggcgttcagcttcggcttggctcagaccggtgttcggatcgacgccgagcgatgcggccacggcttgcgcgtcggcaagcgacgggtcgatttgtggcggctgctggttttgctgatcctgccgaatctgcgtgcgatcgcccgtagcggaatcgccgtcaaaattggcatgggactggatggactgatctttcttgcgatcatccatagtgatctccttgggagcgccgcggagtagtcagctctcccccgtcttacgtatgcctcgaatcgcggaaatcgaaaatccgcggaatcgcaagcattttgcaaaggcgaggcaacgctgcgcggttgtgggcaccgggcggacgccatcggcgcatcctgttattatcgcacatcttcggcgtgtgaaaaatggacatgtggcggaacgatgcatgacacgcgacgggtgcacgataccatgaagtgtgatatattatcggtagttagtaaaattcattactaaacggtcgtgcaacatcgcacggcgcaaccgcaacgatgcagtgacaccaagtaatacagggggatgcaagatggcagatacagccgaactcgcaatcgtacatgcaaccacggcaagtgcaagctggctcaccgatccgacggtgttcgcagcgaaccgcaagccggcacattccagccaccgatatgtcatcggcgagacgagcgagccgaagcagagcctcgacggcgaatggaaggttcgtatcgaacaagcgcgcaacgtggacgtggaaagcgctccgttcgcggccgtcgatttcgaggatggcgatttcggcgcgatcgaggtgccgggccacttgcagatggccggctatctcaagaacaagtacgtcaacatccaatatccgtgggacggtcacgaggatccgcaggcgccaaatattccggaaaacaaccatgtggcaatctaccgccgtcgattcgcgctcgacgcgcagcttgcgcgcacgctggaaaacgacggcacggtcagcctcaccttccacggtgccgccaccgcgatctacgtatggcttgacggcacgttcgtgggttacggcgaggacggattcacgccgagcgaattcgatgtgacggaagcgctgcgaaacggcaatggcaacgccgccgattcccccgaagccgagcatacgctcaccgtcgcctgctacgaatattcgagcgcctcttggctggaagaccaggatttctggcgactgcacggcctgttccgcaccgtcgagctcgccgcccagccgcatacgcacgtcgaaaccgtgcagcttgaagccgactacaccgcagccgacaccgccggtacggccgacaccgccgaactcaacgcggcactcaccttgcgcaaccccgccgacgcgatgactatcgaaagcacgctgcgcgacggcgacggaaatgtcgtatgggaatcaacgcaggcctgcaacggcgaaatcgcccttaattccggcaaaatgacgaacatcgcgccgtggagcgcggaatcgccgacgctgtacacgctgaccgtacgcgtcgtcggacatgacggcgccatcatcgaaaccgtaacgcagaagatcggcttccgcacgttccgcatcgaaaacggcatcatgacgctcaatggcaagcgcatcgtgttcaagggcgcggaccgccacgaattcgacgcgaagcgcggccgcgcgatcacccgcgaggacatgctttccgacgtggtcttctgcaagcggcacaacatcaacgccatccgcacctcccactaccccaaccaggagtattggtacgatttgtgcgacgagtacggtctgtatctgatcgacgagacgaatatggagacgcacggcacgtgggtggcaaacaatgtcgagcgtcctgaagacggcatccccggcagccgccccgaatgggagggcgcgtgcgtggaccgcatcaacagcatgatgcgccgcgattacaaccatccgagcgtgctgatctggtcgcttggcaacgagtcgagcgcgggcgaggtttttcgtgcgatgtatcgccacgcgcacacgattgatccgaatcgtccggtacattacgagggttccgtgcacatgcgcgaattcgaggatgtgacggacatcgaaagccgtatgtacgcgcatgctgacgaaatcgaacgctatctgaacgacggcagcccggcacatacggacggtccaaagaagccgtacatttcctgcgaatacatgcacgcaatgggcaattcgtgcggcaatatggacgaatacacggcgttggaacgctacccgatgtaccagggcggtttcatttgggatttcatcgaccaggcaatcgaagccaaactgcccgacggcacgacacgcatgtgctacggcggcgatttcggcgatcgtccaagcgattacgaattctccggcgacggcctgctgttcgccgaccgcaccccctcgccgaaagcgcaggaagtcaagcagctgtatgcgaacgtgaaaatcgcggtcacgcaggacggcgtgcgcgtcacgaacgataacctgttcgtgtcgacgggcgcatacgccttcgtcttgcgcgtgctggccgatggcaggccggtgtggagcgccacgcgtcgcttcgatgtgccggccggcgaaagcgctctgttcgatgtcgattggccgatcgacgactacctcggcaacgccaaggagctggttctggaggtctcgcagcagttgggcgaggcgtgcgattgggctccggccggctatgagctggcgttcggccagtgcgtggtggagggcgcgaagggcaccgatgcgactgttggcacggccagcgcggctagcgcggccgacggcgccatcaccttcggccgctggaacgtgggcgtgcgcggacagggccgcgaggtgcttttctcccgagcgcagggaggcatagtctcatacacgctcggcgaacgcgaattcgtgctgcgtcgtccttccatcaccacgttccgtccgctgacggacaacgaccgcggagccgggcacgccttcgaacgcgccgcctgggcggtcgcgggaaagtacgcccgctgcgtcggctgcgaaatcgcgccccgcggagagaacaccgtggaagccacgtatacatatgaattggcgattccgcagcacacaaaagtaacggtccgctacgttgccgatacggacggccgcgttgagctcgacgtcgagtatccgggcgagaagaacggcggcctgcctacgattccggcgttcggcatcgaatgggcgctgcccgtggaatattcgaatctgcgattctatggtgtcggcccggaggaaacgtacgccgatcgcaagcacgcgaagctgggcgtgtggagcaccgatgcgtaccgcgaccgtgcgccgtatctgctgccgcaggagaccggcaaccatgaggacgtgcgctgggcggaaatcacggacgattcaggccacggcctgcgcgtgaaacatgctgtgaaacctttcgcgatgagtctgctgccttattcgagcgcgatgctggaggaggcgctacatcaggatgagctgccgaagccgaggcacatgttcctgcgtctgctggccgcgcagatgggcgtcggcggcgacgattcgtggatgtcgccggtgcacgcgcagtaccagctgcccgccgaccagccgctcagcctcaacgttcagctcaagctgttctaagctaagccagcttcagcctcaagcataaccgccgattcgcggcataattccggccgacttgccaataggcaggccggccgattctgttgatggctgaaaacaggcagggtgcctaaaatgaaagcacgtctttgaagcaaacgacgcctcaaagcatgtttttctgaaggagggcatcatgagctatccaaatatgaatcccggcaatcccaacgaccccagtcaaccaccgcagccgggatacggcgcctatgcaccgaaccagcaagcgcagcaatcgcaacagcaggacggtccacaaagcggcggaccagatgccgagcagacccctcgctattccggcaatccatatggcaacccctacggcaatccgtatggatatccgtacggtaatccgtatggttacgacccgaatagccatagcaacgacagtggcgagtgggagccggtaagcccgttcaagttggtggaatcgtggctgccgcaacgcgcgaagaatgccattcgcggtgtatacggcgtgctcggcgtgatggcgattgtgctcggcattgcgctactcatctggccgggggtgacgctgaagatcgccgcggttgcgttgggcgcgtatttcgtgatttccggggtgatccgtatcgtcaccgcaattgtggagctcggtctgccgggaggctggcgcgtgcttgacattctggtcggcctgttgctgacagtcggtggcgtggtcatgctgaagaatgcgaccctgtccggcgccatgctggcagtgctcgtcactatggtggtgggcctcggctggatgatggaaggcgtgatggcgctggttgagtcgtggcatatgccaagttccgcatgggctgtgatttacgcgctgatttcgattgtggccggctgcatcatgctgttcagcccgctggcctccaccggttggctgattctgtttggcggatgcgcgttggttgcacttggcattgtggcgatcgtccgcgcgttcacgtttggcaaggtcggcaagtccggcaagaagcgctaactacgcgtagttctcccgtataggcgataaacccatacgggagaacgcgacgtgccgtacgattgacatgattttatagtcgcgctatgctaagtgaaacgtttcgacgaaacgattcgataaatagcggatagaacggcacaagagggaggcgagacgcatggcaggcatcaaagacgtggcccgcgaagcgggagtttccgccagcaccgtctcctatgtactatccggcaagcgttcaatctctgcgaaaaccaccggcaaagtcatggccgccgtagaaaagctcggttacactccggacgccagcgcccgtaagatgcgcggcatgcgcaaccagatcatcgcgttgagcgccccgattcgaggcgacatcaaccaggccaggtacaacgcctacttcctgcgcaccgcatgggccgcaaggaatgcagggcatgacgtgatgttgctgaccggtccggatgcagtgaaggatatccgccgcgtgacgcaaagcaatcttgcggatggcatcgtgctgctcgacgtggagcaggatgacgagcgcgccgctcaatccggcactttttccaagccgtgcgtggctatcggctatccgtcgtcgcacgccggctgcgcctgcgtggacatcgatttcgcgctgatgggccgcaaggccgtcgacttcctgtacgagaagggacaccgcaccgtcgtgttcctgcgcaacaacgaatccgactacaaccgccattccggttacgtcgtcatcttccgcgaaagcctgctggcgcacgcgaaggagctcggcatgacggtcatcgaatccgagcattacgaagcggacagcttcgacgcgcagcacttcgtcagcaccgtcttcgcgcaccccgaccgcccgaccgccatcatcaaccaggcgaacgcaagcgtcctcagccaggtgctgatggcgttgcacgacgcgggcatgtcgattccgcaggacgtttcggtcctgtcgtgcggcacgtatttcgaaggcgagccgacgcgcttccccatcaccgaaatgccggtcatgccggaggagctgtgcgccgaagccatgaacctgttggtctccgccatcgaggagcacaccgacatcaaaggttccgtggaactcatcgaacccgcgctgaagcgacgcggatccgttgcggaagcggggtccggcggaacaatatagattttcctgcgattaccggaaggcagagcggccggacggaatcgcaaggcaacataatttcatacggataatcgaaacgtttcaatgacgatacaacggtctccgaagaaaccgaacaaacgaacaagccgggcgaaatccggcgaatccaaacggaccgcggaatcgcacgcacgtcatcgaaacgtttcaatacaaccagatgtgagccgtgccgcagggcgcgcctcaagaaggaaacaaggagaatagcaatgaacatcaaacgaggactggccacgctggccatcgcagcactgtcgctgacctccctcgccgcatgcggcagcgataccgcacaggacgaggaaaagccggacagcctgtcgttctggtactacgaagaggacgacgcaggccagacccaggcatggcgtcgcgcggccaaggccttcgaaaaagagaccggcgtcaagatcaacttcgagcgcaagtccttcacccagatcgcgcagaacggcagccaattcctgaactccgacgaagcgccagacctcatggaatccaaccgcggcaacggctccgccggcgtgctctccaccatgggcctgctcaccgacctcggcgactatgtcaagcagtacggctgggacaagaaggtgaccggcgcaaacgcagcagtcgccaagtacgacgagaacggcatcatggacggcgatacctggtacggtatgaccagctacgctgaattccagcgcgtctactacaacaaggacctgttcgccaagtacaacatcaagattccgaccacctacgacgagttcgtggacgcctgccagaagttcgtggacgccggcgtgaccccgattgcagccgacgcgcaggaatacggcgtgatgtggctgtggtggcagctcgtttccaagaatgccgactccaagttcatcgacagctggcagctgtacaggggtgacgtcgactggaattccaaagtgctgaccaactccgtcaagaccatcaacgagtggcttgacaagggcttcatctcccgcaacgccactggcatgaaggccgaggacaccacgcaggccttcatcaagggcgaatatccgatctaccagactggtacttggaaccagggccgtttcgtcaagcagatcaagtcgttcgattgggacgcggccgtcatgccggaatccaactacgcagtcggctgcgcaggcaacctgctggtgattcctgagaagtcgcaccacaaggatctgtccgccaagttcatcgactacgtcctctccgatgatgtgcagaacttcctcggcaacgcaggcggcattccggtagcggcagacaccagcaagatcaccgacgcgaagagcaaggccatgatcgaggaatacgattcctacgccaaggacggcaagctcagctactacccggattacgcggcctccaacctcaccgacgcggttccagcggagttccaggagctggtcaacggcaccaagaagccggcagacgtgctcaagaacatccacgagaagtacgacaccggcgtcgaggacatgggcgtcaagaacaactaaaaacaaccgatccttcctttccattccaactccaataatggtgcggcccgtcttcgggcggaccgcaccaaccctttcctcccccatacattccgcacgtcgcatcgcgccaaatcgtgcgtcatcacagaacaatccatcggaaatccctcggatcatcaatatttcaaaggacttgcaatgtctcaaaagaccaagcacgaagcctccatgtcgagacttcccggcaaccgctccgcgaaattcgttccatacctcatccccggcctcatcggtctgttcgcggtagttgttgttccgttcatctggaacatctacctgagcttcacccgctggcgtggcgtcggtcccgtcaagtgggtcggcctgaaaaactggaaacgcctgttctccgattcgacgttctggatttccttcgctaactcgttctggatcatcgtggctatcgtggtcatccctaccatcctcggcctgttcatctcgtctctgctcaccgacgtgatccaaaagaagttcggcggcaaaaccgcttccttcctgcgcgcgctgttctatttgccgcagctgcttccggtggccgtcgccgcaatcatcatgggctggatcttccgcccggaggacggtgccgtcaacgcactgctcgccaagatcggcttgggtgcattgcagcacaactggctgggcagccctgacagcgcactgccgatcctcatgttcatcctggtgtggatccagctcggctacccgatcgtcatcttcatgtcgggcctgcagcgcgtcgatccggaactctacgaggccgcaggtcttgacggcgccaactggtggcagaagttccgcgtggtcaccctgccgtccatcatccctgaactgctggtggtcatcctcaccgcaaccatcggcgcactgaagaccttcgctccggtctacctgctcaccaagggcggtccgggcacctccaccacggttccgtcgtactactcctacaaccagttcttccaggtgcagcaggtgggctacggtgccgcaatctccacagcgctgactgtggtaatcatcgtcttctccatcgtgttcaccctcgtgcagaagcacgtcgagaaggaactcgtctgagagaaaacccgaaaaacaatcgcaagaacatactaaaaatccgaaaagcaaaggtgccatcatgacttattccatgtccacggccgccgcgcgcaaggcctcgaagaaaacgcagcacgtgcgttccgcaggtgactggatcaccctgatcctgctcgtcgccggagctctgctcgtcctgttcccgctgctcgtcctgaccgtcaacgcgttcaagacctccgccgattacaacgccaccggcccgctctccctgccgaagcacttcaccatggagggcatcatctccttctggactaccaccaacttcccgctgaagttctggaacagcttcatcatctccctagtggtggctgtcgcggcggtcgtgctgtcggtgctcaactccttcgcgctcggcatcggcaaggtcaagggcaacacctggatcgtgctcggcatcatgctcgccaacatgatgccgcaggaagcgctgctctacccgctgtacaccatgttcaagcaggtcggtctgtacaacaccaaactcgcgatcatcatcatcttcaccatcatccaaagcgcctacggcacctatctgctgtcctccgtatacggcacgttcccgcaggccatccttgaggccgcggccatcgacggcgcctctcgctggcaaatcctgcgcaaggtggtgctgccaatttcttggccgaccatcagcgtgctgttcgtgttcttcttcgtgtggacgtggaacgaatacatgattccgatggcgttcctcatgagcgatgacgtacagaccattccgctggcactcgccaccctgcagggccagcgcaccatggaagcgaccacgctggcatcggcttcgctgctgagcatcatcccgaccatcatcttcttcatcatcttccagcgcaagctgtcgcagggtatcaccgccggtgcagtgaagtaacgcgacccaacaacgctgggatgttgtgaaataacgcaaaaacagatacaaccggccgcggcggctttcagcaccgtagccggcattatcgacgcgcccactgcaagggggatctacgatagtcggtagtggtaggcggcgcacccatttccgcgtttcccaagctgtttaacaaaggagagaacaatgaatactatggcgacttccggtttcggcaacggtgccctcgattcgctagcaatcgcgacggaccacggccgtacacgttgcgtcaacgccgaaaacccgaccggcggcaagggcactgcagccaccgctgccagcgcgctcggcccgtcacgtaagggcagcccttgcatccagacgatcaaggcgggcgattcggtcacgctgatggacgtcgatggcccgggcgtgattcgccacatttggatgacggtcaccgaccgcacttccccgaccggtccgaacgtactgcgcaatctcatcctcgaattctattgggatggcgaggagacgccgtccgtgcagtgcccgatcggcgatttcttctgctgcggtcacgcacaggcctgccgtatcaattccatcccgatcatggtggtgccaaatcgaggtttcaactgctatttcgccatgccgttcgagcacgcgcgcattgtgctgcgcaacgatcacaacgaggacgtgccggccttcttctaccaaatcgactacacggaatacgacgcgctgccagccgatgcgatgcgcttccatgcgcagtggcgccgcgaacgcgtcaccgaaattgcccgtgactacacgattctcgacaatgtgcacggccatggcgcgtacatcggcacctaccttgcgctgaccgcgctggaaagccgctggtggggcgaaggcgaagtcaagatgtacatcgacggcgatgaacagtacccgacgtggtgcagcaccggagcggaggactacttcggcggcgcgtggagcttcgccgacttcgacgagcacggccgcatgcgcgagaacacgttcaccggaccgtacctgggattcccgttctattcgcagcgcctcgccgcgcaccgcgaaagcgactactgggatgtggccacacccgtcatgcgcggcctgtaccgctggcacattccggatccgatttatttcgattctgacctgcgcgtcacctggcagcagatcggcaccgaggaagccggcaatttcgagcggcaggatgacgtcgcgtcggtggcatactggtaccagcttgaaccgcacacgccgttcgatccaatcggtgaccgtcacttccgtcagccccgctgatttacgattattccgctgatttacgattattccgctgatttacgccgatatcgccgtatcgtgcgttgacatgggaatggatatgttccgtctcgtgtcagcgtacgatacggcgattgtgttgttatgcgggcacagtaatcacattttcttcaagataacccgatgattttacaatagaaatgacgattgcggcatgccagacgcataccgacgtgcgtatagtaaaggcacaacagaaaaacaacagaagaacgaagaacaagaaaaacaacacaatagcgacgcaccgcacgatgtagagaagaaaaaaagaagcaagaaaccaggcggtcgtccgaaaggaaacatcatgaagaacaacgacactttcaaccagatcctcaactccaacctcgcttccatcgatccgggcttcggccagttcgcacttgccaaggcttccgctgatctgatgaagaaggtcctcaacaagtaagaccttcaagcaggaaggcaagccgaaccgcgtcaggccatctctttgaaacagaccgcgtgaggcaaggcaccgccgcagcgaacgctgcggcaccgattctcttctttccgattttttaaatcgcatagcgggaggccgcgattccaaccgaatcgcggcctcccgctttttcatacgcgcacatgcacccctgtcttgccggcaatgtccattatttgtgccacacaatcacgccaatacatcgctttccgtcaacttcgcacgaacttaacagcaacttaccagcgaacttaacagatgcgaagttgccgttaagttatgttaagttgtctggcaagttcggtggcgtatctaccgcacgccacctgcgcagcgcaaccgctacagttcctccatcgcaagattgcgggctgcggcgcgttcgcgggggccgcgcgtcacgtagaagccgatcgccacaattacgaacatcaccgtgcagcaggtccacagcacgtgactgccgaacgcgttcaaaatccagcctccgacaagcggcgaaaacgcgttggatagcgaccacaccaggttgtacaagccctgatacgtgccgcgtacatccttcggcgcgatattcgccaccgtcgtagcggcaatcgggaatgtgccaagctcgccgagcgtccacagcacggtcgcaatcgcgaacgtcacccacgaatcggcgccgatttggaacgcatagccaaccgcggtaatggacatgcccagcaccagcacacgggtgttgctcatccgctggaacagcgcgatcgcaggaatctgcagcaaacacagaatgcctccgttgatggtcagcaggctggaatattcgtccgtaccaagcccaatctgcgtcatcgaaatcggaagtccgctgacgatctggtaatacgccagcgtgtacaggaacatcagcaccaccatcgacatgagcgctttgtcggtgcaggcacgacgatagctgcgccaaatggagaatttcgattgctgcgattgagccgtttgcgcagtgccagaacgttccacaggttgttccacggaacgttccacggagcgtttcacagaccgtccgacaccgtgcacgcccagcccggcctctttgaagaatgccatcatcagcaacgtagcgaataccaacacagccgcttccgcatagaacatcagcgaataggagattttgacaagctggttggcgatgatcgggccgatagcgaagccgaaattcgcagcccatgtttgcagcgaatacgcacgcttctgcttgcgaaacggcaccacgtcggaaacgtaagccgcgaccgcaggcgtcggcatagatgaaatcgcaccgtatatcagcaacgtaatcgccataatccaaggattgccgatacaagccaacaaaaccagcatcaccgcggaaccgagattgccgataacaatcatcgcggggcgcccgaatcggtcagacagcgcaccaccgtacaggcagccgaaaataccgccgaaaccgtacatggagacgatggtgccggccacgcccgcgctcacatgcatgtcggagacgaggtacatggaaagaaacgacgtgacgaaacggcccatccacaggatgagcagcgtgacccacaagccccagaacatgacgggcaaaccgaaaatctctttgttcttctccattcttgccatcatatcgagcaatatcgagcagacgcgaagccgccgccttttcccggggtgctgggacaatggacaactatggcaatgaaaaaaggaccgaccaaggggtcgggcggaaagcatcgtaacgcgctgaagggcaaggggccgacccccaaggccgaagatcgcgtatatcacaaggcttacaaggcgaagaaggcggcggatcgccgcaagatggccgatccacgactggccgcacgccgtcgagcggcgaagttcacgtcggaatccgacgatctggtcatcggtcgtaacgcggtgcttgaggcgctgcgttgtggcgtgccggcaaccacgctgtatgtggcggcacgtatcgagcatgacgatcgcacgcgcgaaatcgtgcgtctcgccggcatccacggactgcatctgctggaagccgacaggcttgaaatggaccgtatcgcacgctcgtcgaaccatcagggcgtggtgctgaaagcccagccattccagtattcctcgctggcggaacttgtggatcgtgcggacaagaaggcgcgcgccatggaagcagccgattcggaaagcgcgcgcatcgcggcacgtccgctgttcatcgcgctcgacggcgtcaccgatccgcagaacctcggcgcggtcatccgttccgcggccgcattcggcgcgaacggcgtgattctgccggaacgtcgttccgcttcggtcaccgccgccgcatggaaggtgtccgcgggcgccgcagcgcatatgccggtggctcgcgtggtgaacctgaccaaggcgatcgaaagcctgaaggaacgcggctactacagcgtcggtcttgacggcggcggcgacgcgctcgtcggcgaaaccggcttcgaaaccgatccgctggtggttgtgctcggctcggaaggcaacggcctgagccgtctggtacgcgaggcgtgcgattcgatcgccggcattccgatgtcgaatatggtcgagtcgctgaacgcgtccgtcgcggccggcatcacgttgtatgccgtggcacgcgcccgtcgcgaggccgcagcagccaagtaatcgtttattacgatatttatgaaaaagctcaagccttatggcttgagctttttcatatgccattaacggctaatggctccacaccgcagcgtccggatcatcgtccgggttgtagccgtcctcgtcggtgccgtaagtgtattcgtcatcgatcacgccggaatcggcctcggcgttcagcgcgtcgacatccttcgaatcgagcttgtactgcggcagcacgttctccacatagctcttcacggcttcggtcatggacacgtcgtggccggccttctccgcaaggaaccaacgatggtcgagtacctcatggaagaactgcgccggctcgatctgggagcggtattcgcgcggaatcatgcgcacggtcggctcgaacacctcgcgcatccagtcggtggccacgatttcgagatcctcgccatcacgccacgtggaggtgcggtaggcgtccagatcgttgagcagacggcgggcctggttctcctgcacgtcaagaccggtcagtcgcagcagcttgcggttggcgtagccggcgtccaccacgcgcggacgcaccagcacgcgcttgccgtcctcggcggtcttcatttccagctcgtccacgtcgaagcccagttcgttgagcttattgacgcgcttttcgatcttccacatctcgtccgggctgaacttgtcggtgtcggtcagcgcgctccacagcgaatggtagcggtccaccaggcggtttccgatttcgatttcgtccacgttgctcggcagcaatgcgccggaagacagatccatcagttcgccgatgatgttcgtacgggccaaatccacatcgtattcacgctggccttcggtgaggttcacctgcagatcgccggtttcggcgtccaccaggaacgcggagaaagcgtcggcgtcacgcaggaacagcacgttagacagggacacatcgccccaatagaagccggccaggtgcagacgcaccatcagcacggcaagcgcgtcgatgagtcgttcggcggtgtcgggacgcaggttgcgggcgaacagcgcgcggtacggcagcgagaatttcagatgcttggtgaccaggatggcttccagcggctcaccttgcgcattatggcggccggtgaccacggcgatcggctgcacggtaggcagttccagcttctgcagtcggcgcagcagctcgtattcgcgttccgccacgttgcgtgtgatttccttcatggcgtagacttcgtcgcccacgtgcacgaaacgcaccacgtgcctggagatgcctcgcggcaggttgaccagcaggtcctcaggccatgttgccagcggcttctcccacggcagcgtgaacatcttcggattcgaactcgcggcggtgatcttcaacgcctgcggctccgggctctgcgctgcggggtcctcggccttcacggaagtggccttaagcacacggggatccatctgtggcaattcatgtgattccatagctcttcaatttacccgctgacctacccacggcaggcggcaaagggactacgagtgtcacgatgagaacagcgggaaaagaaaagccccgcaccaacgcggggcttttccaacgagacaataagagaggaaagagaatgtctcgtttaatggttgacggacgtttgcacatccgccaagtattggttcaaccacccgccaagcgttccataaggaacgcccgacggttggttactcgttatcgtctcagttcagacgcagctcggtggacggagcgaacaggtgcatcttggacgggtcgatcttgatcttgacggtatcgccgaccttcggaagagcacgcgggttcacgcggatcgtggtgagcttgttctgatcggacatcatggtggacgcctcagcagcggagccatcggtgatgatgttgccgtagatgtagccgtcggagcccagatcctcaacgttcatgaccttgagggagaaggcgttggcctcatccggggcagccaaggaggcgtcttccggacggaagccgaccacaatctggccgttgtcttcggcggtgagcttgttgacggcctcagtcggcagatccacggtgtcctcgccgatctttgccttgccgttgaccaccgggtgggtgttgatgttcatcgacggggagccgatgaagccagcgacgaagacgttggccggacgatcgtacagctcagtcggagcgccgacctgctgcagaatgccgagcttgatgacggcgatacgatcacccatggtcagagcctcggtctgatcgtgggtcacgtacagggtggtgacacccagctgacgctgcagagcggcgatctgggtacgggtctgcacacggagcttggcgtcgaggttggacagcggctcatccatgaggaagaccttcggctcacggacgattgcacggcccatagccacgcgctgacgctgaccgccagacagagccttcggcttacgatcgaggtactcggtcaggtcgaggatctcagcggccttctcgacgcgcttgcggatctcttccttcggggtgccggcgatcttcagggcgaagcccatgttgtcggcgacggtcatgtgcggatacagagcgtagttctggaacaccattgcgatgtcgcggtccttcggctgcatcgtggtgacgtccttgccaccgatgaggatgcgtcccttgttgacctcttcgaggcctgcgagcatacgcagggtcgtagacttaccgcaaccagacgggccgaccagcaccaggaattcgccatccttgatgtcgaggttcagatcatccacagacggcttgtcattgcccgggtagatacgagtaacatggtcgaatacgacttctgccatgatttgtcatcctttcagaggcaggtacgtgcctcacgatccgttgtaaagggatttttgttcggtgcccatcctcgcggcttactactttgacaaagccacaattcaaagcgtttacttattggttggtttagcgaagatctcttcgttgagccatgacctactatacacacccaaaccgaatcgtcaatgcgtgtcgcgggttttcaccgctcaaaacagtctattagggggttatcatcccctcaaatcgatggtttttcatcacaatatcctcattccgcgagagaatggacggtagtctgaacggtgagacgtggaggttcatcgtgcgcaatatccgaatcggagtcgtcgaggacgaccctgcaagctgccaattggtactcgattacctcaatcgctaccaaagcgagaccggcgagcaattcaccgtctccgtattcgacgacggcgcgcgcatcgtggagaaatatgcccccgtttacgacattctgctgctcgatattgaaatgaaggagatggacggcatggccgccgcccgccgcatccgcgaacgcgacgacaacgtcgtgatcatcttcatcaccgcggccccgcaatacgccatcagcggctacgaagtgcgcgccctgtcctacctgctcaaaccgctgccatggttcgcgttctcgcaggagctcaagaaatcgatcgacatggtgcgccgcaacggcgacgattccatgctcatcgaaaccggcaaggggcagatgaggatgaatctcacggacatcctttatctcgagtcgatccggcacaccatcgtcatccacacgcttgacggcaaatactctatcaacggcacactcaaagacatggaagccaagctcgccgaccggcacttcttccgctcgaactcctgctatctggtcaatctcaagcatgtgacgggcgttgccgaccaggattgcatcatgtccgacgacgagcggctgcgcgtgagcagaccacggaagaaagcgttcctcgccgccttggccgactacatgggcggcggccgatgatcaccaacgcgctgcccgacatcccccgttcgtacaccgccatctgcgaatgggcggcatgcgtggtgtatatcgcggtactgttccgccgcgtgccgccgcgccgctccgtcgttgtgagcgcaatcggactggcggcgctcatcgccgtgcagtatttcgacggcagtatgccgatctggttttggatcgtcggcatgctgctcgccttcggctgcatgtacctgacgattctgttcggtgccggcaccggcaagcgcgaagggctgtacatcacggcacgcgcgttcgtgctggcggaactggtggcgtcgctgcattggcagatcgtcgcgttcatcggcacacatgacgctcaagccacttcatacggtgtgcaggccatcgtcatgctcatcgtcatctacgcgctgtgtttcggcctggcatggctggtggaacgcggcaatttcagccaaaccacacccacgctaccgaccgcctccgcggcaaccgcgacggtggccatcaccatcgtcaccttcgccatgagcaatctgagcttcgtttcgaccaatacgccattctccggttcgatgggccaggaaatcttctatatccgcacactggtggatttctgcggattcgcgattctatacgcgcaacaggagcaggctcggcgcattgaagcgagcgcggaaatcgcgtcaatcaacgcgcagctggaaagccagcatcaggagtacctgcagtcgaaggagaacatcgaatcgcttggtcggcttgcgcacgatctgaagcatcagatcgcggcattgcgtgccgaagtcgatcctgagcatgcggcggcaggattcgagcagttggagaagtcggtgcagcgctacagcgcccagcagcataccggcaatcccgtgcttgacgtcatcctcaccacaaaagagcgcacttgcgccgatcgcggcatcagcttcaccgccgtggcggatgggtcgctcttgtccaacatgtcgtcgatggatatcgcttcgctgttcggcaatgcgatcgacaatgcgatcgaagccacgtcgaagctggccgatccggaacagcggctcatcaaactagcgttgttcgagcagaattccttcaccgtggtccgcatcgagaattattacgattcgcggctgaagaaagatgccgagggcaatctgcgcaccacgaagcgcgatgaccagcatcggcatggcttcggcgtgaagtcgattcagcacatcgcgcaacagtacggcggcgaggtgacgatccgcaccgacgaccactggttcgtactcaccgtgctgcttccccgccagacaggcctgatggccatgtgaggatggcgtccatgtgaggattgcgagccggcaatgcgaaggctaacgatctgcagctttcgcccgcggtagatgccaagcggcaagcggcttggccagacgggaggcggtgaacgcgctgacggccaccgcaaggccgattggcacgaacaggttgatcggagcgtcggccaactccatcaccaggcaaatcgccatcaacggcgcctgctgcgaggcggcaagcagcgcgcatgcacccagcagcgcatacatgccgatcgaattcgtgtggaacacctgcatccaaagaatgcccagaatcgcgcctccggaagcgcccaatgcgatgcccggctgcaacacgccaccggaagcgccggaacgaatcgtcagcaaggtgacaatcgccttcgccacgaaactcaacagcagaatcggcagcacggccaaatcggccttcgaggagaaactcagctgcgcggtggcgcggccattgcccatcacctgcggcacgacaatcgccacaacgcccgtcagcaggccggcgagcggcatcatccacagaatgcccgctccggatggcttgtttttctccgcccactgggagccgcggcggaacagcgcgccggcggcgccaagcatcagtccggcaaccagtgcgaacaccatgtagtcgggggtaaacaggccgtccgcctcgccaatcaaatagaacgtgtgcgtgcccttgaccaggctcgccacccatgaggcgagcgccgagcaggcgaacgcgagtgagaccgtttcgagcgtcacgtcggcgagcaggatctccaccgcgaagaacgtgcccgcaagcggcgcgttgtagacgcccgcgagaccggccgcggcggtaatggccaccagcatacgcgtgtctttcacgtcgagacgcacccagcgggcgaatcgttggccgaacatcgcgccaagctcgcgcggagccacctcgcggccgatcgacatgccggtaccgacgataaaaatctgcagcagcacatgtacgatggtctgccagaccggcatcagcgcaccaccgacggctttcttgacggatggcactgttgtggtacgcgtgcgcagcagccaccagatcacggccgcgatggcggcaccgaccgtcacggaaatcgcacgacggatggcaggcacgttgaacgggccggattcatgcgcgttctcgatgtatccaagcgcgaaacgttcgacctggtacagcatgagcgtcagcaaacctgcggccgcgccgatcgcgatgccgacgacggccaccgccgcgatcagcgccgggatacggccgatgttcggccgctgttccgtctcgtcctgcgattgcttcgacaccattgcctctcccacgttgcatgcacctcgtcttcagtccatctcgtcattcgtgttgccgcatcaccatcgttccatccacggcggatttatgcgccgatatccttcagcatgaatcgcagtatcggtcacacaacttgcgtctgcatagtgaacggccgatcaggctcgtcgtcctcggcaacaaggccggccacatccgccaaacaccataaggcgtacagcggcagattcatcggcggcaaatatattggaatatatagcattcaagacacaagatgcacaaaatagacaatttcaaaggcttgtttttgcacaaaacagacgatttctgccacagccaaaagcaaggaaccggacctccaccatacctttcaccacccactgccagtaccgccgtggtgcccggcgaggcattcggcgaggaagggcagggattcgtgcgattgtcgtacgccggcgatgcggatgagttgcgtaagggactgcgtcgtatgtgcgattttgcggagaggaatcgctgacgccgtcaggtgcatgcccgtccttcgtcgcgttcacccactttgttgtgtatgtttacgatttgtataatcgtaaacatacacaacaaaatcatacgatgaaacggcggcacgttggacgggggatggactcctagctattcgaatgactagccgtgcacaatagcgcgtgaagtcggagcccatgacaacatctacactgtcatgagcgcataggcaatccgccgttcgacgtactgacgaaatagttgggatacttgtctgaatcgtaggttgcacatatgtgcaactcctagactgttcgcgctagatacaggcatacagtattcgtatcatacgcaaccaaggtggtgacatatgctcagcgaaccggtgaaagcattatttgagtccaacaccaacgcccgtcatgccggcgacgcagacagactcgccaaagagcataagccgaacggagtgcatgtactgacggatctcccatatggcattccggaccaactgcgcaaattggacctgtatcgtccggaaacacaacatgaacctcttccggtcatcatcgacttccatggcgggggtctctaccatggcgacaaacaaaataccatgtgtcgcgatatgtatttagcgaagtatgggttcgccgtggtcaatgccaactatcggctggtcccgcaaattggattccaaggccaactacacgatgcgcttgacgcaattatctggacgaatgagcacgcgcatgactatggcatggatacgaatgctctgtttctgattggagattccgcggccaccctgcttatcttgtacctcaccgccgtactccattcaccggtcgtcgcgtcacagcttggcatgaaggaagcctgcggaaccgcccgcatcctcgccattgcaggatgcagcggcatgtatcgcttcgagggaggcgtgcatggaactgcaatgggatactatgcggaaggctactttccaacgctgaaggaacgaattcgcatctccccctatcttgatgtcgatcgccttgtagttgatggcaatcttccgcccttctatctgcagaccagcaccgaggattatctcgcggacaacactctggaattcgcaagaatcctgcaataccgccatcatgattatgaactgcgattactcccgaaaggtcttgaccacgctctcgtacacgacttcgcagtcaaggaggtcggcctggagcataatgaggaatcacagcaaatcgtaaaagaggcggcgacgttcttcaaacggtaccgcccaacgaccagctaggaaaggacgctatggaagaacggattcgctccacccgctcctcactggcagtattcgtaggctgctgcgccatgtccttcatcggcttcgctctcatcaccaacacttcagggctgtatttcgacgccatcagccgtgatttacatgtgggtcgagccaaggtcagcctaaccgtatcgattcgattgatttgcagtgccatctccatggccgcgttcagtcgcttttcacatcgcattcgcttgcgccccacacttatcggctgcattggtatctgcgccgtgggattcctgctttgcagtcgggcgtatgccctctggcagttctatctcgcattcgctgtgatgggactcgcctatgttattccgataacgctgatgccacccattctgcttgcggcatggtttcccactcatttcggcacggtccttggcataaccggctgtttgtcaggattgggaggagccatattcaatcctctgatttcgcacgtcatcgcgtcatatggatggcgatcggcatatctactgaccggtgcgatgctgatggtgctgctactcccctgctcctacctgcttaaaccatatccacatggcaagctcgacactgcgtctgccccaaacgccaaacctgcgcatgatacacggacgaaaagcgggcatctcatcggcatgcttcgttcaccggcgtttctgctgctgtcagccgccatgattttgttgcaaatcgtatccggcatcaatcagcatattcccgcgtacgggatttccatcggactcacgcttacacaggccgcttgggtggtcacggcccgcatgattggagccagcgtcggcaaacttgccataggttcgacgctggaccgtgtcagaccgcaattcgcaatcacgctgtttgccgccatcggaaccacaggatggttcagtctgcttttcggagccaatatggaagttgcgatcactgcaagttttctggcgggaatcggccaatgcctgctcatgattgcacttccctggagcatacgccgcgtattcccgggagatgattatgcccgcgcgctgtccgtcatcaacgccaccggccagctgaccgtagccatcgctaccacagttcatggattgattttcgacatgaccggcggatatggagcgtcattgacgctcaacgtgctgttgtacgtgctggcagcaattgcaatcatcacggtggcgcacgggcatacccaatccttccagcatcctaacggtgattagtccatatccaataacaactcagccattccctgattggtagcgagtgccgacatcagtccaccgaccaagcatgcgtgcagtgcccgcgcacgccacgtctcccaagcgactccaatgaccaatggaatgtcacgaaaccgttcgaaatcgatgctgatggtgcgctcacacagactggttcgcacatgattgccatgcatatcgatatgatgtccgcaaatatgcccgaccactcccttttcctgcaactcccgtgctactgcagcgtcttcgaacgaatggaaaatcctcccagaatgcccctgccgaatcgctcctacaccgacaatggcgatatcggctcggttacccaaagccaaagtcatggcaatcagtttctccgaacgcacagcctgcgcaacttccgcggatcccataatcaacggtgcaggaagcaacgagtaagcgcatcccagacgttctgccatcattcggcagatttccggagaatcagtcaacgagttggcggaagacaacgaacccagcatctgagtcacatgcgcacgagggtagtcaaggggaggcaaagctctgattgtcgccgccatcggcgtcccggtcgatgtaacgatcaacgaatccggtttgaggttttccaccagcagctgcgccgcacattgaggcactagcgtcgatgcgatgctgtcatcgtatgaatatgtgacgcgtaccgttttcaacccgtatttgttccgaagattctcctcaagggattgcaatcgttgcaatgggtgcccgatggtaatctgtacgattccggtttcccgtgcttcggtgagcatgcgtgacaccgatgaccgcgaatagccgacctctccggcaatctgcgattgattgagtccctcgtcataatacatctgtgatacacgaatcagcttttcgatatgctgtctggtctgcatcgacgaaagcgcggaatctttgaacatatgtgcatgttatctccagtgtccatacgaacacgcgcgataagcatacgttttaagcccatcatcaaccgatactccggtaaaccagcagtgtggcgatgcacatattctcattcacatcccaatgtcatttcatcctcaaattagtctataaccggctccaggaagaaccgggccccgcgttaccgaaggatgatcttcgggtgacgcggaaggaacagagggagaaaaataccatgtcgaaagtatggcaatacttgaagcagcatgcgtatggcgcactcaccatcgttacggtgttgttgtgcattctgggcagctgcatcgcgaatctggcacagacggatttcggcaacgtcaccaaagagaatctgaccatcgaaacatcatccggacataggctcggcatcaacatgctcaagcccaagaccgccaccaacgacaagccggcacccaccatcgtgttcgcacatggcggcaacggtctcaaggaaaagtgggatctataccagatcgaatgggcacgtcgaggcttcgtcgtgttctccttcgatctttacggacacggcgactccgagattctgaacaacaccgaatggctggtcaacggccgtggcctgtatgacacggtaaagtacgcgaccacacttccattcgtggacaaggaccagatcgccgtatccggccagtcccgcggaggcaacaccattcacgagacgatccttcttgacaacaaggccaagaagcagctgatcaaggccgtgctgtacgtcagccgcgacgccgtctacaaagacaacgaaactcagtcgttcggctatgtgccaggcaagaccacttcagcccaggccgcctccaagaataacggcgagtactttaattattacggcaatcgcaatgtaggcatcatcgccggcaaattcgaccagtactccttcaaggagaccgacaagacgaccggcaagatgctgccgaatccggactatctcaagcacaataacgccaaatcgttcctgaacttcggcatcacgcctgactcttcgactgcggacggcgtcagcggcaagtactatacgaagaaggtcgatggcaaggaagcattccgtgtcatctatctggaaaacggcttccacacttcgcagctcttccagtcgtcttctaccgcagctgccatggagttcatggtcaaagccttcaatatgaacacctcgttgcagtcgggcgaccagatctaccagtggcgtatgatcggcagcaccatcggtttcatcggcatgttcatgttcgccgtgttcttcgctctgtggctctcccagatgccgctcttcaggggaacttctcgtggcaatgccgtcatgcgtatcgcggaatcgcatccgggaaccaaggcttgggcatggggctgccttatcgtcaacaccctgttcgccaccgtcagcacgttgttcctgtactacaacggcgtcgacacccatatcggcacattcttcaggcaggggcaggcactgttcgcaggctccatgctggcgatttcctctgtgttcaccgccattgtcacctacatctggtaccgctgcttcgctaagaagaatggtatgaacatcgatgaaatcgatttgaagacatctgctttcagcgtgttcaagaccatcatgctggctctcaccgtcaccggcggcactctgctgttggtctggggagcgcagtacttcttcaagacgaacttctcgttcctgtactggggcatcatgccattcggctccttcaagatcgtggacatgcttaaggtactcccgatcttcctgattggctacgtgatttcctccatcttcatcaactgcatgaactacaacacttcctatggcaagaacaagatcgtgaacatcctggtactcgctctcgtcaccgccgccgtgccggcactggtgtccggcgcaggctgggccaagttcatgctcaccggtgtcaatgacctgttcggtgcggcctacacccgcattccggacagcatgttcctcaccgtattcctgctgtttatcactccgctgacggctcgcggcatctattccaagacccgcaatccgtacctcggtggcatcatcaacgcgattttggccatggtaatcacctgcgtgaattgccaggtcgttttcccggcctgatcgctagatagcacggcatgacaaagggtggtggctcatcgactgagtcaccacccttcttatttgcaaggtacgttacgccttccaacgacatcagacgcgaagcaggcatggaaaacccgcccggaaaatccgggcgggcaggaagaaaggaattcagaatagggctacttggcggcctcctcgctcttggccgtctccttggacccgctcttcggcatgacccagaacttaagcagcggatagctgacgatcacggcgagcaaggtgttgaccacggatgcgatcgtgcctgcgatgccggcgttcatgccccatccctggcacagaccggtcacgtagcccggcagcacaaggttcactaccacgatgatcacggcgaggatcacatacttccaagcggcgtccttgaagctggagtcggacttgaagacccacttcatctgcacgaagaagttcaccacctgcgcaagcacctcggcaagcaggaaggtgaggaatccgcccaggccgttgcccttggtgtcatagttgaagatcaggaagtggaacggctgcgtgagccccaggccggagatgaaaatggcggtgccgatccacgtcaccacgaaacgggtaatggtggagatgttcgacagcacattgaacaggatgaattcccagatattgggatgatccttgatccactggcgaatcggtccggccttcttatcgccggcagcggtttcggccggcttcgcagcattgttctcagtcatggttcagctcctttgcggtgcgcttgttggcggattggttgcggaagaagccggcgatcacgccgcccaatccgcggaaggtatgcccgttggcgatgttcacgatggcgtcgaccatcgccgagtcgaccatgccttgggtcatcttgctcatggcgcgaggcggcatgttcaggatgaacagggtgttcagatccggcgaaccggtcttctggcgaatcttcgcttcgcgcttggtcagcgtcctggcaacagtgcgcgccgcgaatcccttggaatccacccacgacatgatcggatcgttgacaccgaacgtcgtcggtttgccgggagcaagcacctcatggccgaacagcacggccatttcggcatcggtcacgtccttgacctgtccggtcagatagtggccgagcgcggggtctgcggcgcattcagcgggcgtgcaatcgccggccacggtgtgaggaatcgcaagcggcagatgctccgcattgtcgccgatcatcagcgtccattcgccgctttccgtcttccatgcattggcggcaacatcgaaatggcggaacgtgtagcggtcgaaatcgatgtgcacgctcttgctttcatgcgctgccagctcgaccttgatgaagcccttcagctcacggtcgggatggagcacgccaccctgcggcgcacgcacatacaactgggccacggtggagccggcgacatcggaatcattggtgacgacgaaatccacaccggtcgcggtggcggtgatcgcgctgtacgtgaacgtggagtagctcagtccgtagccgaacgggaagcgtacgggcacgcccacggtctcgtaataacggtagccgacgaacaggccctcgcgatagatcgcgtcacgcccgatggccggataccagccggagctcgggcaatcctcgtattgcatcggccaggtttcggccaaatgtccggatgggttgacttcgccggtcagcgcgcgcacggtggcggaggcgccggcctggccggacaatcctacgtacagcatggcggcaacatcgttgaaccacggcaattccaccggggaaccggcgacgagcacgatcaccaccggtttgccggtcttcgccaacgccgttacgagatcgttctgcgcctgcggaatcgccatggtggagcggtcgaggccttcggattcgctgcgttcgtcgaggccaacgacggccaacaccacatccacggcgtccttcttggcgagcgcgacggcgtcgttcagcagcacctcatccggcttgccttggcggtcgtaaccctgctcgtagccggccagcacgagcccttcggtgtgcttgacctcgtcgaggatgttttcctccttggtggcgctcaccttggacgagccggagccctggtagcgcgcggtcgctgccatgtcgccgatgacggccacgcgggtgccctgcttgagcggcagcgtggcagcgtcgttcttcaacagcacgctggaatgttcggcgaccgttctggcgatattgtggtgcgctttcgcgatgtcgtccttgagcaggtcgttgcgtccgacgccgacgagtttggtcgcggcggcgattttggcgacttcggcggcgcgcttgttgatgtccgcttcggacagcgttcccgccttgaccgcgccttccagctcgcgcacggaagtgaagcccggcgacggcatttccagcgagccgccggccttgacggcggcgacggcggagttggagccgccccaatcggagacgaccatgccgtcgaagccccattcgtcgcgcaggatctcctgcagcagatgcttgttttcgtgggcgtagacgccgttgacctcgttgtaggaggtcatgatgctcatcggcttggcctcgcgcacggcgatttcaaaaccggtcagatacaattcgcgcatggtacgttcgtccaccacggagttgctggcctggcggcgcagctcctggctgttgaccgcgaaatgcttcgggcatgcggagacgccgttgctctggatgccgcgaatgaggccggcggccatacggccggcgacgatcggatcttccgaatagtactcgaagttgcgtccgcacagcgggttgcgtttgatgttcatgcccggtccaagcaacacgttcacgtcgagatcgtgagcttccttgccgagcgcctcgcccatctcttcggcgagcgccggatcccaggtgttggccacggtgcaggcggtcgggaagcaggtggccggcttggatgcgccgatgccgaggtggtcgccctcgccaagctgcctgcgcacgccgtgtgggccgtcgctcatgacgaagccgggaatgtcggcgcgatcgttgccgcgcgaatcccattcggatccgccggacagcatcgccgccttttcaacgatcgaaagatcttcaagttccatgggttctccctcgcactaggtgttgccaaaacctgctttgccgagcctgccctgtccgctccgcccggctgcgctgttttcttgcgatttcccgctgccgtaccgcgctgcatcgcaccgtgccgcacgcgggatttcgccgctagtttgattgaaccagcttttgcgatgccgtcaccgccgtattacacaacctgtcgttttactcgcacaatcggcatatgggcgcggtgaagagggtatgcggtggcgcagaacgcgcataaaatcgcatcgttccattttgcaatcgatggcaagcgtttcgatatgcgcatatcgttgcaatttcaagcgactcgccgatattgatacctttttgcgcaagcgctatcatacttaacgaaagtaagttttgctaacttttcttcaatgcggaaacatgctttgatcactcaacgcggagagcgatgtttcgcagcgcacagaaaggataatgagatgcgcgaccagcaaagcagcgacacgagcatcgccctggacgccaatacggacgtccagcatcgtcacgatgacccacaactacaatctcgtgttccccaccgccatcgtcatcgcactgtgcgctggcgcgtcggtcttgaccatcaagcgcatcaagtaattcaaacgggaccgtgccgccgcatatgatggcacggttccaatccagttatcccgattttttccacactcaaaggagccccacatggtagacagcacactgttctcgctggccacgctcaacgcccatccggcaatgaatccggattcagtgatccagggcgatcattggcgcatcggcctcatcacggacgcgctcgtccgtttcgaatggtccgacagcggccgtttcgtggatgacgccacgcagatggcgatggtccgtgatttcggcgaaaagcctgaattcaccgtcgccgaacgtaatggctggctggagatcgacaccccgtcgctgcatatctcctacaaccagcgcaagttctctccggaaggcctgtacgcaaccgtcaagcacgtcaacgccatcgaaaacacttggcattacggcgacgtgcagcgcaggaacctcggcggcacctaccgtacgctcgacgaggcgaacggccgcatccccgtcgatccgggcgtcaacagcaccgacggttgggcgatcatcgacgattccaagtcgaacgtcatccgcgaaaccgccgaagtgaacggcaaccacaacgatttcggcacgtgggtgaccccgaaggaagagccgaccaccgacctgtacctgttcggctacggccaccgctaccgtgaggccgtgcacgccctgtaccgcctgaccggcccgaccccgctgctgccgcgcttcgtgctgggcaactggtggagccgctaccaccgctataccgaaaccgagtaccgtcagctcgtcgaacgtttcgaaaaggaaggcatcccgttcaccacggccgtcatcgatatggactggcacctggttgacgacgtcgacccgaagtacggctccggctggaccggctacacgtggaacaaggacttcttcccggatccgaagcgctttctcaactggctgcacgagcatggcatgaaggccacgctcaacgtccacccgagggacggcgtgcgcgcgttcgaagagctgtatccgcaggtcgccaaggccatgaacatcgatccggaaagcggcgaggccgtgcagttcgacctgaccgatccgaagttcatggaggtctacttcgaccagctccaccacccgatggaggaagatggcgtcgacttctggtggattgactggcagcagggcggcctgacgcggcagccgggcctcgacccgctgtggggcctgaaccacctgcattacctcgattccgcccgcaacgacggcagcgactacagcgaacgcaacccgcgcccgctcaccttctcgcgttacgccggcccgggctcgcaccgctacccgatcggcttctccggcgacaccgtcgtgacgtgggagtcgctgaagttccagccggaattcaccgcctgcgcttccaacatcggctacggctggtggagccacgacatcggcggccacatgttcggctaccgtgacgaggagctggaggtccgctggtaccagctgggcgcgttcagcccgatcaaccgtctgcattccaccgattcgccgttcaacggcaaggagccgtggaacttccacggcgatgcggaacgtgcgatgacgtccgcgctgcgcctgcgccatgcgatgatcccgtacctgtacacgatgaaccgtcgcgccgcattcgacaacgagccgctcgtgcagccgctgtactgggactatccggaaatcgaagccgcatacaagctcaccgacgaattccgtttcggcaccgagctgctggtcgcgccgatcgtcgatccagccgagcgttccgtgcagcgtgcgaaggccgacgtgtggctgccgcagggcgaatggttcgatttcttcgacggtcgccattacacgtctcgtccggccgaaggccgccgtctggaggcttggcgcgatctcgaccgcatgccggtgttcgctaagcccggcgcaatcgtgccgctgcagatgcccgccgagggcgaggcgctcaactccgtggccaacccgcgcgcactgcaggtagtggtgttcccgggtgccgaaaacagcttcacgctgtgggaggatgacggcgcagcacagagcaaggatcgttgggcatccaccgaaatggcgctgcgttttgagggcgattccgcacagttctcgatcgcccctgcggaaggtgcgacggacgtcattccggcttcccgcgattggacggtcacgttccgtggcatcgctccggaagcgatgcacgccgtccgcgcgaccgtcgacggctctgccgccgctccggaagtcgcgtacgatgcggaaacgctgagcctgaccgtcacgctgcgtgacgtgccgacgagcgccgcaatcgccatcgatttcgccgacggtcttgccgttgcggacgatccggttgaagccgacgcgttcgccgtgatgaaggatgcgcagatgctgtacatgaccaaggagcacgcataccgcgcgatccgcgagctgggcaaggatgcgctgccggcactgagcacgctggaggatctgcacggcgttggcgcgcagaccaaataccagtcccacatgccgcagccggtcatccaggccctggccgaagtgctgacccgcaactgacctcatcgcaataattcaaaataaaacgcgtgtgcgtccggatggtttccgcccggacgcacacgcgttttgttttatgtacgaaattagtatgactcgacattccgcatagattggattggctacaatgtattagacattccgatgagggacgaatggcatgggattggaggccgacgatggccggcccgaaacatccccgccactacgacgaggcgttcaaacggcagatcgtgcagtcgggagccgaccatcattcgcggtgacatagaagccccgctccttcggctcttcgggtagcggcttttcctgttcagctggcttgtcgagttccttgagctggccgagcagattgtcggttttctcttcgtcgtgttccttgtatgcttcgatgaggtctgcgaggatttgttctcgttgttggaagatgttcatttcttgtccttcttctggttgagttctttgagtgttcgtccgatttcgcggcggaggttcatgaggtcggttttgttgagcatgtgttcctggtatccgtctgccatgtcgaatctgagtccgatgaggcagctgtggtcactgctgtgcgtgccgtccttgatgattcgcagttcgaatgattggctcatcgcatgttccctaggtcgtcgttgagcgtgtaggcgaagttgtcgagggtgctttcagggatgtccgcaaggacttcctcgccgtccgcgtggagctcgatgagttggccgctcttgtcttcctggatgcggatggcgtagccggtggtgccgatgagttcgattcttggtttcatggttttcctcgattccggtggcgccggcgggttaagcaactggctcatgttcggtttccttaggctttgaattgtttgatgctgtcaatcggctggatgaggagcatgagcagctgcatggagtccatgtcaaagaccggtgcggcttcttcgatttccttgatggtcatcgagatgcttccattgagcctttggtcgacggtcttgagggtgcatccccaagcgtttgcaaggtcggcacgtgtcttgtcgcgtctggcgagttcggctttgaggtttctgctggctgtttccgtcagaccggccattcatcctcctcgattccctgcttggtgaggcaggcgcgccagtcgtgccagccggggccgcgcatgtggccgcacgggtagtggtcgggggtcttggtcttttttacactcatcatgtctgcgttcctttcgatacttcacagtgtatttaattaactacatctatgtattcatttatacacatcttcacaaattgggcacaattgggtatttatttggctataatgatggatatgggacgaaaagcaaatgaaatgaccccactcgccacacagataatgaacgagtgcataaggatccagaaagccagcggcatgaccgtcgccgatttcgcgaaagcctgcggcttcagccgcgattactggtacaaacacgcgaatctcagccgccctctgacaatcggcgacctggaacgaatcagcaatgccagcggcatatcggcagaagacatcgtgacgaattcgaggcgtcatgcgattgaggaagcggaagcgaaggtgcggtctggcggctatggtcttgccgcctataacgctcatggcaagcaggaggcaatcaatggagaggctgggccggattacgacgagcctgcctgacctgccaataagccgcgacatgacctacggcgccatgcgccgcgccatcgtcggcctgcccgtcaccgtgtccagcgccatcctgccggacggactatggggctgctacgacgcctccacagacgtaatcctcatcgaccggcgactcacgtataccgcgaaaagatgcgtgctcacgcatgagctgctgcactggaagcatggtgacgatggttgttcgaacgatcgttcgaagcaggagcgacgggcgagaatgcagaccgccctcacgctcgtcaatcccaccgaactcgcactgctcgaacgcatgtacgacgatgacctatggtcgatagccgatgaactggacgtgaccatgcaggtgcttgcggactaccaagccacgctcaacacctcacctaacggacgaatcacctttagcgatatcaaagaaagggttttcaatgcgtaaaaaaatcattgccatcacagctgcgacgcttctcctggcgacggtctgtggatgcggaagacagcaggagccggattccacgacggccaagacgccggacgtcagcgcacagcaggcgaagccacaacaacaggaagccgagaagacggcgcagagctttgtggacgagttcaacgcgaactcatcgacgccgataaccgacgtcgagaaattcacgccgagcgattcggacggtccctattatcggacggagtatcgcaccggcgccttctccaccgcagacgctctccacgggagactgggccaatcgtcagtggacgtgctggtctacggggcagtgctcggatgcgggaagaacgacatggttcgcgtctacgtcgatgggccgcatgatgagatcgacagcgtattccccatcatggcgaagatgcttgatccgtcgatttccgatcaggacatccaaagtcagatggcgaaggagtatccgtccaatgatctgctttacgccgatacgcatgagctgatcgagagcgcttatgtcgatggcgatcatgcgtttctcgacgcgaaaatcagctagcggtttataagtctttataagtctttataaagcttatatttgcttcagacgctcgaatacctgtgccgtctgtgcggcatcgtcggcggccctatgacgctccgtcttggcgatgccgaagtagcggatgaggtctttgaggcgatggtggtccaattgcggcaggtatacctgtgagatttcgagtgtgtcgtagaagctgatgtcgggtattccagcgccgaccctctcggcttcgtgtttgattatggggatatcgaagcggtggatattgtggcctatccaagtatccttgccacagaaggcgtagaatctgggcaatgccttgtcgatggtcggctggtgccgcacgtcccggtctgtgatgccggttatctgcgtgaccttggccgggatcggaatctggggattgacgagctggctgtatgacgcgactttgcgtccgtgcctgattctcacagctcccaattcgatgattcgagcgcttctgcctaatccagtggtctcgatgtcgatggccacgtaatcgtcctccacgccactattcgcgttgacgtgggtgattggtgccgtttccactgttggagcgtctgaggtggcttccggcgatggctcagtcgcatttgtcgcttgatgcttatggcgcggctccggcttgaggaagagatgccagaagaaccatgcgaggaatgcgaggagcagaaccgtcatgatgcttgtggccagatcgtacttcggcgtggtgatggtgtcgtatatgccgtagatgccggagattgcgaacagcacggatagcacgaggtaaatcagtttcttcatttttccccttctttcttcttgcttcaagctaccgcagatggggattagacgtgccgattcttctatttcagcgcattggcgctgtatgaaagaatgaaaataatgttacatatgtatatatgtatatgtcatgtttgcaagttagtattttccgattgcaaggttaatatgtacccttgtttacaacacgccatacacacatgtttgcaagttagtatataatgtgtttcagaacaaaaaacctccgcagtgttaacggcaccgcggaggtaaaacatgaagcctcactcaaagacttccaaacccattgtaacgcatggcttggaggtcggaaatggaccgtgaaatgggataccgcaacatgctggcagtcgaagaactcgcaagccaaggaaaactcaccgtcacccacaagggcgcacgcagtttcgacttcgcgcaatacgccctgctcagccgcatggcatggctcaccgctgactggccgctggacaaggcagcaaaggagaagcacatgatgccgcgcacctacgcttccggctggctcaaaatcgctatcgattggggcatgacgctcccacagtcaatggatgagctcgtggcgatcggcaatgagccgcgcaatccgaagcgcgagcagctggcctacaaccgcatcggcaaaatcgccaagaagctcgaagccgcaggactcatcaaatgccttcgcaagggcaacgtgcagcgcaagaacaatgccgtctggcttctgaccatcggcactccagaggaaaacgctgaggtcgaagcatacgtgcgacagcacatgtacctctgattccgtgcccacattttgcccacgttttgtagagaaatgacgtgatttggagtgaattggagtgaaataggaaagcttgaaaaccgttggaaataaaaggaaaaccgccatttctggcggtttgaaaaagtgcctccagcgggactcgaacccgcaatccgaagaggtcgattttaagtcgactgcgtataccgatttcgccatggaggctttgcgccggccagaagaaaaagccgacgccaagctattatgccacgtcagcgcgcagcaagcaatctcttgccgtaatccagcacgatgccgtccaacagaccatgctcgctggccatgaaggagtcgatgcgctggccatgatcctcatatgcggcttcagacaccttggcaagcacacggttccacaccaatgcgccgccgccgaccacatcgacgcgtccgggatgaatagtcttgtaggtcagacgctcctcacgaggcatgtgcaggaaccggttgtcaacggcataggcatcttccagcgtgcagcgtgcgccgtccacggcggtgtggtcgtattccgtcaatcccatagccaatgcggtcatggtggtgaccgttccggacacgccgatgatggtgtgggtcttgccggcgggaacggtcttgaacgcctcgtcgatatgcgcgtcgatatccgcgaccgcctcggcgatctgcccctcggtcggcgggtcgtttttcagatgacgctccgtcatacggacagacccgatattcatggagaacgcggcctgcacctgcgtgctcggatgggtggcgccgtcgcctcccagcaccagttcggtggaacctccgcccaaatcgaccaccagatagggggcctcgacctcgcgatggacgatgctggtggcaccaaggaagcttaaatccgcttcctccgtgcctggaatgacttcgggacgcacgcccaagatcttctcgatgttgtcttcgaattcctcacggttctcggcatcacgggtggccgatgtggccacgaagcggatgccgtccacgggatgttcggcaagcacgccggcgaattctcgggcggcctcataggcgcgcgccaacgcctcgtcggcgaagcgatgggttttgtccacgtcctgaccgagacgaatcacccgcaggatgcgcggaacgatgtcttccacaccgtcctcgctcacacgcgagactttcagacgaatcgaattcgtgccgcaatcaataccggcaacggttaccgacttcattactcccaccttctactcttcgttttccactgcgcaacggcatacggccggatcgaactcatgtttgatggcggacagggccatatcaccgatggggttggcgccctcacccatcaccagcgtctgggccaacaacgcatgcaggcatttgacacgcaccggcatgccgccggcactggtgccttcgatgtgttcctcgctgtcttccaaggccaaagcgatttcatggcggaacgcgaggtacagttcgtgggcacgttcgtatccggcacgcagatcctcgttttcggccagcatatcgttgtattccttcatcttgccttcggcttcgatgtgggagatggccttcaccgcttcgggcccggtcagatagcaggtcgtcgggaacgggacaccgcctggaagcaacggccgggtgaccacagccaaaggccggccgcatacgcaacgggctccgacggcgaccatgccgcgcgggtaacgtccaagctgacgctccaccacggcgatatcatgttcggtggcgggttgggcaagcactttgtccgccaaacccttggcctgttcgataatcgtcatgtccatgtcactcctgtccgtcttccgacggctgctgaccgtcctgttgcgattggccagtctgttgttgactgtcctgtttgtcttcttcgccggcatgctgcgactgtttcgtcgagtcggccttcacgggatccgaccgatccgcctgcttgaaggaatatgcaagctccttataccacggcagggcggttttcggtgattcgtcgtatgtcgtcccttttttcggctcgctcttgccggtcaccgcttcgggatgctcgacacgaatcgcctgttcgccggggaagacgaatcccaaacgatccctggcctgggcggtgacatacgccttgtcatcccatcttgcgatatcgttctccagctcgcgtttctgcgcgaccaacgccgcttcctgttttttcagtccgttaagctctgccagattcaacgcataggtatggaatgtcgatgccaactggatggttcccaaagccacgatgaacaatgccacgaagaacgcgaccgggccggcgccgccgcgttgtgatggtttttttcgtgccttcgaactcatagcaacgaaaatacccgtcgcgttcgacttggaacacgacgggtatttctatgtcaacgcattcatgatgcgctggctacgctcactcggcgatgtacttcttgcaggccttgaaagcgctgtagccggcgtactgagcggtggagccgagctcctcctcaatctcgagcaggcggttgtacttggcgatacgctcgccacgagccggggcaccggtcttgatctggccggtgttctttgccacagccaggtcggagatggtggtgtccggggtctcgccggaacggtgggaaaccatggaggtgaagccgttcttggtggccagctcgatggcgtcgagggtctcggtgacggtgccgatctggttgagcttgaccagcagggagttggcggcgccgagcttgatgcccttggccagacgtgccgggttggtgaccagcaggtcgtcgccgacgaactgcaggcgatcgccgagcttggcggtgatggccgcccagtcgtcccagccttcttcctggaacggatcctcgatggagacgatcgggtactcgttgatgaggttctcgtagaagtcgagcatgtagccggcctcacggtcgtcgccttcgaagtggtacttgccggtctccttgttgtagaactcggaggaagccacatcgagggagatgccgatctgcttgcccggctcgtagccggcggcggagatggcgtccatgatgtagttcagggagtccttgttggacttcatcttcggagcgaagccgccctcgtcgccgaggccggtgttcaggccctgcttcttcaggacgttcttcagggtgtggtagacctcgacgccagcctgcagagcctcgctgtaggtgttgaagccgtacggggagatcatgtactcctggatgtcggtggcgaagtcagcgtgggcgccaccgttcatgatgttcatgttcgggaccggcaggatgtggccgttggtgccgccgatgtagcggtacagcggctgatccgcggactcggcggaagcgtacagagcggccagggacacgccgaggatggcgttggcgcccagacggcccttgttcggggtgccgtcgagctcgatcatggtctcatcgagagcgcgctgatcggaagcgtccatgccgatgaccttcggagcgatctcctcgttcacggccttgacggcgttgagcacacccttgccctggtaaacggacttgtcgccatcgcgacgctcccaagcctcggcttcgccggtggaagcaccggacggaacgaggcccaggccctgagcaccgtcatcggtgtcaagaacgacctcgacggtcgggttgccgcgggaatcgagaatctgacgcgcgtaaacgctttcaattactgccacaactactccttataaacgttaggttgtgatgacaatgccaagaatagtgcgatttatggacgtatgccaaactttgcccgcatgttccatgtgaacgctcacactcttttttgcatcccactgtcattgacgcggtgtcggtttccagtccaaatcgtcaagcaattgactggtccatccgaccacttcgtccgagctcatcggcttggaaccaagcgagcctgcgaatggagccggtaccagatacgtcttggtcaacggccggtactggatgcctttgtagattctggccatgcgcatctgcacggattcacgcggctcgaacttcgacacgcgcacgttgcgtccttgcgcgatgatctcggaaatgccgagcttgcgagccttgaaccgcaaccgcgccacgtcgaacagcgcctcgaaatcgacgggcggcttgccgtaacggtcggtgagttcgtcgcgcagctcgtcgagatcgtcttcggtgcgtgcggaggcgagtttctggtacgcttccaatcgcagtttgtccgaatcgatgtagtcgacgggaatggacgcctcgatcggcaggtcgatggtgacggcaaccgattccttgcgttccggctccttgtactgttcgaccgcttcggacaccatacgcacgtacaggtcgaagccgacgccttcgatatggccgctctgctcgtctcccagcaaattgccggtgccgcgcaattcgagatccttcatggctacgtcgaaaccagagccgagcgcggtgttctgcgcgatggtggcgagcctgtcatgcgattgctgggtcatcggcttggtcggatcgtacaggaagtacgcatacgcgcgctcacgtccacggccgacgcggccacgcagctgatgcaattggctcaagccgaagcggtcggcatggtcgacgatcagcgtgttggcgttggagatatcaaggccggtttcgatgatggtggtgcataccaacacgtcgatgtcgcgatgccagaagtcgcggatcacaccgtcaagctgtttctcccccatcttgccgtgggctatgccgacatgcgattcgggtacgagctcgtggattttcgccgcgacggaggagatgtcctgcacgcgattgtgcacgtagaacacctgcccaccacgcaacagctcgcgccggatggcggcggtgacctgcgcgtcctcgtaagcgccgacgtaggtgagcaccggcagacgatcctccggcggcgtggccagcgtggacatttcgcggataccggtgacagccatttccaacgtgcgcgggataggcgttgccgacaggctcagcacgtccacattggtgcgcaacgccttgagcgtctccttgtgctcgacgccgaaacgctgttcctcgtcgatgatgacgagtcccagatccttgaacttgatcttcggattgagcagcttgtgcgtgccgatgaccacatccacggaaccgtcttcaagccccttgatggtctcgttgatctccttggtggtctggaatcggctcatggcagccacgttcacggggaagccttcgaaacgttcggtgaaagtctcgaaatgctgttgcacgagcagtgtggtcggcacgagcacggccacctgcttggaatcctgcaccgccttgaacgcggcgcgcaccgcgatttcggttttgccaaagcccacatcgccgcagatcagacggtccatcggaatgggtttctccatatccgacttgacctcgtcgatggtggtgagctggtcggccgtctcctgataggggaaagcgtcctccagctccttctgccacggcgtgtccttgctgaaggcatagcctttcgtacgctggcgtgccgagtagagcttgaccagatcctcggcgatctcatgcacatgcttgcgtgccttggctttggtggcggcccagtcggaaccgcccagcttgttgagtttcggcgtttcggcgccgatgtatttgctgacctggtcgagctggtcggtggggatgaacagtttgtccgccggcgcgcctcgtttgctgggagcgtattcgatgaccaggtattctcgggtggtctggttctcgcctttgccgatggtacgttggcgcatctcgacgaaccggccgatgccatgctgttcgtgcacgacgtaatcgcccgttttgagttccatcaggtcgatggccttgcggcggcgtttcggcgttttcgcctgtcctgcggcggatgtgcggccggtcaggtcgcgttcggtgagcagggcgattttcgcggcgtcgtccacgaaaccgtcgatggcgcgcgatcggacgcaatcgaaattcgcgatgccggtttcgttgatcgcacgcttcagtcgggtgagtgtgccttgggccgcggccgtgatcgtcaccgcatagccggcgtcgagcagtccttcgatgccggaggccgctttgttttcgtcaccgcggtattcaccgggtttggtggcatcaagttggatgtggccttcccgggtggcgtcgacgccgaagctggtgagtttccacacgtcatgtttggagaagacgagtgcggagatggtttcctcgaaatcgtagaaattcgcctggtcgaaggtgatcggcgctccggcgccatgtccggatgcggcgacgtgccagcttgcggcaaggaattcgttggcggttttcgccagatcgtcggcggcgcgacgaagtttttccgggtcggacagcatgaccagcgcatgcttgggcagcatgccctgcaccggttccatatcgtcgaccagcgcgggcagcagcgattccatgccttccaccgggatggcgttggcgatggatccgagcatgtcctcggcgttgggaatggagccgatcagcgatttcgcacgttggcgaatctggtcggtcaactgcagttcacggcatggcgtggcccatacggtggaaatatccttaccgtaggtgcgctggtcggatgcgtggaattcacgtatggtgtcgatctcgtcgccgaagaattcgatacgcaccggatgcggcagagtgggcggaaaaacgtcgatgatgccaccgcggacggcgaattcgccacggtccatcaccaagtcgacgcgcgtgtacgcgttttccaccagtttgcgggatgcttcgtcaagaggcagttcctcgccttgggagaacacgagtggttcgacgtcccccaagcctgcgaccaccggttggatgagggagcgcaccggcatgaccagaatgcggatggggccgaacagcgtgctgccctcttcgggatgcttcagcctgcggaacaccgccatgcggcttgccacagtgtccgcgcgtggtgaaagccgttcatggggaagggtctcccatgcttcaagctgcgccacatcgtttgggtctccgtcataccaggaacggatggactccacggcttcctccgcttcgcggctggaggcgacgacgagcacgaccggctgtttgcccgcagcgccggctgcgagcgccgggcgtaggccgtccggcacaccgacggtgatgctggggtcgatgtctgattccggttcttcgatttccccggcgatgagcgcgcggaaatcgtcatcggtttccagcacgtcgaggatgccggcaagcgagcctgcggtcggcagttgcggtggttgcgccggagacgtcggttcagcggccattgaatcgctcctgggctttggcgagaccgtcgaagatgatggtttcggccgcgtcggcaccgtcggcgaggaattcggggagctgcttgcgttggtccggtccgaagccgcccagcacccagttcacggtgttgtcgtgcgcgtgggctccgcgttgggcgtggccgacgcccatgcgcacgcgcgcgtatttcggggtgccgagcgaacggtcgatggatttgatgccgttgtgcccgcctgcggagccgccggctttgactttgattctgccgaagtcgaggtccatgtcgtcgtggataaccacgatatggtccggttcgatctggtagtaggcgctgatggaggcgaccgcgttgccggattcgttcatgtaggtgagtggcttggcgaggaagaatttgacgttgcggccggataggttcatcacgcctttgccgagcatggcgagtcccttgtggtcggagaagttgacggaccagcgttcggccagcacgtcggcggtcatgaagcccatgttgtggcgggtgccctcatatttggagccggggttgcccagtcctgcgatcagccagaaatcagatgccataataatcgtccattcctctgtgttcttgcgtgctctcgtcttgtttaaccgcacagattctactgtcaggtgcttacaggtcgagatgccagtagctcatgtcgcgcatggttccggtggagtcggtggcggcttggggcatgagtccgaattgggtgaatccgaaatgtttcatcagtgcgatggatccgcggttgtcggcgaagatgatgccgcaggctttgcgcatgtggcggtttcggcattcgtcaagcagtttggccagtgtgaaggtgcccgctcccctgccctgccattcgggggcgatgtagtaggcgaggtcggtgacgccgtcgtagccggcgcggtcgtagaacacggacagcgcggagaagccgatgatccgttcgccgccttccgtggctgcatccgtggcaggcacggtggtgacgaacaccgcatatggatcgtggtgcgattccacccatgccttgcgttgcgcgtaggtacgtggcgtggtgtcggcggacgagccgccgcggatgactgccgcgttgtagatgtcggtgatcgcttggatatcgtcttgcgtcgcgatgcggaaagaatagtcggccatgcgcccagcatacccggcggcaaacgacaacaggggccggttcctttggaaggagccggcccctgcgtatttcatgaagggaattggacgggaatcactgttcgagttcgatggccttgttcagtgcttcctgaagctgcttctgagcgtcgccgtaggcggaccaatcgcccttcttcatggcggcatcggaatccttcatggcctgtgcggcatcgtcgagtgccttcttcaggtcggcgctcatcgtgccggacgaatcgccattattgccgccggtcttaccgtcggtattggatggcgtgtcctgcttgccgtcagtgttggtcttgccatcggcggaatcgtcgttcttagcatcctgcttgtcatcggtggtgtcgcccacgttttcggcgtcgcctgcggacgcgccggaatcgccgccgaacacctggtcgagagcctcgtccagcgtgtcggcgaagccgacctggtcgccgaatgcgacgagcaccttcttcagcagcgggaagctggtggagccggacgatttgacgtacaccggctgcacgtagaccaggcctccgccgagaggcagggtgagcaggttgccgcgctgcacattggtcgagccggattcgagcaggttgagttccttcgacacgtcggcggacgcgttgaagttgttctgcgcctggccggggcccggcacgttggaatccttcggcagttcctgcaatcgtatggtgccgtagctcgagccgattttgcctttctcgtggcccgcgtcggaatcgaccgacaggaagccggtcaggatttccctggtggacgagcctgcgggaatgtacgacgaggtcagcgagaacaccggttcgctggagccgccggtctgcagcgtcagatagtacggcggctgcaggatgtctcgctgttgcgcctgctgcgattcggtcgggtcgacgggggtctgccagaaatcctctccggagaagaactggttggcgctggacacgtggtatttggccagcagttcgcgctgcaccttgaacaggctttccggataacgcatgtggctcatcaggtcgccggagatttccgacagctggtggtactggccggggaagatcttctcccaggctttgatgaccgggtcggactggtcccatacatacaggtccacggaaccgtcgtatgcatccacggtggctttcacggaattgcggatgtagttggcgttcttcgagttcaggctgcttaccgtgtcggaggattccgtggtggagtccttggtggcctcgcccaagtcggtcatctgagagtatgggtaggcgtccgaagtggtgtagccgtccacgatccacttgacccgtccgtccaccacggccgggtatacgcggccgtcaagcgtcagatacggcgcgactttggccacacgttccttcggggaacggtcgtagagaatctgcgaattggagttcacacggttggagaacaggatctggtcggagccgaagcggatggcgtacagcagtctggagaagatgttgccgatcttcggaccgccatcgcccttgaaggtgttggtggcgccttccgaaccggtcggatagtcgaattcccaggatttggtgccttccggagcgcctacgatcgaatattcggtggcgttcggagagaagtagatgcgcggctcgtacttttcggaatcggtgagcttgccttgggtggggatgcccgcttcgaagaacttcggctggccgtcggcggtcaccttgttgccgtaggcggccacaacgccatagccgtgcgtgtacacggtgtggtcgttgacccagttgcggttgtcgagaccgtccagatcgagttcgcgcgcggcgatcaccgtgtcctggctgacgccgtcgacgtcgtatttgtcgaccgcgacggtgtcggcgaacgtgtagtactgcttggactgctgcagctgtttgaacgtcggggagatgatctgcgggtcgagcaggcggatctgagcggtggattccgcggaatcagccaatgcgccttcctcgccttcggtggtggccttgtactgttcggccttcaccttgtccaagccgtacgcggcgcgggtggcgtcgatgttgcgctggatataggtggattccatttcctgcgcgttcggattgacgcggaagcgctgcagcagcaccggccaggctacggtaagcaccaggctcaccacgatggcggaggcgatggccacggtcggcaccttccacgccttgagcgcttcggaagcacgtgccgcgatgggtgcggaaccttccaacgtatgggatttcataatccacaggcccagtatcacgccaaggatggcggtgatggcggccatgatgaacgtgacggggatggtggcgttcaccgtggtgtaggtggcaccggtgattctgctgccttcctcggtcaggtgcgagaacactcccagaacctgattggcggcccaggcgaacatgttgagcatcagccagatgccgatctggcggcgggcgcgtttggtgatgcggaacaggccatggccgttcaccggcatggtgatgcggatgccgcccataagcacgtgggtgacgatggagaagatgatgccagcgagcagcaacagcgagacagcggacatgatgagtttcagtccgggcagcacgaacacgtagaagccgttgtcgatgccgaactgcggatccttggtgccgaagctttgcgagttgaacatgagcaggatttcggaccagttcgcgttgaaccgggagccgaacaccagtccgacaatcagggagatgaccacggcgatgcgtcgagcgctcttggagctcacgctcttgccgatttcgatggtgtcgccgttcacgcggatggtggagccgtccgcagcgtcgggacgcgcccatatcgccagcgtggcggagatgaagccgactgcggcgatgagcaccgcgtacgccagccagaggccgaccctggtgcccagctgcgtccaaatcacgctttggaagccgagctggctgtaccacatgacatcggtgacgaactgcgcgagcgcgaagaacagtccgatgacgatggcgagcgccagcaccacgccgatgaagatcttgctgccgttcgacggtttgcgcggacggttcggcttgctggtgatgcgggggcccgaaggtcgtttcgggggaacgttcgacgatggttgcggaccgtcccctccgtcggtttcgacgttgaggatgatcggatcgtcgttgctgggtttgcgcggattctgcctgccggcacggttcgagccgccttcgggatcgaacatgggaccaaacatatcaaagaaagacatgctaatagcctagcgacaggcgaggaacgccgttaagccgccagccgaacggatctggccgtgggctgaatcggctgttccgtggcatgtccgtatgaagagaacatatggggaatgccggcatgccataatggcggtatgaagaaggctcatgggtttttcacacgattggtggccgcctgctgcgtggcgatgctgccggtcacgttggccgcatgttccggcgacgcttccccatcggacgccgccaccgcagctttttccactcgccggccgacggtcacgcatgattccctcgacaaggcgcaagtgccgtccgtccgcgacgattcgccgcatgccaaggcggtgcgggccgtggagtccatgagtgtcgaggaacgggtcgggcagctggttatggcgccattgttcgctggttccgatccgtcatcgttgtatgacctcatcgcgaacaggcatgttggttcggtcttgatcatcggcaactggaattcggggaccgccggggtcgcggccgccacatccacgctgcaatcgtatgctccgggcgacaaccagctgttgatgtccaccgatcaggagggtggtctggtccagcatctcaagggggccgggttcgataccatgccttcggccacccagcagggcgcaatggatgtcagccagttgaggcaatcggcatccgcatggggcacgcagctcaaggctgccggcatcaatgtcgatctggcgcccgtcgtcggcacggtgaccgtggaccgttcgtcgaacgccccgattggcgcgctgtaccgtgatttcggtcttgatccggccggcaatgcggaccatgcgaaggcgttcatacagggcatgtccgattcgggggtaggcagcgccatcaaacattatccgggtttgggatcggtgaccggcaataccgatttcaccgcgaacggcatcctcgacaccaccaccacgttggatggtccggaaatcagcgcgttcaacggcacgttggaggcaagcccttcgatggtgatgatgtctttggccacatatcaggcgatcgatccgaataatccggccgtgttctcatcaacgctggtcaccggctatctgcgcgggaaaatcggcttccaaggcgtcgtcacttccgattccctgtccgcaacggctttgagtggcgtgcagccgagtgatttgggtgtgcggctggtcgaagccggcggcgatttggcatgtatcggcgcctcttcctacgtgcagccggtgttggacggattgaacgccaaagcggccggcgatgcgacgttcgcgcggaaggtgcagcaatccgccattcgtgtgatgacgctcaaatacgagatggggctcgccaggtaatcgcaatgccaagcacaggcggaagccgtcttacgagaaaaccagctgtaccagcagcatatagacggcggtgccgccggcgatcgacagcagcatgttccttttccatatgtgcagcagggcgattgcgataatcgccaacaattcgggaatgccgtggctgcctgacgtcaggcgcactcctttgagcgagtacacgacgagcaggcctgtcatggcatacggcaggacggtgcccaggtaggtgatgaaacgcggcggttccttcgattcggggaacagcaggaatggcaggaaacgtgtcagcatggtgccgagcatcgccatgatgatggtgatgacgccttgccacgtggtcatgatcatcatgcgttcgtctccttgtccgcgttgttcgtttcgttctccccgtccgtcttgtcgatcttcaggtcgtccaggtatggccgcagcagaatgaacatgacgagcatggcgaccagggatgggatcatgaaattgtcggcgccgaacacccccagacagatcgcgggcaccgctatgccggtaagcgcggccatgtggcttttgcgtttcgtggtcagccattgatccacgaaaatgacggcgaacatggcggtcatgatgaagtcgagaccggaggtgttgaaggtgatgcgttctccgagaaggccgccaagcgtggcgccggccacccatgatgactggttgagcaggccgacgaagaagtagaaccatccgcgatcgacgtcggccgcaatgatggtgccgttgtcgatggcgaaggtctcgtcgcacaacgagaaaatgagatacggcttcttggcgcccatgttcttgaaccggccgagcatggagatgccgtagaacagatgacgggtgccgagcatgacggccagcatgaacgtgacgaacgggttgaacgcggacaccagcagattcacggtgacgaattccatggaaccggtgaagatgaacgcgctcatgcacatgggccacaggaacgaaaagccgcgcgtgcccatcagcacgccgtacgacaacgccagaaggaaaaagctgatgcagaccggcgacgtccgcggcaatgccgttctgaacgccttgcccatgacggcgttcctgttctgcgtccgcaccattaaatatcagcccttcttccgtccgttcccatgcttctcttctcatgccttctcttgccgcgccctgatataccccgacgcgccacaacgacggccaacatactatcgccgaccccgacaaaccatgcgcaaccgtatcggcgcgtggacatcgacggattacgtacaaagcatgcgcgacgagattatcatgctgcatactggaacgtaacgaaaaacctttggacaaggagcatgaatgaagacactggtactggtgttccacccgcatctggaaaaatcgcaggtcaaccgcaagctcatggacgcggccaacgagaccggcgacgtgaccgtggtggacgagtacgccgcatatcccgacttcaaaatcaacgtcgaacatgagcaggagctcatcgaaacgcatgaccgcatcgtgctgcagttcccgttctactggtacagctcccccgcgctgctcaagcagtgggaggatgacgtgatcaaggccggctgggcctacggcggcgggcgggcgctcgaaggcaaggagttcatgttggccgtgtccaccggctctccggcggactcctacacgcgtgaaggcagccatgtgcgcaccatggaggagctgctttccccgttcgagaccacgttccgtcatacgcatgccacatatctgaagccgttcctcatccaaggcgtcgccacgtccaccgatgagcagatcgacgccgccgtggcgaagtatccggcagcgctgatcggctgattcctctgcctgtttcggcgcgcatttcccgattttccgcagggagccgtgttcgttccagacgaacgtggctccctgtttgacttcaagtacttgaagttcctattctcttccaacagagcatgaaggagcatacggtgaataacactccagatacatttacatccgctgcggagcaggacatgtccgaaacccgccaggcgttcctcaccggcgagcgcgcggagttcttcgcgcatgaccgccggtacgtcgatacgattttcgacgatggcgaatcgccgttgaagcatgcccatgacatcgaactgaggtcgagctcgttcaaatggaagtatccgctgtggtattgctcggatatcgatgcgaaggactgcacgtggtttgagatggcacgtgcgggcgtatggtacacggaccatatcaaggtggaggattcgacgatcgaggcgccgaagaatttccgccgctgccatgacgtgacgttacgcaacgtggatttcgtcaacgccgaggagacgttgtgggcctgttccggcgtgacgttggacaatgtgagcgcgcatggcgactatctggcgatgaattgcgcggatgtgaaagccgacaacctacgtttggtgggcaattatccgttcgatggcgcaaggaacgtggagatttccaattcccgtctgatttcgaaggattgtttctggaactgcgagaacgtgacggtgcgcgattcgttcatttccggcgagtatctggcgtggaactcgcgtaacgtgacgttcgagcattgcacgatcgaaagcctgcagggcctgtgctacgtggaccatctggtgttgcgtgactgccggctcgtcaatacgacgctcgcgttcgaatattcctccgtcgatgccgacgtgcgcggcacgatcgacagcgtgttcaatccttcgtccggcacgattcgcgccgaccatatcaacgagatgacgctcgatccggcgaaaatcgatccgacggccacgacgatcgtgacagccgacgccgcataacagtaggtaggattggcggtatgacttacgatttcgatactccgatcgaccgttccggcacgtactcgctcaaatgggaggaggctggcgacgcgctgcccatgtgggtggcggatatggatttccagaccgcgcccgtaatccgcgaggcgttgcgtcggcgcgtcgagcatggcgttttcggctattcgatcgtgccgccagaatggaatcaggcgtacgtggattggtggggacgccgtcatgggcttgccatcgacccggactcgctggtgttctgcaccggtgtggtgccggcgatctccagcatggtcaggaaactcaccacgccgaacgagaacgtcgtgatcatgacgccggtctacaacatcttcttcaattcgattctcaacaatggctgccgtgtgcttgaatcgccgctcgcctatgacggcgaaggacattacgagatcgattgggctgatttcgaaacgaaactcgccgacccgcagaccacgctgatgattctgtgcaacccgcataatccgatcgaccgtatttgggattgtgagactttggaacgtatcggcgaactgtgctggaagcatcatgtgacggtggtcagcgatgagatccactgcgatctgaccgatccgggtttcgattacgtgccgttcgcctcggtgggcgagcattgcgcgatgaattcggtgacctgcatggctccgaccaaaacgttcaacatcgcaggactgaattccgcggccgtgatgattccgaatccggtgctgcgtcataaggtgtggcgagctttgaacaccgatgaggtggcggagccgaacgccttcgccatggacgccaccctggccgcgttcaacgagggcgaaccgtggctgaacgaactgcgcgcttatctggccggcaacaaggcgaccgcgcgtgcgatgttcgacaaatacaacgcttcggtgccggccgaccggcgcatcatcatggtcgaaggacatgccacctacctgttgtgggtcgactgttcggccatcacgcatgacacggatgcgttgtgcgattatctcaaacgcgagcataaggtgatgttctccgagggttccgaatatggtggcaacggtcatgatttcgtgcgtatcaacgtggcttgtccgcgtgcacgcatgatcgagggtcttgcacggttcatcgacggtctgctcgcgtatcgagcacaatcgtttccaaagatggaccgataaacccttggactgacgcatgacggatgcggcaacggcctcttcaaggaccatgaaaggacgcaacatggtggtggtgtttttctcccgcgccggcgaaaactacgaagtgggcgaggtgacggtcggcaataccgcgaagcttgcccaagaggtggcccggcggaccgattcgccgatgattgaaatcacacgtaccgagccttatccggaacggtacgccgcgacctcagaaatggtgcaggaggagcagcgtgtcaacgcgcgtccgctgctcacgctcagcggcgatgtcgatgcgctcgattcgtccgataccgtgttccttggctatccgatttggtgcggcgatatgccgatgcccatgtacgcttttctggaaagccgcgactggtccggcaaaaccatttatccgttctgcacgcacggcggcagcgggcttggacggactccggaacgtatcaccgcaatcaccaagacgacggtgaagccggggcttgcggtcatggggaccgacgcacagaacaacgcaagtaaagccgccgaagccgtcagcgggtggatcgccaaatccggtctatagattcgcaatccacatccgtccgttccgtctgcttcagcacgccttcgagttggagcagacggattttggtttcaatgcctcccgcataaccggtgagactgccgtcagcgccgacgacccgatggcagggcacgataagcgcgatcggattgtggtgcaccgctcccccgatggcgcgtgcggataccctacgcccgtccgcacgtttcaactccaatcgacgtgcgagtccgccgtatgaaaccgtttcgccgtatggcactttccgcagcaatgcccatgcttccttgcggaacggcgtgccttccagccgcaacggcacttcggtccgaggtatgcaacctgcaaagtattcctccagccatcgtttcgcggcgccaatcgtcggcgaatcacccaaaaccgcggaatcatcgtccgcatagcctggctgccaatcgaaccacaggccgagcaatgccgtttcgtcggcgatcagcgtgatgccgccaagcggcgaatcgtaatgcgacttctttttcaccgccgttatccacctttccacaaaacacctatctcgcctatgaatggcggatttcgtctttcgacacatgttatctcgcttatagatggcggacggcaaagtgaaaagccgcgctttttacccccatacgctatctcagggggtctaaatcgaaaaacatccgccatctatagtggagatagcatcaggcagacccgcaaatccgccattcataggcgagataggaccaaaacgaaggagttggcatgggatacgcactcatcacgggagcgtccggcggcatcggacgcgaactggcggcgctgttcgcagcggacggacatgacctggcgatcaccgcccgcagccaggaacggcttgacatggtaaaaaccaagctcgagcagcgttttggcgtgcatgtggtgacgttcgccatagatctgagcgaagcaaatgcgccgaagaaactccatgatttcaccacatcacaaggtattgcggtcgaccatctcgttaataacgcaggcttcgctgactggacggattttctcgacgccgactggaaccggcaaaatgagatgatgcagctcaacatgcatgcgctcgctgagttgacgtatcggtatggccgagacatgcgcgccaacgggcatggcaggattttgaatatttcgtccgtcgcctcgatgatggcaggcccatacatggcgatgtatttcgcgtcgaaggcgttcgtgcgttcgctatccgaggcagtggcccacgaattgcgcggcacgggcgtgacggtgacctgcgtatgtcccggtccgaccacgaccggctttcagaaggctgcgaatatgagtggccgcaacttcttcaccatgaccaaaccggccaccgcacgtcagcttgccacgtacgcctaccgcaggatgatgcgcggctcaaccctcgcctaccatggtccgctcaccaaggcgggcgcgctcgcggaacgggttcttccccgcgctttgacccggcgaatcgccgcgttcatggacggcggcaagccgcacacgctcaaggtttaacggcgaatcgcttggacggacggtagcagagcagagcgatgccgatgagtacggcggttgcggcgaggctgatcgggtagacgatcatgatggcctcgaacgtgcgatgcgcggggaacgcgaacgcgatccaggtgatgcgcacgccgaccacgccgattacggtgagcagcgccggcaccagtgagatgccgaagccgcgcagatatccggacatgacctcgtacagcatgctgaacgtgtaggcggagaacaccatgacgagtctggtgtagccgacggaaatgacctccggtgtcgcatcgaacaacgccagcagactatggccgaagaacagcacgacggcgatggtgaccgcggtggcgatgaaatcctccagaatgcagatgccaagcacgcgcttgcagcgtccgatccgtttggctccatagttttgcccggtgaaggtggcgcaggcctggctgaacgagttgagcacgtagtaggcgatgatttcgatgttgaacgcggcgctggaggcggccatgacaacggtgccgagactgttgatggcggcttggatgatgatgttggccacggcgaacaccgcgctttgcacgccggcgggcagtccgatgcgcagaatctgacgcagggtaaaccagtcgatgccgaactcgcgcaaatcaacatggatggctgcgtcagtatgaaccagtcgatacagcagaatcatggagctgacgacgttcgcgatgactgtggccgtcgcgacgcccgaaacaccccaatggaacagtacgacgaaaatcagtcccatggtcacgttgagcacgccggaaatggcgagtacggcgagcggagcctgggtgtcgccgatgctgcggaagatggctgtttcgaaattgtatagcaggatgacgggcatgccgatgaggtagatgcgcaggtatgcgagcgccagggggaacacgtcggcggtcacgttgagcatgccgagaagcggtccggcgagcaattctccgatgatggcgacgatcacgccgccgatcagggcggtgacgatggacgtgtgcacggcgttgcgcaccgcttcgcggctgcctcgtccgatggcgttggcgatgacgacgttcgcgccgagagcgatgccgatgaacaggttgaggatgagtccggtgacgggcgcgttggagccgacggccgcgaccgcggcggtgccgtcggattgggagaagttgccgacgatcatgatgccggatgcgttgaagagttgttccagaatgccggtcgccgccacggggagcgcgaatcgcaggactttcgtccatatgcgcccgtgcagcatgtctatgccctgcttgttgtgcaccatgttttgcctccgccagccgcagccggctcgtcgttcgcttccgaaggcattgtagtggcggcaccaaacgagggaaccgccatgccgttttgtaggatgctctaaaaaagggcaatgacgttttcgaattccctttggtggcgagtggagcccgcgcgttagtatgaaaggcatgagtgaaaccgtttcaaccgcatccaacgcggccgacgcatggacgaatccgctgcgcgacccgcgcgatctgagacttccccgcatcgcaggcccatgcagcatcgtgattttcggcgtgaccggcgatctgtcccgtaagaagctgctccccgccatctacgatctggccaaccgtggcttgttgccgccaagcttcggtctgacaggcttcgcacgccgcgactggaccgaggaccatttcaaggacttcgtcaaggagaacgtgcaggcgcattgccgtacgccgttcaaggaatcgacttggaagcagcttgcggccggtatccgtttcgtacaaggcacgttcgatgatccgaaagcgttcgagcgtctgtccgacacggtcgccgagcttgaccgcgaccgtggcacgcgcggcaatcacgcgttctacatgtcggtgccgccgcgcgcgttcccgcaggtgtcccgtcagctggccgactgtggtctggcgaaaagcgacaagggcgcttggcgtcgtgtgatcatcgaaaagccgttcggtcatgacctggccagcgccaaggagctcgatcgcgtggtctccgaagtgttcgacccgtcgagcgtgttccgcatcgaccattatcttggcaaggagaccgtgcagaacatgctggcgttgcgtttcgcgaacgccatgtacgagccgatctggaacaacaattacgtcgaccatgtgcagatcaccatggccgaggacatcggcgtggccgggcgcgccggatactacgacggcatcggcgccgcacgcgacatcatccagaaccatctgctgcagcttatggcgttgaccgccatggaggagcccgtctccttctccgccgccgatctgaccgccgagaagaccaaggtgctctccgccgtgcgcctgcccaaggatctggccgcgcacaccgcgcgaggccagtacgccgccggatggcagggatcgcacgaggtggtcggctacttggacgagaagggcatcgatcccgaatccaccaccgagacctatgccgcgatccgcctggacgtcgacacccgccgttgggccggcgtgccgttctatctgcgtaccggcaagcgcctgggcaagcgcgtcacggagatcgccgtggtgttcaaacgcgccccgcatctgccgttcgaatcgaccgccaccaaggagctcggcaagaacgccgtcgtgatccgcgtgcagcccgacgagggcgtgaccatgcgcttcggcgcgaaggtgccgggcggcacgtcgatggaggtgcgcgacgtgtcgatggacttcggctacggtcgctcgttcaccgaatcctcccctgaggcatacgaacgcctgatcctcgacgtgctgctgggcgacccgccgctgttccccaccaccgaggaggtcaacctttcgtggaagatcctcgacccgatcgaggagttctggtcgacgctcggccagccgcagccgtatcgttccggcacgtgggggccggaggaggccgttgaaatgctcgcccgcgatggacaccgttggaggatgccgtgatcattaccctgcaagacaccgagacccgcgagatctcggcgaaaatcgacgaactgcacgaggagcgcggcgaggcggccctgggccgtgtgctcaccctgctcatctccaccaacgaggccgagctcgagcatgatctcgaagtcgccaacaatgcgagccgcgagcatccctgccgtgtgatcgcggtcgccccgagcagccgcaagatcagcccggaagaggagcatcccaccttccttgacgccgagatccgcttcggctccgacgccggtgcgggcgagatcatcgtgcttcgtccgcgcggcggtctggtccgtcacgccgacaccctggtgatcccgctgctcgtgcctgacgctcccgtggtggcatggtggccgaacgaggcgcccgcgaatctgtcgaaggacctgctcggctccatggccagcagccgcatcaccgacgcgatgcactcctcgaacccgcggcgcacgatggacgatctgcgccgcaaccgctccgccaaggacgtggacatgtcgtggacacgcctgaccgtatggcgtgcgatgatcgcctcgatgctcgaccagccgccgcacctgccggtgagcaatgtgcgcgtgaccgggcagaaggattatctgccgttggatctgctggccgcatggctgcgactgcgcctgaacgtgccggtgatgatcgaggaggatccgaacgccacggccgtcaccggcgtgtacctgacgcgcggcgacggcgtgctgagcctggagcgcccctccaccgacgacgggttcgccgtgatcagtgtgcccggccagtcgccgcagaccatcagcgtgcccgcgcgcacgcttgaggaatgcctgagcgaggagcttggccgcctctaccccgatgagatctacagcgaggtcgtctcgcaaggactagatctcgtcaagcccaggcagtagccaccgagcgtcgaaccataatacaaggagtgaacgtgacagaacgtaaaaccgtcgtataccccaatccgcaggtactggcggaggctgtggccgcgcgcacgctgctgaccatcatcgatctgctggccgagccgaatcgtaaacgtgtggatatcgccgtgaccggcggcaccgacggtaaccgtgtgttcgccgcgatgaacgccagcccgctgaacgatgccgtggactggagccgtgtgcacgtgtggtggggcgacgagcgcttcgtggcggccgatgacgacgaccgcaacgcgaagcaggctcgcgaggcctggtacggtgcgcttgtggaaagcgggcgcatgccggcggcgaacatccatgcgatgccggccgatacccgcggcgccgaggagatcgccgccgcctcccccgaacagaccgatgcggtgctggccgaggccgccgcggagtaccagcgcgagctcatcgagcagttgggcgagaatccggcattggatatcgcgatgttcggcatggggccggacgcgcatttcgcgtccctgttccccgaccacggcgaggccgagatcgacgacccgcacgtgctggtcgcaggcgtgcgcgattcgccgaaaccgccgccgctgcgcctgacattgaccgtgccgatgatcgcccggtcgaagcatacgtgggtgttcacctccgaagagcgtaaggccggcgcggtcaaggccgccttcgcccagcgcaacaacccgcatgccccaagctcctacgccgatggcgaggaactgctctggctcattgacgagggtgccgcttccaagttgtgaggttcatccgaaacaggtaacagggggtgtcccgcgactcatgccgtgagacacccctttttttgagtgttgattgattgttgagtgtcgttttgacgcaggttcccgctggactgcagcttcgtaggcggtttcgcgtttccgtaggcggttgccccaagtatcggggtcatggaaaaggccggtttccggccttttccgcagcaggctcccaagaccaaccacctatggaacgcaaaaaccacctacggaatcccaatccgccgcctatttcgccccatagcttccgaaaacctctcggaaggaggttagacgatggcattagactcccctagaaacgcaaatgggatgcatcacaaccacaagtaccattcgttctgcttacggagcgacactatgctccgtcaatgcaacggtacggcaatatcgcagctcagtaatatgcatatgccagaggtcttgcaatggaacacatcgcaagacctctggcatatccgccctgacacagaggcaaggaaaagatcaggcttcgatctcttcgcggcccggctcggcccacagggtgtggaacgcgcccggctggtccacgcgctggtaggtgtgggcgccgaagtagtcgcgctggccctggatgagggcggccggcagacgcttggaacgcaggccgtcgaagtaggacagcgacgaggcgaacgccggggtcggcagaccgttgatggcggcctgggcgaccacgttgcgccaggacttctcggcgttttcgatggcgttcttgaagtacggggcgaacagcagtgacacgttggcctcgccggattcgaacgcttcggaaatgcggttgaggaacttcgcgcggatgatgcagccgccacgccagatgcgtgccacggcggcgaggtcgatgtcccagccgtattccttggcggcggtggtgatctcgttgaagccctgtgcgtaggcgacgatcttggaagcgtagagggcctgacggatgtcttcgatgaaggccttcttctcgtcgtcgttcaggttgagcttgccgtcggggccggcgaagccctgcttctgggcttcctcacgcaggtcggcttcggaggacaggccgcgggcgaacacggcttcggcgatgccggtgaccggcacggcgagggacagtgcggtctgcacggtccaggtgccggtgcccttcatgccggcgtggtcgacgatgaggtcgacgagcggcttgccggtcttcttgtcgacctggtgcagcacttcggcggtgatttcaatgaggtaggagtcgagttcggtcttgttccactcctcgaacacgtcgccgatctcggccggggtcatgcccaggccgcggcgcatgaggtcgtagctttcggcaatgagctgcatgtcggagtattcgatgccgttgtgcaccatcttgacgaagtggccggcaccgttgagtccgatgtgggtgacgcacggttcgccttcggccttggccgcgatggattcgaagatcggcttgagggtcttccaggattcctcggaaccacccggcatcatggacggaccaagcagggcgccttcctcgccaccggacacgccgcagccgacgaagtgcaggccgcgggcgctgatttccttttcgcggcggatggtgtccgggaagtaggcgttgccggcgtcgacgatgatgtcacccggctccatcaggtcggcgagcgcgttgatcatggcgtcggtcggctcaccggccttgaccatgatgatggcggtgcgcggcttgacgaggctgtccacgaattcctcaagcgtcttcgccggatagaactcgccttcgccgccatgctcgttcatgagcttttcggtacgggcgtaggtgcggttgaacacggccaccttgttgccgtggtgagcgagattgcgtgcgaggctgccgcccatggcagccagaccgacgacgccgacgtttgcttcagctgacatactgttccctttcatggagaaacgtagtactttttatgaaccttccccagtgtagccccgagcgcacccaaagcgacggcccatctcagggatgacgggccgtcaaccggtcgcatggtttcagttcgttttcgtaggcacgatggtgcgtacgaatcgcatggcttcggctggggtgagcgacggcacgtaggcctgcgcgacggcaagcgagatctgcggcagtttcgccggatccggatagcagatgtacactttggcttcatccggatggaacttgagtttgaagcggaacagggagtggaatccgtaagccggttccatgatgtcggccaccatctgcagcacgtggtcgagtacggcgctctccccctgttcgtggccttcgccgctcatgccggcaagtggcgccgcggacaggctcatgaatcgcacttcgccttcgtcgcgcagccgttcggccatgcgggcgatgaggaattccatgatgccgttgacgctgtcggtacggtgacgcatgaagtcgagcgtccatccgaccactttgccgttctcataggtcggcagccagctggtgacgcccagcaccttaccgtccgtgtccaccgcgtacagcagtttgacgcgtggatcgaccagctcgtccacaccacccagggtgaagcccatttcaggcagggccttctcgccggcccattgcgtggagatctcacggatctgcgtctgcacggagaacggcgattccttgaatgtggcgagcacgtcggtgatgccgtcgcgcttggctttgttgatggcggtgcgtacgtcctgccatttcttgccgcgcgtctgccatgcggccgggtcgatcaccatttcggtgccgacgtcgagcgcgttccaaccggcggagaccaactcgtcacgttgttcggcgtgcacgctgtagaacaccggtgtcagggaacgttgggtgcagaagtcggcgaacgcatgcagatcgtcctcatattcgtctgggtcgccgaaaggtccggtgacggtcaacgcgatgccgtacgacacgcggtaggcgatggcggaacggccggtggcggagaaccagtaatcgttgcctttccaagtggccatgaacgacatggattcgccgccgagtccgatgatctcgtccacgcggtgacggtacgcgtcgttgatcatggaacggtcacgcaggccaccccatgtgcagcacagcgcgaccagccaaaacatcggtccgacgtactggtagacgatttcggaaagcagtccgaccggcacgaacgccggttccacgccacttagcaggccaatcggcagcaaacgctgcacgtagtctgcgatcagatcgaccagcagcggcgtttcgttgaagccggacggcatggacaggccgtagccgacgtacagcaatcccagtaatacgaatgcggcgaacgtgatggcgataccgcgcagcacggtctcgcttttcgtgcgaatggtgaaacatgcgcggaacaggatgatgatgacgatgcacagcagcggcaacgccatcgtggccagcatcgcgtggaatgcgccgtgccgttgcaatgcggatatcgcatccatgtatgcaccggcgtcggagccgtccacgtaggacagcggaatagccacatagaacaccgtcgatagcgcaatggtgcatgcgttgaacacgatgctgagcgtggctgcgagatgacggcctcgatacagaccccaggcgatgagcagcagcatcagcgtcggcatgatggataccagccagttgccgggcatggtgaaacgcatcatgcggtattgcgtgaagcagtccgtatgcgaggcgccgctgaggcagtcgaccacatgtccggtgtcgaagtcggtggagccggtcaacagtccgaacatggacagcaggccgaacgattggcgtgacgagacggcgacgagcgagccgatggcctgcacgcccgcgacgatgccgataagccgacgcatttcgtagatggcgccatgccggtattcgtcgccatgcgtgcaggaggccatcagatagccgagcacgtggccaatcaccgaagtggcaagcaggcagtagtcgctcacctcgcctcggtagaggaacatgatgagcacgaccgcatagccgatcacgcggatacggcggcgccacagcatggttgtgaacgcgctgacgcacataagggtgccggcgacgagaatcagcggaccaaggatggcgccatcatgcgagatcgcatgccattgggggctgcgcccgtcggatagggagcacagtcccatgcccaaggccacgccacccagtgtggtgatgacggacacccatgcggttttgattttgccgatcaccgattcggccaggccgaacgcaaccagcatgagcggaacgtcgatgagcagacggcccagattcggcacgtacagcatggatatcggcgcggtgtaccagcggccgcgtgcgagcgcttcgaaacttactttggccaggctcggcgggaacggctgacgtatgagcgcgcacacgatctgcgtgcccacgttgatgaggatgacgaacagcacgaggcagacggtgagcaggtgtcgtctgatccatccggccagatcggcgagcagcgcgcggaagccgaacagtggtttcgcgggtgatgcctcggctggtttagcaggcgcggtttgcgtttgagtcatttctttccttttctgggattctcaggcttgcgggtttgtgttcaggatcgtcatatcgtgatgcgtttgagattcggatagtcggataagttcgggttcgcaccatccagtccggtgtcgtggccgaatacggcgagcccgtaacgcagcacgtcctgcacggcgtgccagtcgtgtgcgttgccggacgattcgacggcggcgacgcgcatgccggctttcgccgcgaccggcgcgattgttttgacgttgcgtattgaggtggtgtccttctcccccgcgcctatgatgagcatctgatgggtgggcgtgtggttgcggatggcgttgaccggcacttggttctcataggctgtggtgtcgccgtcgaagaaccggtcgatcatttcctgtcggctgccgttggtcggtttgatttcgctgtcggtgggaatcatggtgccaaacaggtcgggatggttcacgccgatctgcagcgaacatgtggcgccttgcgagaatccggcgatggcccaatccttggcatcctgtgcggcgggcaggttggttttcacccagtcgaccacgtcctgcgtcaggtaggtcagcgcattgccgtacaccttcgaatccacgcatagcgtgttgtgcgaatcggcgccaagctgatcggctgcgatgacgattggggcgagtccgtcgtgggttttcgcatatccgtccatcatggtttggatgccgccggcttggaagacgcgtcccggactgcccggctgcccgctcagcatgaggacgaccggcagggccggcttgcgtttcgagtcggccaatgccgccggaggcaggtagacgagggctttgcgtgcttcaaactgcgatttcgtggccggaatgtcgattttgttgacggttccgttcgccggaatattgcggatcgtgccgttggcggcctgtttgcgccactgtgcgacggtgatgaggtccttgcgtttggccagtccggtcagatcagcttggctgtaggaatcctcgccgaacagcgagccgatggtggcgtattcgccgtacgattggtcgatgccgatcgccgcggccagtatcgcgaatacggtcaagatggccgcggccacgcgcatcatgcccctgctcaacacgatatgcgcgatggcgaaaccagcgatggcgaaaccagccgccacccaagccatcacacgggatcccaatccgacgccgaacaccacgaacacgtcggacagcagccaagctaccacatagccgatcattccggacacggccgcaacgccgatcggcagcacggtagccagtatgcgtccgtcccgtttcgaaacggccgcgctgaccagcagggttacggacagcactgcgacgacggcgaacgccgccgccggaaaccagcctccgaccaggcttatgttcataagccactgacgcatatttcccatccccaacatataggttttccttcaacttgacagttgtagtacgcaaaataacgggcacgcgtcatccttatggctgatttcgcctcaaaactcagggaaaaccctgaaaccgccgtgaaccgttcgctattggcgtatggttttggctatgacatacgtattcgaagcatcgaacgtacgctgttcgattatggtcgacggcgaacgccgcaccatattctccggattgtccttcgccatcgagcctggcgaaatcgtggacttggtcggaccgtccggcgcaggcaagagctcgctgctgaccgctttcgcacggctcaatccgcgcgcgtcaggcgatttacggttggatggccgttccgccgacgatttcaccccgcagcagtggcgcgcgcaggtcgcgtacctgccgcagaagccggtgctgttgggcgagacggtggcgcaggcgattcgtctgccgttcacgcttgccatacgccagtcggcgagaacgaagcaggggccgcgcagaatctcccccaccgatgcgttgccggacggcagaatccgtgaaaccttggacaatatgggctgtgccgacatcgatctgaaccgtccgccacacgacttgtccggcggtcaggcggcgcgcgtgagccttgcgcgcacgttgctgacccgtccgaaggtgctgctcgccgacgaagtggacgccggattggatgacgacaacgccgacaaggtggcgcgtatcctcgccaaagcggcggcggacggcatggcgatcgttcgtatccggcaccggccgccggatggccgtgccacacgtgtcatgcgtcttgccgatggcacgctcacgcagtccggcaacgccgaagcggacggtactgcgacgggtagtacttcgacgggtaacacggtagaagggagcgtcgcatgaacggcaactactatgcgatcgacatctggggtctcatcgccgcgctggtgatggtggccatcgcggccggcatctccgaaatcatgcgcatgggtgtgggacgtacgttgctgtggtcggcatgccgagctttgctgcaattgtgcgcgatgggcttcattatggagtacgtcatccgttcgaacaatccgtggctggtgctgctgctggtggcgttcatgctcatcgcggccgtgcagatcaccctttcgcgcgcgaagggtgtgccgaagggactggccggaccggtgttcctcagcctggtcgtgaccatgctcattatgatttcgctggtcaccgagctcattatccgcccgaaaccatggtatgcgccgcaattggtggtgccgctgaccggcatgctgctgggcaacaccgtttcggcattggctgtgggattgagccggttcttcgaaagcatgaaggaacgtcgcgatgaagtggatacgctgctcgctttgggcgccaccacgtgggaggcggcacgtccaagtatcgtctcgtcgatccgtctgggattgctgcccaccaccgcgtcgctcgcctccgccggcattgtgacggtgccgggcatgatggccggtcagatcatcgccggcggcaaccccatcgacgcagcgaaataccagttcatgattctcgccaccatcgcggcgcttacgctgctggcggacagcatcatcatgctgatggtctataaacgttgcttcaccacgctcgaccagtatcagccggtcaacggctgatactgcgatatcccgtatagaaaaagccgttcattccttgcgattgctggaatgaacggctttttgcttgaccgttgacgtacgtcagcgggagcggaacggcgccttgtggatcttcgcatgcttgcggtacggcttaccctgcctttcgcccgcatgcttgtcgtggcgttctccgtgaccgccacgacgaccggaatcgccatacttggcttccatgcgacggtcataacgcttcgcgtcctcgccacgctcgtcatgaatcacgcggatttccttgcgatggatgcgtttgccgccctgacggcggtcgtcgcatccgtcgcggttcctgcggtattggcgatcgtcctcgtaacggcgttcggcacgggcttcggccttgcgctgcttcttggtcggcgcgccctgctttttcgcatactgctttttgccgggcttcctatcggattggccacgctgatcggaacgctcgtcggagcgccgcttgcgattgtcggttccacgctgttcgccggcttcggcacgctgctgctcatgcagccgcgcgtacttttcgcgacgcttgttgttgcgcttctcctcgtgcttctcgcgcttctcctcttggatttcaggatgttcccaacgatgctcgcgtgcctcgtattcgcggttgtcgcggccttcgaacttggcggcgcgacgttcggcgcgattctgtttcggttcgaaacgctgctcgcgttcggcgacttcggcgcgctcctcacgtcccttgcgattcgcgcggtccttgcgttcggacttgaacggcttgccgcccttgtccttgccccggtccttgttgcgtccgccggaacggttgcgtccggagcgcccgccgttttccgcggaaccgtcgccgaccttgccatgcttcctgcgacgcggattgcccgccggctgggactgctcaagcgtccaaccgaaacgcggttcggccggctcgcccaccaattccaacacttccggggaatcgtgggtcacttcgatcggcttgaccttcagtccggcctcatgcagcatgcggcgggtgcggcggcgctggttcggcagcacgatggtcaccacatcaccggaatggccggctcgcgcggtacgtccggagcggtgaaggaacgatttcgggtcctccggaggctccacctgcaccacgagctccacgccggacacgtcgatgccgcgggcggccacatcggtggcgaccatgacgttcacgtcgccggattcgaaggctgcgagattgcggtcacgctggttctggctcaggttgccgtgcagctcggccgccggaatgccgttcttcgtcaggtccttggcgagcttctgggtctggaatttggtgcgggtgaacaggatgcggcgtcccttgccggaagcgagggtgcggaccagctcatgacggtcaccctgcgtggtttcgaacacgtggtgggtcatttcgtcgacggccgcggtggcggagtcgacgctgtggatcttaggatcggtgaggaacgtgttcaccacctcgtcgacgccatggtcgagggtggcggagaacagcatgatctgcgcgtcgaacgacacttggccgagcaggcgcttgaccggcggcaggaagcccatgtcggccatttcgtcggcttcgtcgatcacggccacttcgaccttctccaaggtcagcgcatgctgttcgagcaggtcctcaagacggcccgggcatgcgacgacgatatcggcgccggcccttagatcgcggatctggcgggcgtagcgcacaccgccatacacggtggtggtggtcatgccgtacatctgcgcgagcggcatcagcacgtcgttgatctggttggccagctcacgggtcggagcgagcaccagaccgcgcgggtgcggcaggaaatcgtcggcgcgccgttcctcggcatgccccttgcgcacctgttccacctcatggcggaactggctcatgttctcgtactcgtcggcgtcgacctcacccagtcgcgcgaccagcggaatcgagaacgccagggtcttgccggagccggtacggcctcggccgagaatgtcacgaccggccagggaatcgggaagggtgtcggcctggatcgggaaagcggttttcttgccatcggccgcgagcacgcgtaccaacgggccgggaacgccgagttcggcgaacgtctgggggcgttcctcctcctcgcccgcctcatcgaaatcggcggcgagggcatcttcattttcaatcacagcggtatcgggcacaatggcctttcatgtcaaacattgcgcacgttgcgcaaacctgttaacagtagcccatgcccgatacttttgccttggctgtgactggtggccgacgctaccggtagttgcgttcgatgaggatgtcggaaaccgtcagattcgcgtcgttgacgaggttgaacagcaccacttcggcgagttcggcagcactcatgaaggaatgctgcttttccaacgatacgtaatcatggctatcatggtagaagtcggtgtcgatgccgcccggatacacacccacaaccttcacactggttcccttgtaggccgccttgaggctcgtcgtataccccttctcaccccacttggtggcgcagtaaacggattcgttggcgttgccgcgtgtggcggcggtggacatgacattggcgattttgaggtcctgctcgccgtcggccttcaatgtttcgacgctccacagaatcatgcctttgagccccttaaggcacttgtccacgtcggcggcctcgtagtcgaccggctttttgaacgacggctgtcccgcgttgttgatgagcaggtcgatgtggccgatctccttgatggccgcgacggagtccttcacgaacgcctcgtcgctgatgtcgccgacgaaggcgcggtattcgtccgcgccgaacgtgcgggacagttcctcctgacgggccgtgttgaaatcgatgccggccacgaaccagcctttgccgatcagctgacgtgccagctcatatcccaagccaagcgcggaaccggtcacaatcgcgattttctttcctgccgcagtgctcatgttgtctcctttgccacattgcgcaatcgcttatagataccatcataaaacgtatgcgacgcaacacgtcaatcgattgacgaaaacggcaatgaaaaacgcccgccgacctttttggccgacgggcgttgaactagccagcgtgagatgcgatccgttacaggatgtccggatcgtccttggcgatggtgccggtcgccttgccgatggccttcaggccgtggtaggcgacgaggatgacgacggtgccgatggcgatgccgttgaaggagatgccgttgaaggcgaactcgaactggccgacggcgatgatcatggtgatggcggccaccatgacgttgaccggcttgtcgaagttgaccttgttctcaacccagatgcggatgccgaccatgccgatcatgccgtacagcagggtggtcacgccgccgagcacgccggcggggatggtgttgatgatggcgccgaacttcgggcacagcgacaggatcagcgcgaacgcggcggcgcaccagtatgcggcggtcgagtagaccttggtggcggccatcacgccgatgttctcgccgtaggtggtggtgccggagccgccgccgaaaccggcgatggtggtgccgagaccgtcggcgaacagcgcggtgccgatctggtcgtcatagtcgcggccggtcatctgggagacggacttgacgtggccgacgttttcggcaacgagtacgagcacgaccgggatgaacatcggcaggatggtgaagtcgacctgcggcagacggaattccggcagaccgacccatgcggccttgccgatggctgagaagtcgacctggccacggaagcaggcgtacgcgtagccgatgatcacgccgatgaggatgttgagtcggccgagcagacctttgaacagcaccgcgacgagcagcaccgcgacgagggtgacgatggcggtgtcgggagcgactttgaagttgttccacacgctcggagccaggttgaagccgatgatggccacgatggcgccgttgacgaccggcggcatgatgatgtcgatccacttggcgcccgcgtaatggacgagcacaccgatcagggccagcaggatgccggtgaccatgatgccgaaggatgcgacggcgaggcccttgtgggcgctggcgacggccgcgatcggggcgatgaagccgaaggacgagcccaggtagctcggcagcatgttcttgttgatcagcaggaacagcgcggtcgacatggccgtgaagaacagggtggtggacgggtcgaaaccggtcagaatcggcaccaggaacgtggcgccgaacatggcgatgacgtgctgcgcgccgatttccgcggtgcgcggccaggtcagcctctcgtcaggttcgacgacctcgccgggcttcagcgttttgccgtcaccgtggagcttccacgtgaacaggcccgcgattggattggacatgtgattgtctcctaactctcttacggcacgaaatacaacggtcgtgccgtacaatcacacgccattgtaatggcaccgcagatacgagaggcctcaacgcaagtagggggcaccaatcgcaagcagacaagacagatgaatcgtatatccgtggtatgtcacaggtgacggtcaacggcgtgcaccacgtccaccagatcgccgttcgacagaacgggacgtttgaattcacgccattcgtccactttcaccacccaacggccatccgtctcgtcaagcaccggacgcgccgtctgctcccaacggaaccgcttatgtgtacgcccggttgccggatcgcgacgcgaataatggaagcatgtgcagttggtgatcttccattcgtcggcggccgctcgatgcatgaactcctcgtcggacaggtcctccaacgtgagcatcaacgccagcatgaggtcgccatggctgaccatcaccacggattccgcatccgacttgcggttcagggacgtgagcaggttgtgcacgcggttctcggccacgtcggcgatggactcgcccgccggcggacgccagtacagcggatcggtgttcttgaacatccagttgcgcgcgtagttggttttgaaatcgtccttcgtgatggtgttgatctcaccccaggagcgttcgcgcagcacgcgagtctcctcccatttcgccttaggcagggccatcgtggccgccgtctcacgcgtgcgcacgtacggcgaaacgaggtagcggtcgaacagcggctgctgcgcgacgagccaacggccgatgcagtcggcctgcttgcgtccggtggcggtgagcctccacgaacggtccggcacggtgacgttgtcctgcgtatacagcgagttgtcaccctgttcgccggcgctgatgatgacgttcgcctccgactcgccatgtcggatcacatacagatcaaggggcattcccatattcgtttattccttcgctttcatccacatcctgcgcgcacgttccttgttccgccgttcattcggccggtggcgcgcatcatcattgaatgcttccaccgtagctgattcgcgcgtgtttcgcacgcacggacacgtcgatttcacgattggcacacccgaatttcgcggtgccgtcaccggcggttcaccgcaaccggcgtggtagacgccgtgatcgcaatcactccggccagatgccgctctgcgcgtacttggtgcggtactcccccggcgtcatgccggaatgttttttgaacaccttcgagaagtggctttgcgaccggtatgcgaggatctgggcgatctcgtcgaagctgtattccgagtatttgagcatgttctcggccgcttccatacgcttgtcggtgatgtattgcgatatggccgtgcccgtttcgcgtttgaacagctccgacagatacgtgggattcagatgcacatgctcggcgaggatgggcacggtgattttctcatgcagatggtagtggatgtagtccaggcattcgttgacggctttggaatgtgtttccgccttctgcatgtcggccatggcccatgtgaagaatgtcatcatgtcggtgtgcaggcggcgcacgtcgtcgggcgttttgcagttttccaggttctggatgtacaggtcggaggcgttgtaggcgtcctcctcgtccataccgccttcgatggcgaaacgtgtggcgagcgtgatggtggtgacgaaccggtatttcgcgtttttgagtggatcgtccgacaggtagccgtacagtccggagtcccacagacgtgtgctttcggcgatggcgttgatgtcgccggaacgcatcatgtcgtattgcttcatttcctcgacgtaccggtggtgccggacgcggtcctccctggaaagaaagtccaggtatctcagcttcgcttcgtcaacaaccgccatacttctcccactgttttatactgccgtccgctatttgcgatcgtccagatcgaatcctccttcaaggataaagcttttcagcaacttggtggcgagaagattcgcagtgaattgggtgacagggctatccggcttgctgaagaacgcctttgccaaaggcttgttgatggacgctttcaactggtcgaaccgaccaaattcgttcaacgtcgcctcggtaagatcaagccgcatcatctcgttgagcaaagctccatccacgccaaacgccttggtgatttgctccacctggctgttcttggcgctgttcgcgtaatacgtgatgtagtcgcgcagcgtcttgccttcctccaactcgatttcgccacgttccacatcatgcatgaacagttcggcataccgttgttcctcttgactgagcgaagcaaacgacttatgcaattcctcctcggctgatgccaacagggccggatcgcctccgccaagcgccttgagccatttggtgaagttggcgttcatgtaatccgtatcaatcaatcctgtatctatctcagtgatatgaccgtcaagttcatatggtgcttccggaccgctgccggggccttcgccgctgctgaacatctccttatatcgctgtacaagaatcagatatgtccgttcatcaagcttcggccgcacaacctccacggatccatcgtcataggtgacggaatactcctgctgcccccaagtgaatccttgcactttggcggattccaggaaatcattgagttccacgaacagttttgcgaacttgcggcatgcctccaccgattccggcagtcgcatgaaatcttccacgcctccggcactgaacacggaagcgatctcttcgaaacgcgcatccatcaggcgcacgttttccggcagtttctgcacgaacagatcgagcggcttgtctccggaatacagttttaccgccgcttcgatataccccttcatggtgtgtggcttgcggtagtagcgaatagttccgaaaggcttgtcggggccgaacagtcgattcgtacgactgaacgcctggatgatgttctcatagtcgatgattttgtcgaggtacagcgtgttgacccacttggaatcgaaacctgtcagcatctgatcaaccacaatcagcagatccagccgctcctcacggtgctggtcgaccgtcaggtacggacgcttgtgggaaagccgcgcggtgatgtccttcttcatcttcggccatgtggggatgatgaaatccttgtcgaacagttcgttgtaatcgccgatgatttccttaagcgcatcctccttgaggattgcgccgtcggaattgtcgacgttggggtcgaacagcgcggtcacgtgcatctgcggagcacgttccttgaacagatggtaatagctgatcgcctcgggaatggaactcgtggccagcatcgcatggaatttgttgcctctgctcagcaatgggaattggtcgagaatatcctccacgaccttgtcctcatgtggcgtgccttgcgcatactgcgctgcggtcagatagtcctcaatgcctttgacatgttctcctgcctgcgtttccatgggtcccatcggcatttgcttcgggtccatgtaatggtagaacacctcagctttcgccggatccacctgggcttcctcaaccgttgccgctttcgccttctgcaacgcgacagcctgacgaacatccttgtctcggtaggtcaacaccatgtacgggtcgaatccgagcacattgccatcgcggatgccgtcggcgatgctgtatcggtgaaggcaatcgccgaacaccattgatgtggtcgcgcccttcttacggttctcctcatgaatcggagtgcccgtgaaaccgaaatacaacgcgttcgggaaggaatggcgaatatcctgcagcatctcgccgaacgtggaacgatggcattcgtcgataatgaatacgatgcgtttgccggcgagcttcctcacttcctcttcggtgatatgcccctcgcccgctttgatgttgctcattttctggatggaggtgacgatgagcgtgtctttggggtcgatgcttgccagtttcgatttgagcacatccgtgttttccgtgccctgcacatcatcggcatcatccgcgaacgaccggtattccagcagcgactgcgtgcccaattcgacacggtccatgaggaagaccaccttgtcggcatctttcgagccagcgatgagctgcgcagccttgaagctggtcatggttttgcccgagccagtggtgtgccacacataaccgcccggacggcccggcgtgccgcttggcaccggctcatcccatttgcaggtgcgtacacggtcggaaatggcgttcaccgcctggtattggtagctgcgtagcactttgaggcatccgtctgcggaatcggcgaccgtatagaacccgatgagctggtgtgccatgggaatggatagcagatcagatgtgaaacgcttccattcatcctgcccgacatggttgttcgccgctatgggctcgttgttgaagtcagcccagtggaagaagtagttgctgttgaaatcgccttcaccgggattggcgaagtacacggcatcatccggattcatggccacgaaaacctgcacgagtcggaacagcccggtgaacacgccttcatgcgcgtatttggcgatttgattggtggcctggcttacgggaatgccgcttttcttcagttcaatatggatgaccggcattccgttgataagcaggcaaacgtctcccctgcgatcgttcagcatcttgcttttcgctggatacatcggctgtcttgcaatttggtagcggctttgcccggcggcgatttcctggcgatcgtagatcttcagactgatttccttgccgaaatgtgctgtgtctgcgggattgtcacgtttgatggacacggttttgccgttgatgaaagagttcaacgccaatggcgtgcgcaatgtttcgatctgttcaaggatctgcgccatctcacccttggtaaggcgctgcccgttcaggcgatcgatgcctttgttgttgtcgaataggatgttggcccagttatcgatgagatcctgttcagtcgggtattccaacacaccatcggtccacccgtggcgtttcagcaccgcgaccagatcgtcttcgaaatccgattccttatcgtagaacatgtttcatctccccgaatgcgccgtcactttctgagcccaatcttacgagcgcaacccctaacatccaagaagcaacaccacaatacttacgctgatgaagggtgatgagcgaatccagacggccgaaaaacgacgcacgaaataagaaaattgacgatcgccttataaggaaaggcgcatcgcacaaaaacctcaccgtccttcaaggcctcccggccactcgcaaggagcggacgatgaactggcaatcattgactataaagaagtagtacaaatacgctcttgagttctcaaaccaccaccgcaccagcaagccaccccaatctccaggagcgaggccgccgtgctgagcagcaagagataaacctacacgagaacccgcaatcgcgcaacccgcagggcgcaatgaagcacggaaccgttggaaatccaacgttccatcggcgtgtcgaaaaccgggaaaatgcgtccggaaagcgccgataccatcagaatagaccccgaaaaccacaaccaggtgaacgcaaaaccaatagctgtcggcgtgtcgaccatcaacatggtcaaccacatccgcattttgcggtccaaccacggttctcgcataacaaaagccggaagctccgtggttagcggaggctcccggctttgttgttcggctactggatattcagctttggtcattcgaatcgctgaccattgctaatgctgcctgtagccgactgttttcagttattacttcagttatcgctgatcaggcagctcactcggcattggccgggccggcggcaaccggttctgcagccgactcgaccgtggcgacggccttcttgcggttcaggtaccgcttgatggccacaatctccaggccgatcacgagcaccgcggtcacgccccaagccacgtacatggcggtcttccagatcggggtggcgaccttcggctcgccattcgcgtactgccagctgttggcggccgtgtacaggatgttgtgcgcggcctgacgcatcgccttcacggaagtggcggacttatcggtgatgtggttggtgatcttcgtggtggcgagcatcgaatcgttgcccgcacgcacttcctgatcggcgttctggtagccgtagccgccgaagtaatcggtcaggacgaaacccttgaagccccactcgccgcgcagcacggtctgcagcaggttgctggaagcgccggcgtaggtgtagccgatgtagttgaaggagctcatcacggcctgggcgccgccttccttcacgctcatctcgaacggcttcagataggtttcacggatggactgctcgttggcccacgtgcacaccatgttggtgcggttggtctcctggtcgttgagtgcgaagtgcttcatgaaggagtacacgcccttggacttggcgccggcgatttcgttggaggccatcgcaccggagagcagggagtcctcggagaagtactcgaaggtacgaccggagaatgccgaacggtggatgttcatggccggagcgtaccaaccagccacgtgcatgtcgtgagccatgtcgccgatcatctcaccgaactgcttggcgagatcacggttccaggtgcaggcgaacgcggtggaggccgggaagccgatggagccaacaccggtgaagttgttgttcagcgaggccgggccgtcggcgtcggtcagctggatcttgccgacggacttcacagccggagtgccgtaaccaccattggcgatcaggttgtccatatcgtcgaaggtgagctggtcgagcagcttgtcccaatcggcgtcgtcataatccttgccatacatctggtacagcttcaggccattcttggcaccggtggtcggcatctcgtccgaatcgttgtcatacttcttcggatcgtagttgctgttgttggtgaactcggccttggcttcgtcgctcatcgagaagttggtcggagcggcggtggccttggcatagttcgcgaagtggcccgcgcgagacaggtacgtcacgtcgccggcggcgtaatcgaactcgttggtggcggccacggcatcgccgttatgggtgttcgagtcggaattgtaggtgacggtgtccttcacggtgaccttctgatggtcgatcacgtggtgcgaatcggactggatggagatgtcgtaatcgccctgctccagcacgtacgccttagcgtccttctggtcgtaggaggccatgtcgtcatcgtcgaactcgatcttcacggtctgggaagcgcccggctcgagcttcttggtcttttcgaacgcaaccaggttcttggatgccttctcgatgccgccatcggtgtacggcgggttgtagtagacctcgaccacgtccttgccggccttatcgccggtgttggtgacggtcacatcgaacgagatcttgccgttcttgtaggagaccttgcccatctcctgcttgaacgtcgtgtaggacaggccgtagccgaacgggaacatgacggtgtcgtcgtagttgatcagaccttcgtcggcggcggtctcatagaacttgtagccaacgtagatgccttcgacgtagttgacgaacgtcggggtcaccgtgaccttgtcgccactgaagcccatgtaggaagcagcgagatcatccgcattgtcgtaagtgaacttgccgttcgtgccgacggacgaagcgttgccggcggcagtgccatcggtgttgttgaacacagcggtcttggtcaggtccttcacgaacgtgtcggaggtcttgccggacggattcacatcgccggcgagcacctcccagtgcggagaagccggtctggccggccggcgggcaccacagcacggacttgatctgcggatactgggacaggaagtcgaactggaacgcgttggcgccgttgtagacgagcgtcaccttcttgaagttcttggtgaccaggtcgatcatgtcgcgctcggtctgggacagctgcaggaagtgctcgccatccttgaaatcttcgtagtccttggaattgttgttgtaggtgatgcccttcgccttcatgttcgtcggcaggtcagcgccttcgccgccgacgcgggtgatggtgatgacggcttcgtcggagaagtccttggcgtcggagatcagcttgtcggaatactgcttggccggaacctcaggcagggtccaatcctgcgaccacatagccaccatcgggcggtccttgcggtagtcggtgtacagcttggtcagctcggaattggtttcgatgccggcctgcttcatgccgtcaagcatggaaacggtctcgtactggtcggacatggagccggagccggtgccgccgtaaaccgggttggtggagccccaaccgaacacgttgaccttcttgttggacagcggcaggttggaatcgtcgttcttcagcatggtgatggcttccgactgcacttccttggccagctcgttggctttggaaacggtggtgtcggacagcatgtacttggtggtggtcgcgttgttgagcagcgtggaaagcgggccggtcagcatcatggacacggccacgacgatgccgacaagcgccaccagccaggattcggaatggacgatcttacgggtcgccacgtccttgaccgtcttcttgttgacggcaaaagtgataatcagcgcgagcgcgaacagcacgccaatcgcaataaggtacggcgtcaatgagccgatgacgttcataacgtcagccatgttgatttgcagcatggtctgcctcctccttgattctcataaccaaacgacacgtaggctccgatgcctttatcggaaccgcgaaaccattcaacactgccccgcatctcatggtttcggtgaagtggctgcagatgcgtgcggcaagtgaagacacttcttcatgtcgatgattcgatttcatcagacttcaacgtgcggcacatggcgttttccccagcctgtcaattcgcgtgcataatctgcacgccaagtacgatggaagtatgagcgacttaagcgcattgaatctggaagcaggcagcctggttggcggctacacgttgatttcccggcttggttcgggtgccatgggctcggtatggcgtgtgcgggacgatggcggccatcaatatgcgatgaagattttgcgcgattccctctccgacgacgattccccgcagcagcagcgcgacgagttgaccgcacgcgagcgcctgcgcagggaggcgatggcgttgcagaaggtgcggcatccgggcgtgtgcggcattgtggatatggaacttgacgacgcgttggcttttattgtgaccgagttgatcgaaggcaagaatctgcgtgaggatgtgcgcgtcaatggccgatatgtgggcgacgatttggaacggctggcacgcaagctgattgaggcggtgcgtgccgtgcatgcggccggcatcgtgcaccgcgatatcaagccgacgaatgtgatggtgtcgagcaccggcccggtattggtggatttcggcatcgctatgggcgaaggcgaaagccatgtgacgcgtaccggtctggtgatgggcacgccggggttcatcgcgccggaaatcattgatggcgcggaatcggatgaaatgaccgattggtggtcggtggcgagcgtattggcgttcgccgctacgggtgagccggtgttcggcacgaagccgatgatgaccgtgttggaacgtgcggcggcaggcagcgccaatcttgcgggacttcctgcgggcacgatggccgcgttccgttcggcgcttaatccggatcggacgaagcggtgcacgccggacgatttgctgcaggcgatcgccgtggatgcgttgaatccgcaggcgtgggttgcggccgacaatggtggcgcagcggatggcgatacggaggcgatgcccccttttgttgaatcgcccgacaatccgcgcacgttgtggcaatcgcaggacgacataaccggcgaaaacgccatcggcacgcgcacgatgccaaggctcagcgaagcaacgcaggcgatcgggcagcccgatgtgagcgcaactcaagtaatcgggaaacaagtgaccagccaatccgacgcgagcgcaacgcaggtgatcgcacctgttgacgatgccgagaccagcgtgctttccgacgcacttcccaacgtgggcagcacgcgggcgatgccgacaggcacgcaggtaatgccgcaatccatgccgtcaacacaaatgctgccggcccagaacgcatggaatccagcggaagcgccgacgcaagtcgacccgaccatcaaacccgcgttgcaacgcatcgccatgcggcagccaccgtccgtcataccgcaggccacggtggccgcggcgcagcaatcgcccgcaatgtcattcccgccggtacccggtatggatgggccgaacgttgcggaagcacccaatcccgccgatgtgaagcgtggcgcgatgttgggccggggcatgctcccctgcgcgctgatggcgattcccgtggccgtctgcggactgttctcactgtggacggcgatggcagccgcgttgctgttcgcctgtgcgctggccactatcggattcaacacggaggcgcagctcgagcgcgaaggcaaacgtggcggcgagaagaaaagttccgactggctgctgcgattggcgggactgccctggcacatcgtgaagggcttcggcgtcgccatcgtgcggacgctgatcatgttggccgtggccgcgctgggtttgtcgctcaccacggtcgtgctgcagcttccgtatgccgtgatggatacgtggatatttggattgacgattccgatgccgacgctgcttggcggtccgctttccgaaagcgggctggcgcaggctgcgttctgcgcgatcggctggcttgtggccgtggccgctccgggcgcgatcgtactgcgattgggcggcggcgcactgcgtaaacagccgtatctgcgccacttgagcgagctgccgacgcaatcgcaaggcaatacggaattcccggcgaatcgatagcaaggcatcgctagtatggtgcccagcataacaacgtgaggtcgaaaggaatatcgatggcccagaacagcaaggatgcgcagaagcgtaccagccgcgccgagcgtagggccgctgaggccgcggcgatgaaggcgcgcgccgagcagatggagaaggaacgcaagcagcagacgatcatcggcggcatcgtggtggcggtgctggtgattctggtggcgatcggcgcgttcaccgtgtaccacaacatgcataagaaggccgaaacgaaggcttccaccgaaaccgtgcaggaagcgtacacggcgttgcagaaagtgaagaacactccgaagctcgtcgataagaagggcggcctgctgatttccaagaacggctacggcaaggctgtggagggcgcgccgaccgtcgagctctacatggatttcctgtgcccgggctgcggcaacctgcaccgccagttggacgccgacctgcagaagatggtcgatgccggccagatcaatctggacctgcatttcatggcgttcatggaccgttggtccaccgacgagtattccagtcgcgcggcgaacgcggccatctacctggccgagcatgacagcgacccgaaccatctgatctccttcctggagaaggtctacgccgaggatttccagccggaggaaggctccgcatacaagtcggtgagcgacgccaagatcaaggagcagatgatcgccgcgggtgtttccaaggatgttgcggacaaggcgtttggccgcgattatcaggaatggcttgatgcgatcgacacttacacgccgaagcgttccgaactgtggcatcagtccggcagctacaagggcagcatgaccacgccgaccgtgatcatcaacggcaagtattgggatatggaccagctgaccaccgcccagacgacggttaaggacggtctgttggaatcgatcggcctgaaggacagcgaagtcggcgttgccggcaagatgccgtccatcggagccaagaaggggccgatttccgtcaccacgggcgaataaccccttacgggcagccggcgcgtctcaacccgcaatgctaagttgactgcggtggaagcgctggttatgctattcatcgttcctctgttgttttcatagcaaaagaggacatgcctccttagctcagatggccagagcggccgccttgtaagcggcaggtcgtcggttcgatcccgacaggaggctcgaacccgtatgacgggcttggacctcttaccatgggtaagtgctccagaagtcttcccccaacttgagacttctggcaaagcggacgagacgtcccccaacctgtctcgtccgaccgggggcaggacatccccttctctcctgccccctttttatttttcgcttttcgcacctgctttcaaaaatgtggcggtatggataaaaccatcggaaagcacggcgaccgttccagctgagccgttacaataacggcgttgtaggcagcgctgaaaagaggataaatgacgagaaggtggacccctcggagattcgtgacgcttcgtcgtgtccgcgtcatggcatgcgtggcctcattgactttgacttcggcgttggcgtttggtgtgggcgcgcgcaaatccgtggcgttgaccgtcaatggggagaccaccacggtgaccacatatgcgatgagcgtggaccgtctgctgcaggagcagggcgtgaaagtcaaaacgcacgacctggtggaatcgaccagcccgaccagcatgctgaagaaccatgatgtggtgaacgtgcagagcgcataccagaccaccatcaccatcgacggccaggaagtgccgttctggacggtcgcgtccagcgccgagcagttgctggacttcttcaaccaaaacgaaaccgaagcggcgaaaatcaccgtcaatatcagcaacgtctacaacaagctcaccggcggtctcatcatcaaccagaaggggcccgtcaccgtcatcgcggacgggaaaagctcggtggcgccgaacggcaagctgcccgctgcctccattcttgacgccaaaggcatcacgttgggcaaggaggatcgcgtcagcgtcgaaaaggacggcaaaaagaccattctgcgcgtccgccgcgtgacccacggcgaggaaacacgtacgaaggaagtgccgttcggcacgcagaccatcatcgacccgaacctgcagccgggcgaagtcacgatacggcaggaaggcgaaaacggcgaaatccagcagacgtacgccgtcacctacgtggatggcgtgaaggaaagcgagacgctgaccgaagagaagaccacgaaaatcgccatcgacaaagtcattgcggtcggaccggaaaaaactacggacgataccgacaagtccgacaaatccgacaacagcggcaacggcaacagcaacggcgataacggcgattccggcaagacggacgacggcaagaacgattcgggtaagaacgactcgaataagtccgattcgaataagtccgattccgacaaaaccgattcgaacaagtcggattcctcggataagaacaattcgaacaacaactcgaataacaattccaacaacaccgagaaggacgatccggcaccgacccccacaccaacccctgcaccgcagccgactcccgcaccccagcccaaaccgcagcccacgccgcagccgagcaatccttccgcaggctgccgcttgtaccatccttccgcggcacaggcacaggcctacgcttccggcgcggcggcgcagcgcggctggaccggccagaactggacggatctggtcaaactctggaatcgcgaatccggatggagctggagcgcggaaaacgtgtattcgggcgcatacggtattccacaagcgttgccgggcagcaaaatggccacgttcggcgcgaattggaaggacgatgccgccgtgcagatcgactggggtctgagctacatcgcacagcggtacggcagcccgtccgcggcgtggcagcactccgaacagaccggatggtactgatccggctaatcgccaacgattttcgtaccggcatgaacggataatgagggaatgacagaagagggaatgacggaaaacgtgaacgagcatacgcagggccatttgctgggggcggccgacatccgacgcatcgccgccgacgcgggtatcagcccgacgaagaaattcgggcagaatttcgtgattgatccgggaaccgtgcgtcgcatcgtgcgcgaggccggcgtgaccgccgacgaccatgtgctggaagtcggtcccggactgggttcgctgacgctggcgattctggaaaccggcgccacgatgacggctgtggaaatcgacccgccggtcgccgaacgcctgccgaaaaccatcgccgaattcatgccggacgccgtggaccgcttccgtgtggtcaaccgcgacgcactcaccgtcaatccggagaatctgcccgatttcaaggatgacgattccttcacgctggtggccaatctgccgtacaacgtggccacgccgattctgctcaccctgttggaacgtttcgacaatctgggcaccttcctggtgatggtgcagaaggaagtggcggaccgtttgagcgagaagcccggttcgaagatctacggcacgccgagcgtgaagctcgcatggtacggcaccgcggaacgcgtgggcgtcatcggccgcaacgtgttctggccggccccgaacgtcgattccgcgctggtgctgttcaagcgctacccgggcggtcacgcccccgccgcggacaatgcggacggttccgtggtggatcgcgaaaccgtgttccgtttgatcgacgcggctttcgggcagcgccgcaagaccctgcacgccgcattgaagaaaatcgtgccgtccgaagcgttcgagaaggccggcatcgacccgacccgtcgtggcgagacgctcaccatcgacgaattcgtggcgttggcacgcgcgttggatgaggtgttcgcgtcatgagcaccattgattcgcccgccatcggaacggccaccatcaacgccgtgagcgtggactgcccggcgaaaacgaatctgaccctgcatgtgggcccgtcgcatgccgaatggggcggccgtcatgaactcgacaccatctattgcgcggtcggcgtatacgacaccgtcaccgccacgcgcaaagcgccgggaagcggcttctcgctgaatctcgagggcgcgtatctgggcgacctggcctcttccggcagcgatatgcgccgcaaccatgccgtgctggcattgttcgccatggccgaagcgagcggccatgagccggacgtggcgttgaacatcgacaagcgcatccccgtcggcgcgggcatggccggcggttccgccgatgcggcggcgacgattctggcattgaacacgttgtgggatctcgattggccgatcgaacgcctgcaggaagtcgcggccacgctgggcgcggacatgccgttctgtctgaccggcggttacgcgcgcggcaccggtttcggcgaacgcatcgaacagcttgatgacgatggcgatatcgtacgcgatcttacggaacgtgggtttaccggccatctgctggtcggcgcataccgtgcggaactgcgcacgccggaagtgtatgccacattcgatcagatcggtgccggcgatggcgatgagaaccacctgcagaaggcggcggtctccctgcatccgcgtagcggacaggcgatcgaggaagccttgcgtgcgggagccagccaggcgttcgtctccggttccggcccatccgtcatcgcgttcgtgccgacggaggatgcggcggacgccgtgcagcgggcatggcaggacagccgttgcgtcgatcgcatcatcgccacgaacgccccagcccgaccgattgtgcatatcaccgcatgacacatatcaccgcatgacagtaaagttgatggcaattggtttgttcaaaaggaattcgtaaatgacccaggctaacgacgagcgcgccgcgcgcaaagagtacattcgccgccgtcagaagacggtgttcagcatcgtcggagccgtcatggtggtcgccatggtggtgtccctgctgttctttttccatgtcggaggcctgggcaacgtcaagtcggccgccgtacagccgaactacggccagcaggcaccgtgccccatcaaggaagccgacggcagcaaggccaagtatgtggagaatcgcaacatcacgctgcgtgtgctcaacggcacgaagttctccggcttcgccaaggcggtgagcgacgcgttgcagaaccgcgagttcaacccccagacgccggacaactacaccaagaaggtggatcgcacgatgatcgtcttcggcaagaacggcgtgaatcaggcgtacaccgtggcaagcaatttcaccgacgccatgctggttatggacgaccgtcaggaccagctgatcgacgtcatcgtgggcgccacattcgacaatctgcaggatacgaagaaggttcccgccgcaggcaaggcgatcaccggcatccagggctgcgtcgcggtggacaagatgaccgacctgcccaaggcgcccgagcatgatgcggtgaatccgcaaagctgaccgccaatcgaaatcgatataggcaatatgaaaaacccgcgctcccccaatcgggaacgcgggttttcgtattcgagctgttccaagcacactgttccatgcatgcggcgaaaccaccgcatgtcaatcgctattcgctctgctccttgtaccagcgttccagctcggcaacggccacgtcacgctccaccggaccgttatcgaggcggtattccagcatgtgcttgtacgccttgccgaccatcgggcctggttcgatacttagcagctgcatgatctcgtcgccgttgaggtcaggacggatcgcgtcgaagtcttccttttctttcaggtcgcgtacacgctgttccatctcgtccatggccgccgagaacatcatggccttgcgcttgttctgcgtggtcgtgtcggcgcgcgtaaggcggttcagacgctcgtacagcgggccagcgtccttgacgtagcggcggaccgcggaatccgtccacggctcctccacgtagccgtggaagcgcagatgcaggttgaccagctcgctgacgtcctcgaccatgtggtggtcgaaatgcagtgccttcaaacgcttgcgtgtcatcttcgcgccgacggcgtcatgacggtggaagctcaccttgccgcccgcttcgaaacgacgggtcttcggcttgccgatgtcgtgcagcagagccgccagacgcagcgtcaggtccggggccggcaccggaccgtcgggaccggtttcgagggcgacggcgcgttcgatgacgatcatggtgtgttcgaacacgtccttatggcgatggtgctcgtcgatttccagctgcagcgcgggaatttccggcagcacgatgtcggcaagaccagaatcgaccaacgcttcgatgccggcgcgcgggcgatcggacagcagcagcttgaccagttcgtcgcgcacacgttcggcggagacgatttcgatgcgatcgaccatgtcggacagcgcttcggcggtttccggctcgatgcggaagccgagctgcgccacgaaacgcacggcgcgcatcatgcgcaacggatcgtcgtcgaacgactgccgcggatcgacgggggtacgcagcacgcctttggccaaatcgttcgcaccgccgaacggatcgacgaattcgagttccggaacacgcaacgccatcgcgttgacggtgaaatcgcggcgggaaagatcgccttccagcgtgtcgccgtaattgacttccggcttgcgcgagtcggggtcgtacgtgtcggaacggtaggtggtcacctccactttcacctcggtgccgtcctcacgcctgcgcatcgcgccgagcgtgccgaatttgcggcccatatcccagaagccatcatgcccaaaacggcgcagaatatgctcaaactgctcgggacgcgccgatgtgcagaaatccaaatcatgcgatttgcgatgcagcagcaggtcgcggacaggacccccgaccagtgccagttcatagccttccgcagcaaacatacgtcctaattcaatggcctctggccacacttcgaagttcacgccatacctttcagcaccacaagttttccgtttaccagcataccgttaccccacctgcacacagaattgagtatggttggaatcatgattacgcccgcagaccttgcacgcatgcttgcccatgctgcggacgaccatgcccaaaatccgctggaaccggacgaactgctgtacacatcgcagtcggtttcgctgcagcagctgcaacaactacagcaattgcagcagcgcacgatcatcacgccgagcgcgcctacgccggcgatgatgccgcgccggcgcaccgcggatggtccgaccacgttcgcatcgcttgacgcgcaggagctgccggtggtgcgcgagtattcggcgggcgggctggtgttcgacgacaagggtcgcgtggcgatcatcgcacgtcattcacgcagcgggcatttggaatggtgcctgccgaagggacatatcgaaaaaggcgaaacgccgcagcagacggccgtgcgcgaagtgcatgaggaaaccggcattctgggcgaggtggtcgattccatcgccaccatcgactattggttcaccggtaccagccaacgcgtgcacaagctggtgcaccacttcgcgttgcggcagatcggcggcgagctgaccgtcgaaggcgatcccgaccatgaggccgaagacgccatttgggtggattttgctgatttggacgatgtgctgagctatccgaacgaacggaagatagcatggttgtacgcaaggaaactcaacagacaggcgtaatagtgaatcaatccgcacaacggcacgtttcgcgtggccttcgcgcgttatcatccatcctcgccatggtattgaccatggcgttgatgttgttgtacgcacccacgccatcggcaagggccatggaatcgaccacatcggcggagtcgacggacggtatgttgtccatcaactcttccacggccgtattgacggacatctccggataccatctgaacgccacggtgaccaacacgaccggacaggagattcccgcgggaacgctgacgctggccatgaacgccttctacacgttcgtttcgcgcaacgacatccaggattggtctgaaggcaacgggcgaatccccaccccgcaatccgtgggacaggccgatgtgcccgcgttgcagccgggagccagcgccaacgtgagcatcgacgcggacgcccatcaggaatcgctcgcggccatcaactcttgggggccgaagccggtgctgctgagctattccgccaacggaaccccccttgctcaatcgcatacgttcgtgacgcgcaccggcgcgggactccacacgcccagcacgccggcgctgcacatcaccgtcgcccagccgctggccgccaacgggtggaccaccgacagcaagctgcttggacagctggtcgatgaagggggtatttcctcctcgaaactggcgaaaatcgccatgcccagcaaggatgacgacgcacggctcaaatcgttgcagcagaccttcgccaagcacgacatgctgcaggtcgtaggagatccgacctacctgcaggcgatggcgatgccaacgcgggtcgacggcatcacccagcccgcattgttcgacataaccgcctatagcgccatgaacaacgctccggcctacagcgcagccggcatcaacgaccgtcaatggtccgcagccaaagcccggaaaacctatcaatcggcattgggtgacagcaacgcggacatcaccgcatacgcgtggcagggcaacggcaattggaccctacaagcgttgacgaaggcccgccagcaggggtacggcaccgtcatcgccacgcatgacttcgaagaggacgatgcggctaccgtacgtaccggcaagacggtggtctccaccgatgccggggacatcaccgtgctttccgcgcagaatgtgctttccggcctggcccaaggcaaggcgaccagtgacgatgccaacgccgacagcgagggaaccacggccggcagattggcgcgattcgtcgcgcaaagcgcgttctaccagatggaacagccttatgcggaacgcaacctgctggtctgtctgaacgaggattccgaccccagtgttgtggacgcgctgatgagcgacatcgagcagtcgccgtggctgaacctcaccgatctcgccacgttgaaggatgccgacatctccgaagatgcggccagcatgtcaaccgaccttccccaaacggacggccttaccgatggcatgcgcagcgacgtccagcagactctgagcgcgctggcgaactcatcgagcaacatcaaacgtttcaatacgtcgatcctcgtcaagccgaacggaaaagacgaatccgacgtcaacacctggagcaggcagctgacgaacgcccacaccatcatggccctgcacgcgttgggcggcgagagcccttccagaagcacgatggcggaaggcgcgaaccagctcgcggtcctgctgatcaacggtgtggcgatcacgccgacggaaagcgtgaacgtggtcagcgaaaccgcgaaaatgccggtgaccatcagcaacagccacccgtacccggtaaaggtgaaggtctcgtcgctgaccgattccatgcagatcgtcacgtcccgattcgacaccgtgcaggtgccgccccacggcgaggcacaggtggcgttcaccatccgtgtgtccacgtccggcaccgccaacgccaccatcagcctgttcgacaggaatggtgcagcgtttggagccacgcaggtcacccacatcaccagcgcgctgcagatcagcgacaagagcggtttcgtcatcatcggcttcgccgtgctcttgggcgctgtgggactgtggcgtcaattcaaccgtaagaaggatcccgacgaatgagttcttccgttggccgtaactcactgatcatggcctccggtaccgccgcttcgcgcgtgaccggccaaatccgcaccatcctgcttgcctgggccttgggcaccaccggctatgccgccaacgcctaccaggccggttcgatgattccgcaggtcatctacacactggtttccggcggcatcttcaacgcggtgcttgtgccgcagatcgtgcgcacgctgaaatcgaaggacgccgaaaccaagctcaacaagctcatcacccttgccatcaccttgttgttgggtgtgacgctgctcatggccgttgccacgccgttgttgaccaaactgtatgtcaacggcagcgccgaaaccatggccctcgccacctccttcaccttgtggtgcatgccccagatcttcttctacggcctgtatacggtgatcgggcagattctcgcggcgaaggaccatttcgtcacgtatgcgtggagctcggtcggcgcgaacatcatcagctgcatcggtttcggcgcgttcatcgcgatgttcggcagggccacggaacgtccgctggacttctggacgccgacgaaaatcgcgctgaccgccggcacttggacgcttggcgtggcgttccaggcgctggtgctgttcattcctttgacgagaatcggcctgaaataccgtccgaaattcggcgttcacggcatcggactgcgttcgatgggaccggtcgccgcgtggagcctcggcatcgtcggcgtcgatcagatcgtcaacatcatcgtcacccgcgtggccaccagcgcgccgttcaaggcttcggaacagctgcatatgagccagttggacgtggccggcaacgcctcgtatcagaatgcgtacaccatctacatgctgccgtattcgctgatcgccgtgtccatcgccactgcgatcttcccgaaaatatcgaaagccatcgcggaccgcaatatcgacgaggcgcgcaaggatctgagctcggccctgcgtaatctcaatctcatcatgtgcttcttcgcagcggcgttcatcgtgcttccgttgccgatcatcctcgcactgctgccgtccatcagcgtgcgtgaggcgctgctcatcagcgcgccgctcgccgctttgggcatcggcctgccactttccagctcgtatttggtcatccaacgcacgttctacgcgttcgaagacggcaagcatccgtttattttcatggcgatcaccatggccatccagggtggcgtcatcatcgcgtcgacgttcattctgccgcccacgcagtggatcaccgtcatcggattggcgatttcggtgagcttcatcctgccgtatccgctgcttacacacatgctccgctcccgtttcgacggcgatgtggacgacaagcgcatcatcaccgcctatgcgaaggcgctggtggccacgatagccgcctgcgtgattggcctgctgtgccgcaacggcgtctaccggctggtcggagcgcatatcggccccgacgacggcactatgaactggggtcaggcggttctgtccgcgatactgctcaccatcgtcatcgccatcgtctatctggcgtgcctgtgggcgctgcgtgccgaggagctcacttcggtcgtgggcatgctcgccgcccgcataccagggcttggcaacaagcctaagtctggcggaacggccagccccaacggtaaacttgagcaaagtaccgccgaaaacggcgaccaagaataacagcgtaggtagaacaatcgttacagagttgaaggaaaccatgaaacctcaactgggagataccatcagcaaccgctatgtgctggtttcgccattgcgcgaggaaaccggcttgcaggtttggaaggcaagcgatcacgtgcttgcccgggattgccagctttttatcgtcaacaaccgcaaggctttgcaggacgtcaatgcgacggcctccatgctggcgatttcccacgacgcccatttcacgcaggtgctgcagcttcagcacgtgggcgaggtggcgttggtgatcacgcagctcgatgccggcatgtcgttgagcgagtatctcacgcagtccaacaagccgctgagcttcaccgcgatccgttccattcttggtgaggtcgtcgaagccctgcacgtgttgcagaaagacaatctcacgcatttctcgatcagcacggacaccgtgcgattgacccgcaacggcattgaaatcgccgacgcaccggtaagcatcatgctggccgatacttcgcgcgtgcaatccgtagaaaaccaggagcagcttgcgattcgccagatcgcttccctgctgtattccctgctgacgcgcacgccgtcgacgctgtccacgaactaccatcttgacgcgatttcaccgaacgtgccgatggagttccgcgtgatttgcaagcgtggtctggatctcaaggagaaggacggtttcccgaccgttccgatggccaccatcgccgaattggaggcgttgctgggcgactacgagccgctggcgaagcttaacggccctgatattgcgttaccgtccgcggattcggaatgctcgattgtgaacgtgcccctgctgcagattctcgagcaggatgccatcgccttgcccgatacgctggctgaaaccggaagcattccggaaatgacgttcgaagcgcctgaaccacacactgatttctccgacagcaaggaagccttggccaagggtatggccgcgaccggcggtgccgtgaaatcgctgtggaacaacagccgcgaactactcagcgaagaggacctcgacggatcctccgaagatgtggattcgccgttctccttccccatccgtgtttccacgccgtcgccgcagggcgattatcatacggacgattcgcaattggagaagaccggtcgcattccggtgatcggacctgacggacgggtcatcgagccgggcgaggaatccgcacgcgcgttgaaggcggagcaggaagcgatcgacgtggcatatcagaacgaaaacggagcccccgttgcggtgccgccgagctttgcccctaaagcctcttcctccagtccggccgaggtcgccaatgccaaattgttcggcaagctcaccaccaaggtcgtggccattgtggtcgcgttcattgtggtggccgtcgcattgggattcgccattcatggtttgaccaagaagccggatgacggcatcaccaatacgaattccaacaatccgtggccggaaatgaaccttgacgacgtgcctttcggcaataatggcgattccggcaatggcagcagctccgccagcgatgcaaacaacgattccaacgatgccaacagctccgacaacggcagctccgattccagcaagccgaagaaaaccacgaaaaagagccattccgccaagaaggacgtcgacaaggtggtgacttcggataagaaggtgcggaaggttccggaaccgaagatgccggagaacacgactccgtatgagatcgacaaccgccagttcctgtccaatccggacggacaacagggttacggttattacctccacctcagccagccccagaaagcgtatcgcatggtcatcaagatccgttcttccggcggccagggctacattcgcgtgaacgccaagtccagcccgaaccagggtgaacaggtcgcccagttcgagttcgacgccagcggcaccaccgaaatcaagttcaacaaggccgtggagacccaggacatcctcttgtgggtgccgttcgacagccttcccggcaaccagctgtacatcgattcggtgcagattttctgacgcatcggcagacaaggagggtgtgcggattgttccgcgcaccctctttttgtttcacgtgaaacaacatgacggatagctgacttttttgaacgcttttttgaacgcctttttgaacgccatctgcaaaaccgcccgcaaccgtcgtggaaactgcattacagtagcaaccatgagtgatatgcgtgatgtggtgattatcggttccggcccggctggctatactgccgcgatctatcttggccgcgccggcttcgagccgctggtcgtcgccggcgcgctgacgcccggcggccagttggtcaacaccactgaagtggagaatttcccaggctttcccgatggcatcatgggtccggatctgatggacaatatgcgcaagcaagcggaacggttcggcacgcatatcgtttgggacgatgttgtttcggttgcttcgaatgccgattccggcatcaaaaccgtcacccttgacggcggcgacgtgtacgacgcacgcgcgctggtcatcgcaacaggctcaaactatcgtaagctgggcgtgccaggcgagacggaatacgcaggcaaaggtgtatcctactgcgccacctgcgatggtttcttcttccgcaacaagccgattgtggtggtcggcggcggcgacagcgctttcgaagaagctgatttcctgtcccgtttcggctcgtccgtcacccttattcataggcgttccacgttccgtgcttcccgcatcatggtggagcgtgcgcaacgcaatccgaaaatcgatttcatgcttgacgctgtggtgcaggagattcgcggcgacgagaacggcgtacaggaggtggaggtgcgcaacaccgccaccgaaaagacctctgtaatccccgctaacggcgttttcatggcgattgggcacactcctgccactgcttttcttaacgggcttgtagacgtcgattcagccggttatatcacggtcgatggcgccagcacgcgtaccagcgaacccggcgttttcgccgcgggagactgcgtggatagcgtctatcggcaggccatcagcgcggcgggcatggggtgccgcgccgcgctggatgcgcaggcttatctcgattcgctcaagtaaggctcaaatcgttcaaatcattatcgctcgccgagctcgattggctcggttcgttcagctctgctgctgcataagcaggtcgacgatgcgtttcatatcgtcttccgatttgaacacgatttcgattcgcccgtgcttcttcgatcccttgatggagaccttggtgccgaaacgctgctccagaccaacctgaacgggggtaccagcccacggattgagcttgctggccttcggcttcttgggctggtcgctttcggcggccttcatcgacacgatttcctcggtgctgcgtacggacagtccctcggcgatgatgcgcgtggccagctgttccatatccgcttccgtcggcagtcccagcagcgcacgcgcgtggcccgcggacagcagtccggatgcgaccttcttttgcacggcggccggcaggttgagcaatcgcaaggtgttggcgatttgcggacgggatttcgacaccgacttggacagttgggcctgcgtcaggccgaaatcgtcgatcatctgctggtaggcagccgcctcttccagtggattcagcgcgacgcgatgcaggttttccagcagtgcgtcacgtagcatgtcgtcatcggcggtggttttgacgatggccggaatcgttttcaggccggcgatctgcgatgcgcgccaacgacgttcgcccatgatgagctcgtacatgctatccatgcgcccgtcgaacatgttgtgcggttcggccggtttggctgcggcttccctgcgggcggcttcgatttgcgattgcggacgcttgcgtacgacgattggctgcagtacgccgacttccttgatggattcggctagctcgcgcaggtcgtcttcatcgaaaatggtacgtggctgatgcagattgggaccgacgtcgctcaaacgcagttcaaccagatatccaccctgcacgggaagcagttccggttcgtccttcttatgttcggtcggcgtggtttcacgtgaaacactcccctgctgctcgccctgttcggaagctggctgagcggtggagccgaagaacatgtccgcgggatgcgcgctttcgttcaacgaaatcgacggcatgctggcacgacgatgctggtttttcttggttgtttcacgtgaaacagcatgcttcatcccctgcacggcgttcaccgatgcctgtgcggtagcggacgcgctcttggattccacatgcccatcagtcttggaagccttgacttccttggcggcagcggcaggcgccgcatgctcctgatgctgcggctcccccggaagagaaggaaacagtgcgccaagacctttacccaaacgcgacttagttgccatgatcagttctcattccttcttgcatcgattgcctgcagcaccgtatcggaacgacgcgaaagttccagcgcggcttcgcagtacgcgatcgcacccatgcccttggggtcgtatgcgatcacgctttggttgaagcttggcgcttcggaaatcttcaccgtgcgcggaatggtggtgtcgagcacgattgtcggatagtgcttcttcacttccccatgcacttcgcggctcagcagcgtgcgcttgtcgtacatggtgatgagcatcgtggagaccagcagcgacggattgtaatgttcctgcaccagtccgatggtgttgatgagctggcccaaaccttccaaggcgtaatactcggcctgaatcggaatcagcatttcgtgcacggcgcacatggcgttgatcaccagcagacccaggctcggcgggcagtcgatgatcacgtaatcgtaatgctcttcgctggtggcgaggaactcgtccaccgcgttcttcagcagcgagttgcgatccgccatgtcggcgacctcaagttcggcgccactcaaatcgatggatgcggggaccacgtcgaggttgtcgaaatcagggcacgtgcacttgacttccgcgatgcgcttgcgcccttcgatgacgtcatacaccgaaggctgaccggaggcgtgcggggcacccaatgccgtggaggcgttgccctgcggatccatatcaataagcaggaccttgcatccgaaacgggccaaggccgcggacaggttcaccgcggatgtggttttgccgacgccacctttctggttggcgactgcgatcaggcgcgtttgggccggcttcgggcagaccgcatgctccaatgccttgtatcgcgtcgattcatcagcgatttgcgcgcctacgggggatgtcgagccttcgaagattcgcttgatggtttccgtggcggattccatcgacgtcaaattgtctggttcttcaggtccagtcatgaactagccttcctatacatattcaacaatcaagtttcatcatttgggtggacagattttcacctgttcacggccatgtgcaccattgtgaacaacggtggatagttggtggataactcatccgaccacccaaaagttatccacagaacaatcgttgcaattccaagcttcttcaagatgcttcgtaacacatttccgcgattgtggatactgtggataactcacgcgattttgtggataacttatcgcttgtccaccatcagcacatgcgtcggttccagacccggaccgacctcggcctccaccacgcggggatggataccgccgtttttggagatctctttggtggccttgacgatttcctcctgcgcggatcgtcctttcagggcaaccagccgtccgcctttgtccagcaacggcagcgtccatccggatagtttggtcatcggcgcgaccgcacggcaggtcaccacggcaaacggatgcctgaccgggatgggatttccgtcgagatcgacggcatcctctcccctgcccttccggccaccgttcgaaccgcggacggcttcgattacggcgttggctcgggagcgcactatcgagacattgtccaatcccatttcgtcaacgcactcatgaagccattcgatacggcgttccatcggttccaccaaagtgaactggtggtccggcaggcaggcggccgccacgataccggggaatcctccaccactgccgatatccgccaccgtcttgaattgcctcttggccgttgcttcacggatgaacggtacgatggccgcggagttcagaatatgccgttcccaaataataccgacatcgcgtggccctatcagcccgcgcggctctccttccgcagcaagtttcacgtgaaacaccttcaacttgcccaatgcatcgccaagcacttcctcaagaatcggcgacccatccaattcgtcattcacatcactcatgcacaccatcctaatctacaggcatcaaaaagcgccgcgagaaactcgcgacgcttcatgtttcacgtgaaactatttcaggcttcgtcgatctcgtcggcgtcatcggctgcggaagccttgacgtacaccgtgacgtaacgatgcggttcttcgccatgggaccgagacttcatgccttcctcgcgcaccacatcatggatgatcttgcgttcgaaggagttcatcggcttcaggtccaccggctcgccagtctcgcgcgcctcgtcgatggcatccagcgcaaggtcgtgcaggcgctggcgcttgcgcttcagatagccgtccacgtccacgatgaggtgggaccgctcgccggtcttctgttgtacggcgagtcgggtgagctgctgcagggcgtccacgacttcgccgttgcgtccgatcagatgtttgatgtcggtgtcgtcgtcggcaacgatctgcacggtcggacggttgttgcgcacgcccatttcgatatcgccctcgtagtcgacgatgtcaagcaatccttcaaggtaatcggcagcgatgtcagcttcgtcattgagctgatcgatggttttctcagcatcctgcgccatggtgttttactcctttgagcggggttcgtattatttcaagtctactgaaagtctactgattgggttgtatcatatgggcgattcgcccgatacaaaagcggtgtgtcctgcgtttcacgtgaaacacaggacacacacttgatgttatttcttcttcttctttttgcggcttggctgctgacgctggaagccgttcttttccttcgcctccgcggccttcttggctttctgcagctcctcctcttcgagggacggcagaccggccttggcgcggcgggcgttctcgtgggcgtggtcgcgcttttccttcgcttcggcggccggggatcccggagtcgggaagacgtggatctgccagacggaacgcagcaggttgcagatgttgttggtcaaccagtacaccagcactgcgaacggcatggcgacgccggagaagatgtacatgatcgggaacatccacagcatcatcttctgcatcatttcagtctgcttgttcgcagcgctctgggccatgttgcgcttcatgctgttgtactgcatgagccacaggcagaagcacatcaacgccacgaagatgccgatgatgatcttgccgtggatgtcggcggtggtgaagttctcggccacgttcacgccgaacacgttggtggaggtgaactgcttggcggtggcgatgtcgaaggcgccgaggccggaaccgttcctgaacttgccacgggcgatgtatggaatggccgacagggtgtagaacatgcacatgaacacaggaccctgcacgaacataggcagcatcgacgtgcagccgcccatcgggttcgcgtcgttgtcctggtagagcttcatcatctcgcgttgcaaagcctctttgctggcgggatcgttcttgcccttgtacttgttttggatgcgctgcatcttgggctgcaaaacggccatctgggcctgcatcttgcgcatgcccttcatggacttgtagaacagcgggaacacgcacgcctggaccacaatcaccaggaacacgatggacatgacccacgagaaaccgatctcgttcatgcccagcatcaccatgaatcggtggaatccggccataatctgcgtcatgagccactcgacggggtacaggagcttgtacagccagccccagaaaccactatcgaggaggaattgatcttgattcattacaggccattctccttatcgcctataggttcatctacatccagaggcgtgagacgaggctcctcatgtgccttcgaccacgaacatctgtaaaacaaggaatagagctgtggaacgtcgtcgattcctccacggttccactggttgcaacgaagaaggcgtaataacgcaagaaggccacctttaaggcagccaaatcgttcaatcgcctgaatcgcataattggagcagctgggataataccggcaccgaggtgcggtatgggcggaaatatgtttctgataccagcggatgagccgcaccatccaattgcgatgatgccccttgctcattgccgggaagcggttttacgtttcaccgcttcgaaacacgatgccatctgctgctcaagcgacaggaaatcggcacgtgcggcacttggcttggcacgcaacacgatatcgcaggattcaggtaatagtgattcgtactttcgtgcaagcacacggaaacgccttttcacggcgttgcgcgtgaccgcgttgccaacagctttggaaacggccaagccgacacggcggccttgcaccgtcgctgtatcgcccgttacgacatcgtcgtgcatcagataatgcacgacgatgtcttctcgcgataccctacgacggcgtttgagcaccgcaacaaaatcgcgatggcttttcagccgttccaccgctctatgccactaaaaaatcaggcagcgagggacttgcggcccttggcgcggcgacggttgatcagagcgcggcctgcgcgggtgcgcatgcgctgacggaaaccgtgcttcatgtggcgacggcggttgttcggctggaatgtcctcttcataattaatgctcccggtgtttttagccatgccaaggcacggctcctcatgagtcaagctctactaaattactctgacccctgaacagattgccgcgtcgtccattttcttcacattttcatggggattccccgcataaaacaatccacataatcgttgcgattccgccgaattccccacaaaagttatccacaaactacaacaatgttattcacatttcaatcttttcaacacgcacgccggtggataactcggggaaaagagagtacaaatatacagttgcacatcagtggtacgtctgtcgagaaaggattatccgtggttgataacacgacaacagatcctctcgagcaggctcgtggggtgtggtccgacgctttggccctgctgcaccagaatccgtcgctgtccgtacgtgacaaaagctggctggagaacgtctatcccgaaggcatgtggggtccgaccatcatgctgtgcgtgcccagtgaggcggctcagcaggctttgcagaccgaattgaacaagccgttgatggaggcgttgcgcgaatccgccgaacaggacatcttccccgccttcaaaatcgttgaaatgaagccgaaaacggaggaacagccggaggaaacctatccgcgcttctcccccgcgaaatcaccggcgaaatcccctgcgaacgagacgatgcaaggccagttgccgattcccgcgacgatgccgccggaacaggaccatttccagagcggccagaacaggccgctgctcgaccccgaaacgcatttgaacaagaacgccaccttcgacaccttcgtgcccggcgattccaaccgtttcgcacgtaccgtggcgctggccgtggcggagggttccggccatgatttcaatccgttgtgtatctacggaggctccggcctgggcaaaacccatttgctgaatgccatcggcaactacgcgctggtcaaggaccccaatctgaaggtccgctacgtcaccagtgaggaattcaccaacgaattcatcgaggctctggccgatacgaaccaaagttccggccagatcaaggaattcaaccgccgctaccgcgaggtcgacgtgctgctcatcgacgatatccagttcctgagcggcaaggacgcgacccttgagcagttcttccacacgttcaacaccctgcatcaggccaacaagcgcatcgtgatcgcctccgatgtgccgccgaaggacctgcagggcttcaacgaacgtctgatctcccgcttcgaatcgggcctgaccgtggacgtcaaaccgccggatctggagacgcgaatcgccattctgcgcatgatcgccaccatgaacggctccaatattcccaacgacgtgttcaacctgatcgcggaacggttcaccgagaacatccgcgagctggaaggcgcgctgaaccgtgtgaccgccatggcgtcgctgagcaaccagccggtcaccaaagcccttgcggagcagactttgcaggacttcttcaccaccgacgtggaaatcaagcccgcggacatcatcacgcaggtggccaagtacttctatttgacgttcgacgacatcgtcggccgttcgcgtaccaagaagatcgcgctggcacgccagatcgccatgtatctggtacgcgagctgaccagcatgagcctcaacgacatcggcctggtcttcggcggcaaggaccacaccaccgtgatgcacgcgtatacgcgcatcaacgacgagatgcaggagaagcaggagatctacaactacgtgaccgagttgactctgcagctcaagcagcgttccaacgacaagtaacggaagcaaccacaacaaacggcgtatttccaacggtttccttaggctggtaaattatttaccagcctttttactatccgcgtgacacgcccggacagaatttcttgtacatcgagttttccacatacatatccacatttcggggaaaggtctgtggaaaagccgttggaaacacggaaaacggcagtggatggctcgtggattattcacagtgaattgtggataagttttgcgcggccatgagcctgtggataacccatgctcttatccacattcgactcagaagttatccacagatgtcgcctcgtactgagacgttgctgcgcttgggctgaacgagcttatccacactatccacagggcttattattacgaaagtacgtttttcttactttcatcgtcattctcgtaatgcggggaattccccacgctttcgtcgtcgttgctcttatcgctagaatggcatgtgaatcgaacgaaacgaggaataccccatgaaagtcgaagtcaattcccaagctcttgccgatgccgtggcatggaccacacgtgtcatcgacgcacgtcccgcaaccccgattctggcgggcatccgtctggaagccattgacggcacactccagctttccgccttcaactacgccatttccgcacgccaccacatcgaagccggcgtggacgaggccggtagcgttctggtgctgggcaaactgcttgccgacatcaccaagtcgctgcccgctgcgaaaacctatctttccactgatggttccacgatgaccatcacgtcgggcaagtcgaccttcaccatgcagctcatgccggaaagcgaatatccggatctgcccgtggtgccgacgaaactgggtcaggtggactcccccaccttcgctcaggccgtcaaccaggcgtccgtcgcggtctcccgtgaggagaaccgtccggtgctcaccggcatccgcgtccagttccagggcgacaaggtcatcatgagctccaccgaccgtttccgtctggcccgttccagcttcacctggacgccggaggatgcgaccatcagcaccaccgctttggtccgtggctcgctgctgcgcgacatggcgcgttcgctggacgagcatcagaacgtcaccatcgatttcgatgcggacaacccgtccctgctgggtttcgagaacgccggccgcgtgtccacctcccagctcatcgacggcgaattcccggccgttgaccgcctgtatgccgatgaatacccgattcatgccgtcatcaacaagcaggccctcatcgacgccatcaagcgcgtttcgctggtcgccgaacgcaacgccccgatccgtatggtcttctctggccaggagctgacgctgtcggccggcaccgccgacgaagcacaggcgaaggagattctcgacatcgacatggacggcgaggacatcaccgtggcgttcaacccctcctatctggtcgacggcctgagcgccatcagcgagccgttcgtgcgcatgaagatgaccaccgcggtcaagcccgtggaattcaacggccagcaggaagcggattccgacgaatccatggactaccgttacctgctcgttccgatgcgcttcaacaactgatttcgttccacctgtggcccggacggcaagttcccgtccgggccaccatgccatcgccttcaaggaatcccggttttcatgcatatctcccgtctcgcgctcgaccattaccggtcatgggaccattgcgtgcttgatttcgaaccgggaatcaacattctccaaggctcgaacggcctagggaaaaccaatatcgtggaagccgtggaagtgctgtccaccggctccagccaccgcacctcgtcatcgctgccgctggtcgaaaaaggccacccttccgccactgtccgggccaacgtcgaagatgcgggcgaacagcgcacatatgagatcaccatcgccgcgcgaggcgccaacagggcgcgcgtggacggcggaaaatcgcaatatatgagggatatcgtgggtttggtcccctccgtgtcctttacccccgaagaccagcggttggtgtctggcgatccggccacccgaaggaacttcctcaaccaggcggcttcgctgctgttgccccgttatgcgcagtcgttgcaacagttcacgcacgttgccaaacagcgtgccgcattgctcaaacagctgtccgacggctccggcatcgaccccgaatacgggcgtcaggccgtgctgagcggtctggaagtgtggaccggccaattcatcgccctcggcgtgcaattgaccaaggaccggaacgatgtgatcggactgctgcgcgagccgttcacccgcatctatgcttcgctggcgggcgaagaggaacaggccgacctggtgtatgagccgtccttcgacgaggtgcttctgttcgacgagccggccgcggaaatcagccgtcatttccaacgcatctaccccggcgaagtggcccgtgggcagaatctgatcggaccgcagcgcgatgatctgacattgcggctcaacgacatgccagcccgcgaattcgcttcgaacggcgagatgtggacgatggcgttggccttgaaaatggcgctgtacgaagtggtttcggcgcagcgcgacgtcaagccgatcgtgatcctcgacgatgtgttcgcccagctcgacgagtcccgtcgcgggcagatcctcgacttcgcgcgacggcaggaccaggtgctgatcaccgtcgccgcggcaagcgatattccgcaaggcgaggcgcatgtcatcgacgttgccgcgctgcgtgcgcaatcgcaggagacggacggcgatatcgcggcgatggcggccatgcttgccgccggacgtggcgcgcaatcgcaaggaatcgaggccgaatcctaatgccgaaaccaccaatctgcgaactgctgaacctcgaccaacgcaaactgccggccgaagtgttcgaccgcatcagcgaccgtgccgggcggctcaaggaacgcgaggaacgcgcgcgcaaggcgtgggaaagcttcggtaaacccggacgcgatccggaaaccgtcggcagcctgttcaatctgctggcatcgaacggcgcatggatgccccacctcaaaatggcgcagatgcgcgaccattgggaccaggtggtgggcgtggaaaacgcgaagcactcctaccccgccagcctgcgagacggcgtgctgacgatacgttgcgacagcccggcctggaccaccaccctgtcgtatatgacgccgttgctgacggacaccatccgcaggaaactcgaaggtctgaccatcaatgaggtgagggtcaccggcccgcagagccaagggttcagccgtgggcgtatctcaaggaagattcgctactgagggctattgcgaagtcgacttacaatcgacctctctgacaggagagatcgattgtggcgcgcgtgaaacaggccgttgcgacggggtttacggaggttttccggctcgtcggacgcgttcggaaccatgccgaagccgttgaaaaccgttgaattccaaggacaaatgtctatagcgcgctgtccccctccatgagtagaatatccagcagtgtatgtaaacgcctagaaggggcctttatttgcgttctaggtggtatcacctgcggaaatgacccttgatggcgggaaaaatgcaggaaggaatctctgtggcagaccttgatgcggattcgctgaacgaatcagctgaaaacacgcaggaagatcagattcaggatcagatccagaacgaccagctcgaagatgcgcaacttgacgattcgctgtctccggaacactacgacgcgtccgatctgagggtgctggaaggccttgaggcggtgcgtatccgcccgggcatgtatatcggctccaccggcccccgcggcctgcaccatctggtgtatgagatcgtcgacaactccgtcgacgaggcgcttgccggctacgcgtcgcacatcgaagtgacgattctgccggacggcggcgtgcgcgtggtggacgacggccgaggcatcccggtcgacgaagtgccgggcgaaggcatctccggtgtcgaaaccgtgatgaccaagctgcacgctggcggcaagttcggtggcggcggctacgcggtctccggtggcctgcacggcgtgggcatctccgtggtaaacgcgctgtccacccgcgtggacatcgaagtgcgccgtcagggcttccactggacccagacctacatcgaccagaagccgaccgcgcgtctgctcaagggcaagccgatggaggaaggcgagtccaccggcacttccgtgaccttctgggccgacggcaagatcttcgaaaccaccacctacgatttcgagatcctgcgcaaccgcttccagcagatggcgttcctgaacaagggcctgaagatctccctgaccgacctgcgcgagcccgaccaggccggcgacgaggtttccggcgaggaatccgaaaccgaagacaagttccagaccgtcacctaccagtacaacgacggcatcaaggactacgtcgactacctggtgaagtcccgcaaggccaccccggtcgaaccggacgtcatcgacttcgaggccgaggacctgaagatcggcatctccgcggaaatcgccatgcagtggaccaccgcgtattccgaagccgtgcacaccttcgccaacaccatctccaccaccgaaggcggcacccatgaggagggcttccgcgccgcgctgacctcgctggtcaaccgttacgcccgcgagaagaacatcctcaaggacaaggacgagaacctgtccggcgacgacgtgcgcgaaggcctgaccgccgtcgtgtccgtcaagctcaccaacccgcagttcgaaggccagaccaagaccaagctcggcaactccgaagcgaagaccttcgtgcagcgcgtcatgaccgacaagctcggcgactggttcgacgcccacccgaacgaggccaagaacatcatccagaaggccatcgaggcctcccgtgcgcgtctggccgccaagaaggcacgtgagaacacccgccgcaagtcgatcttcgaatcggccggcatgccggacaagctcaaggactgccagtccaacaaccccgaagaatgcgagctgttcatcgtggagggtgattccgcaggcggctccgccatccagggacgcaacccgatcacgcaggccatcctgcctctgcgaggcaagatcctcaacaccgagcgcgcaagcctggaccgcatgatgaagtcggacaccatcgaatcgctgatcaccgccgtcggcggcggctacggcgaggacttcgacctcaacaaggtgcgctaccacaaggtcatcatcatggccgatgcagatgtggacggcgcgcatatcgcaaccctgaacctgacgctgttcttccgttacatgcgcccgatgatcaccgccggctacgtgtacgtggccatgccgccgctgtaccgcctcaagtggaccaagggcccgcacgacttcgtgtacaccgacgccgaacgcgaccgcgtgctcgccgaaggcaaggccgccggccgccagctgccgaagggcgaaggcatccagcgctacaagggtctgggcgagatgagctaccaggaactgtgggagaccaccatggatcctgaccatcgcattctgaagcaggtgcagatcgaagacgcggccgcggccgacgagaccttctccatgctcatgggcgacgaagtcgaaccacgtcgtctgttcatccagcgcaacgcacgcaacgtcagctggatcgacgcgtaaacgcgtagggtttcgcaggacttcaaagcaaggattagaaattggcagacgaaaacaacagcaacgaagacggccagttcgtgcctgacggctccatggaaccgttgagcccgcaggaggccgacaacaccgattacggcctgatggtcggcgaacgcgtccagaagaaggatctgcagcaggaaatgcgcgaatcctacctggcgtacgccatgtccgtcatcgtcgatcgtgcccttccggacgtgcgagacggcatgaagccggtgcaccgccgcgtgatctacgcgatgtacgacggcggctaccgccccgaccgcggctactccaagtgcgcacgcgtcgtcggcgaagtcatgggcaagtaccatccgcacggcgattccgccatctacgacacgttggtgcgtatggcgcagtcgtggtcgatgcgatacacgctcgtcgacggccagggcaacttcggctcccccggcgacgacccggcagccgcaatgcgttacacggaatgccgtatggcgccgctcgccatggaaatggtgcgtgacatcgacaaggacaccgtcgatttcctgccgaactacgatggcaagacgcaggagccgaccgtgctgccggcccgcttcccgaacctgctgtgcaacggctcgtccggcatcgccgtcggcatggcgaccaacattcctccgcacaacatgcgcgaggtggcagaaggcgtgcattgggcgctcgaccatccggacgcgagccgtgaggaactgctcgacaacctgatccgcatcatcaagggaccggacttccctaccggcgccacgattctcggccataagggcatcgaacaggcgtaccgtaccggccgtggcctcatcaccatgcgagccgtggtgaacaccgaggagatcaagggccgcatgtgcctcgtgatcaccgaactgccgtaccaggtcaacccggatcgtctggtcgtgtccatccgcgaagcggtgcgcgacggcaagatccaaggcatcgccgacatgcgcgacgaaacctccggccgtactggccagcgcctcgtgctcgtgctcaagcgcgacgccgtgccgaaggtcgtgctcaacaacctgtacaagcattcccagctgcagcagaccttcggcgcgaacatgctggcactggtcgacggtgtgccgcgcacgctgtccctggatgcgttcatccgtcattgggtaaaccaccagctcgaagtcatcgcacgccgtaccgcctacctcaagcgcgaggccgaggaacgcgaccacatcctgcagggctatctgaaggcccttgacatgattgatgaggtcatcgccctcatccgtgcctccgagtccgcggagaccgcccgcacgggccttatggacctgcttgacgtggacgaggtgcaggccgacgccatcctcgccatgcagctgcgccgactggccgccctggaacgtcagaagatcctcgacgagcacaatgagctcatgcgcaagatcgccgactacaacgacatcctcgccaagccggaacgccagcgcaagatcgtcggcgacgagctggacgaaatcgtcgccaagtatggcgacgaacgccgtaccaagattctgccgtactccggcgagatgaacgtcgaagacctgatcgccgaagaaaacgtggtcgtcaccgtgacccactccggtttcatcaagcgcaccaaggccgacgaataccgcgcgcagcaccgcggcggcaagggcatcaagggcgccaagctgcgcgaggacgacgtggtggaccacttcttcctgaccagcacgcacaactggctgctgttcttcaccaacaagggccgcgtgtaccgtctgaaggcatacgagctgccggaaggctcccgcgattccaagggacagcacgtggcgaacctgctgcagttcggcccggacgagacgatccagaccgtgctgtcgattccgaactacgacgtggccaagtacttggtgctcgccacccgttccggcaaggtcaagaagaccgcgctcgccgaatacgactccccgcgtcagggtggtctgatcgcggtacgactcatgaccgacgagaacggcgagaacgccgacgagctgatcggtgccgcgctgtgcaacgccgacgacgacatcatcctcgtctccaagcagggcatgagcctgaagttcgaagccaacgacgagcagctgcgcccgatgggccgccagaccgccggtgtgcagggcatgaagttccgcgacggcgacgagcttttggccatggatgtggtgcagggcgattccgacagggatctgctcgtggtcaccaacgagggcttcgccaagcgcaccgccatcagcgaataccgtctgcagggccgtaacggctacggcgtcaaggccgtgcagctcgccgaaggccgtggctccctggtgggtgccgtgatcgtggaggaatccgaccagatcatggccatcatgaagtccggcaaggtcatccgctccaacgtcgccgaagtcaagcgcaccggacgtaccacccagggtgtgacgctcgccaagcctgacaagaacgacgaaatcatctccatagcacgcaacgaggagaccgacgaggatgacgccgagcaggccgccgcggaaaacggagcagtccagaacgacgcagccacgcaatcgcaagccgaaaccactactgaaaactccgctgaaaccggtacggaagccacttccgatgccggcgatggcgagaatgtagaggcctgagacacaggcggggaatcgtctgcgaaaactggtagcctcggctagaagtaggcaagattctgcaaggagcaacgatgagcgagaacaatgaaagccatcaggcgcaggcaggggcgcaggccccacgcgtggcccgttccgcatccagccagccgttgagcggtacggaacagtctcaggcgcatgagaacatggccgccgcgtccggcggtgtgaaggttcgtgaaaaagcgcgtcgtggcgcgcctcgcgcccgccgcatgagcctgtccctgacccgcatcgacgcatggtccgcggccaaggtggcgttcatgctttccatcgcgggaggcatcatccagatcgtcgcggtgacgctgctgtggctgctgctgaacgtggtcggcgtgttcgatcaggtgacgcagatcgtgtcctccaccggtcttgacgccggcggattcgaccttgccaacgtgctttcgctgagcaccgtgctaagcgcggtcaccatcttctccatcatcgaagtggtgctgttcaccgtgctggtggtgattctcacgctgctgtacaacgtggtgagcacgctggtcggcggcatccacgtgacgctcggcgacgactgatcgattcgtcatacggcgttcgtacggcgcttgcgcaacgtaagccgttcgtgcaacataagaagacggcgcttccctacttcgggaggcgccgtcttttcttatgtaatcgcgattatgcggtcgcttttatgcaatcgtcatactgcgttgcgtgttatgccgtaaacgcatatgaaaacggtccgtgcgaacgaatcgcacggaccgttgaaacggattgtgaaagacgatcagagcacgccctgggcgaccatggcgttggcgaccttgacgaagccggcggcgttggcgccgagcatcagatcgccctcatggccgtactccttggcggcggccagggaattggcgacgatgttctccatgatggacttgagcttgttgtccacctcttcgaacgtccaggaaaggcggtaggagttctggctcatctcaaggccggacacagccacgccacccgcgttggcggccttagccgggccgtacagcaggccgttgtcctgatagacggcgattgcctccggggtggacggcatgttggcgccttcgcacacgaccttgcagccgttggcgacgagggccttggcggactcctcatcgatttcgttctgggtggcgcacggcagcgcgatgtcgcacggcacggtccacacgcccttgcagccctcgtggtattcggcacccggaacacgctcggcgtattccttgatgcggccgcggtggccgagcttgatgtccttgacgatgtcgagcttgatgccgtccggatcgtagacgtagccgttggaatcggaggcggtgacgaccttcgcgccgagggcctgggccttctcggtggcgaagatggccacgttgccggagccggagatgacgacggtcttgccttcgaaggaatcgttcttcaggacgcgcagggcttcctgggtgtagtagcacaggccgtagccggtagcctcggtgcgagccagggagccgccgaattcgaggcccttgccggtgagcacgccggagtattcgtcgcggatacgcttgtactggccgaacaggtagccgatctcacgggcgccgacgttgatgtcgccggccggaacgtcggtgaactggccgatgtgacggcacagctcggtcatgaacgcctggcagaaacgcatgacttcggcatcggacttgcccttcggatcgaagtcggagccgcccttgccgccgcccatcggcaggctggtcagggagttcttgagaatctgctcgaagccaaggaacttgatgacgccctcgttcacgctcgggtggaaacgcagaccgcccttgtacgggccgatcgcggagttgaactggatgcggtaaccgcggttgacctgcaccttgccctcatcgtccgtccaggcgacgcggaacttcaccacgcgctccggctcgacgaggcgctcgagcacgcccgccttctcatattccgggtgcttctcaacaaccggctcgaggctttcgaagacctcgcgaacggcctgcaggaactccggctggtcgccatcgcgcttctcgacctgcgcgtacacgcgcttgacgtactcatcagtgagcatatttttccccttcgggatagttgggttatcaatacggcggtttcattctatgtgcttgattgtgagacgcacaagatattgctcaagatttggctggagcgtgcggatataggatggattcgggcatgcaagagagacacgtccaaagagagacttgtccattgacgcgattcacggaatcgcgaatgcagaacaggagcaaaaatgttcgaaggattcaagaaattcatcgcacgcggcaacatgatcgacatggccgtcggtgtcgtcatgggcggtgccgtcaccaccgtggtcaacgcgatcgtcaacagcgtcatcaatccgttcatcgccatgatcttcggcaagccgaacatggatggtctgctggcgatcacattcaacggcgcgaccgtttcgttcggcgcagtgctgggcgctattctgaatttcctcatcatcgccgtcgccgtctatttctgcattctggtgccgatcaacaaattccgcgacatgaccgaggcgctgcttgccaagaccaagcttgccgagcagaaggaagccgaggaaaaggccgctgaagagccgtctgccgaagagcagaccgtccagctgctgcagcagattcgtgacgagctggccaagcagaacgcggcccgcaactagttgcgattcgtggtgccactcccctattgatttgatgattccggccgcttgcgggtatgcaggcggccgttttatttggtttgcgggcgatcgcgtccgttggatggtcgacaagaggctgaatacgaaaaaggcttccgattactcggaagccttcaattctgtggagctaaggggattcgaacccctgaccctctccatgccatggagatgcgctaccagctgcgccatagccccgtggagctagccgggttcgaaccggcgaccctctgcttgcaaagcagatgcgctaccagctgcgctatagccccataggtgaaaaaagcggctatgccgcttccttaccatctacgtgggcccgggaggacttgaacctccgacctcatccttatcagggatgcgctctaaccacctgagctacgggcccaacttgctgtgtcttgaacacaacgaattgaaatgatacttgaatcacagggaaagtcaagtgccgccgtgtcatcggcgtgtcgtggcataatgcaggcatgacatacgggcagcgtaacggcggtaacggccgttacggcaggggagtggggcatcgcaaccgcaatcgcgtgatttccgaaacgacggcgagcatcgccggcatgcgggtggccatcgtgcgcaaacccatcaaaaacatgtacctgcgcatcaaaccgccgaacgcggatatcgtcatctccgcgccgcaacgaatgtcgcaaagcgctatcgaacggtttgtgacggaacgcaagccgtggatcgaacgggcgcaacgcagcatgcggcaggccagagacgcgcaactcaacgcgcagcgtgcgcaaaacggcaatattggcgatactggcgcttccgccaacccgcccgctttcgtatggacggacgaggccaaggcgcgggcgcaacgcaacatcgaatcgcaattgcctgtgttgcttgccaaatggggcccgatcgttggccgtacgccgacgcatatcacgttgcgtctgatgagttcgcgttggggatcgtgcacgccgaagaccggacgtatccgacttaacctgcagcttggtttaatggcccctagattcctcgaatacgtgctggtgcatgagatgacccacctgtgggagaacggccacggagagggctttcaaaggcgtatgagcgcctatctgccgcaatggaggcagttacgccgcgacatcaaccggcaggtggtgctgtaagaggctgctcgggttacttgccgtccgccgcggaatcgccagccgcggaaccgtcctcatcggcggtgtgccgacgcacttccagcgtttcgatacgacggccgtccaccttggtgacgaccatgtcataaccgtcatcggacgacagcacgtcgcccacttcgcccattttgccggtgtgcgccaggaaatagccggcaaccgtctcgtatgggccgtcttccagctcgatgccggtcaaatccgcgaaatcctcgatcgtcatgccaccttcgatggtggccacgccattgacgaaagcggcgcgttctgtgcgttcaccgcccttttcctccggcaggtcgtattcgtcgcggatgtcgccgaccaattcctcggtcatgtcttccaacgtgacgatgccgtcggtgccgccgtattcgtcgattaccacggccaggtgaatgcctcgtttgcgcagcagctcaaggcttggcagcagcttcgacgtgcccggcagggaaatgccctcacgcgtcacgtcggcaacggttctcgccttcggatcgcggatgtcaagcaggtcgcgcacatgcacgaagccgagcacgtcatcgaaatccttgccggtgacggggtaacgcgaatacggcatttcacgcacgtacgcggcggcttccgcaatcggcatggagccgtccaggaacgcgacgtcggcacgaggacgcatgacctccgccacgatggtttcggatgcgtcgaacacgtcgtcgaggatggtgcgctcgtccttgctgaggttggtgttggtgttgacgagcacgcgcagctcgtcgtcggacacctcgctgtcggtttcgttcggatcgaagccgagcagccgcacgatgccgttcgtgttcttgccgatcagccagatgatcggcttgcacactttggcgaacacatggatggccggcaccacggcacgcgcgatctgctcgttgcgttgcatggcgatacgcttcggcaccagttcggaaatgacgatcgagcaatacgagatgatcagtgtcaacgcgatggtggtcaggggagcggcgacgttatgcggcacaccccagtcttcgatgaccggcacgatatacggggcgattgaggattcgccgaacgacgcggacaggaagccgcacagcgtcacgccgatctgcacggtggacaggaacgtgttcgggtcgcgtgcgatctgcgccacacgcttgccgcgcgcatcctcctgttccatctggtcgatctgcgatccgcgcaggctgaccagcgccagttcggtgccggcgaacacggaaccgagcagcaggaaaatgaaaatcagaaggatgttcaaaccaagcgacatgattccaatctaaagcaacggcatgtcaaaacagcgcgacgcaacggatccggaagccgtctttttccggaaaatcgtcagaagctcagcacttccaccttgccggtgtcgagctggtagcgtgctccggtgatcatcagccgatcctcggccagcgcgtgctggatcacttcggaacgttccaccagctgttcgatggtgcgtgcgatgtgcacgcgctcgaaatcctccgccgattccagttccgattcgtgcgcctgccaaatcgaaaaaccgaccgtgcgcagcatcagcgattccgcgttcataatgcgttcgtcgatgtcggcgatgctgtcggcggccatcagcgaatcctccgcgtcggcggtcaactcgtgcagcagcgcctcgtattccttgcttgcctgcttgatcgcaccgcaattctgatggccgagtaccaccaaaagccgcacgccgagcacgtccaccgcgtattccaaagaggcgatcacagcatcgtctatgacctgccctgccgtgcgcacggtgaacagatcgccgatgcctgcgtcgaaaataatatcggggctgacacgcgcatcagagcagctcagtatggccgcttccggtgcgtgtgtgtccacaagtgcctcgcgtgcttcagcgccacgattcggatgttccggtttgccctccgcaaacctgcgattacctgccagcatgcggctccaaacgccgcttgccgtgccttcgacctcgtcttggtctacaaacagttcgtctgccattgactccacccctcattgttcaggctagccaacatcatacgttttggtctgaccgttcgctgggaaatagagcgatatctcgcttatgtatggcagatttcgtgttctgtccggtgatatttcgcttatgtatggcagtcccaaaggtgaaaaaccggaaaaatgtacccccgaagtgggtttttcgcatgatggtctgccatatataagcgagaaggctcatgacaaggctccgattctgccatatataaggcagatataggtatgaaaaagggtccccgatcggcagtgcgaacggggaccctgaaagaaactggctaaaatcagccggtgttctgcaggcctgctgcgacacccgacacggtgcacaggatcaggtaggtgttactgcagtctgcagaagatgaaaagaataagagctaaaacaagaaaggcggcaccgcttattctcattaaggatgtgtatagattgctcggatctcctttttgagtccagaggaaattgcttattttccagagttgccttggaaaaataagcatacataatcctagcagggcaagtgctgtgagatatatgtactgcactgttctccttattttaggtagtcggagatgcaagggtatggtccttgtttatttattccgttgcttgaatctttgaagaaatcgatactctcaaatgtaatccctttatattgcttcacggtaattactttaaaatgaaggttaattctgtcttctttcttgtacttgctggtgatatttccattaaatttccattcaatatatttgttgtctaataaaaagaagagtgatgtattgttttcattgggattgaattgaattttatctatggtatcttcaaaaataatatcatctcctgtattgtagtcgcgaagataatcgactgatataccacttttttcgtcataaaattgattgttaagttgtttgatgtcaagggttggggcttttgttgttcttggttgatctgggttggcgttgtatcggaacgtggtgccatcgttagccaggtagtcgattagattggtatttgggacgtcgatgatcgttggaagacttcttccattgccgtaatattggcggtaataacactgccaatttttcccgctgtcatcttcggtgaaacgagcgtcccatgttccggtgccatcgctgcttgatctggtgtatgagacatactggtttgtccctactgttttattgataacccttttgcctgaggttgtggacaaggctagaactatattggctccaaaatcgacggggttagctctatgcgcgtgcatttcgaaactggtcacacggctggagacttgagggcgcatatagaattcgcccccattggtgccattgttgaaaacaatggaaggtgaaaccatataggtggaatattgatcatttgaactttgcccatcgagattgactacccggtcgatgacgttattggcgacaatccatccaacctgtcaccaatttacagcaaaggctggagtggtcataactgtgcataggcaaactgagataattgtggagaataaaaaactcttctggatttcataatttcctccatgtgaaaatttaatctcaatcgacaatgattaagatattaagagtattctaatggaaaatgagtaggggtgcactttagggtgtgattttctagtgaaaatagcaaaggttctctctcgtggaagttacaaacgagggcttcgctatgtgtctgtgtttcaggagtcatgcagttgttactgaatcatgagtggattgaggataagtatgctagtgctgcatgttaggcgctgaacaaaaaccttcgagtgcggcgtcttccgtcaacaacacaactcgttcagaaatacacccaatatggtcaaacagtaagacagcgctatgatgcgaacaatcttcttccaagacagtttgtcatgaaggaaagccgtaaccaaaagggttgtcattggggttataagcaggacgaggaagaaatagagaaatgtggactaggctcaatctgataacgtccgaattcctgcgcactttcggttttgttcttcgttgagatgttgaatcggctcgtcaggcccacgaaacgtatgattcttgctgtgggcttcggcatatgcctgtgccgccgactccttcgcctcgctgatctcgccgttcgccgtggtcaggtcgctcttggtctgcgcgatatccttccgcgcctgcgacaggtcggattgcgcctgcgcgagcgacttggacgccgaatcaagaccagtcctgttggcttggatgttcttctgcgcctgcgtcagcttggccgtattatcccgcaacgtggcgttggcagagttgatggccgactggttcgccctgatgtcagacttcgcggattcaagctctttcgccgtggccgactgcgcggcctgattcgcggcgatatccttccgtgcctgcgtcagcttcgcggtgttatcccgcaaagtctccttgttgtcagccaaatcctgctggattcgcttgacctcctccggcgacacggcggaagccacggtgacagtggcgactaccgaccagtcggatttattgcccgcatggtcgatagcacggaacgcatatgtgtgcgaagagccagccgtcaaaccagtaatcacataatcgccgataccggtcgcgacggccgcgatctccttgaaaacaccatcagccaaacgttcgccgagaatattcctatcccaatcgataggcatggaaccaccatcagcggtttttccatcccaattaaccgaaaccacgcccaactcggaagaaagaatcggcttggatggtacaggaggaggagtcgtatccttggcgacggtcaacgcgaacacgctggaccattcgcccatctggtcggaatacgatgggatagcacgcactctgataagaatctgaacaccgcaatccagattcgaccaagataacgtatgctcagtggtcgtgccagcggaatgccactcatacccagtcttgttcacacgatattcgaccgcatacgacgtgatgtccatggcggtgccatcagtagccaacgtcacatcatcccaacgggccgtaaccatgccacgcgcatacccgttcacattgatataagcgtcggaattggccgacagattctgcggagccttcggcacacgatggtccttttcaggagccggaatcgcaccggacgctccaccaagatgagcgccgccagtaataccgttcatacgcttcgtcaaacgaaccgaggaatcataattcttatcgttcagaatcagcgaagccttaaacccagtcgagtcgagttgcaaagtgacctgttggacacggaccttctcacggttcgccactgtaggcgcggtaatccaatcgcctatcgtgtaatcgatgagcggcagacaagacgcttcgaccacgttcacggatcgcgtgtactgtccgcgaaccctagccgcgttagccaacgtcggcttgatgagatgttcggcggtctccttcttgttcacaccctgttggcttgaatacaattcccaaccgccccaaggcttcggggcgttcggattatcctgccggaaattaatattgtcgccacgtacaaggatcgaggaagccagaccatcaatactctcatcgtcaggagcttcggacacatcctgagcaagcgtcaccacacacgatttagacaagtcacggcatatggcgacactatccgcgttccataacagcagttgccgggcatcagtacgccaatcgcataagccgttgttcaccagcgaatccaacacgtcctgtatggaaatgccaagatcgtaatatatgctcggcagcatgtagccccactgtttgccagcggaatcggcactagaagtgaaccggctgcaatcaactttcacgccgccacgattccaattctcatccatgaacgtgcgcatgatcgtgccagcgttcgcgttcgcgaatttacgggtgcctttctcgtcgccgctggtctccaatctggacgtgtccagattcaaagccttcttcaacagccacccgtaggaaacgccggtcaacgacaccgtgtcggacacgtccaaagcgttccttgaacgtgaagcgataacaaaccggccattatacggttcaatccagcgtccaccatcagacacttccacggcgatttccaagccggtttcaagacgccggtcaagaatctcaccacgcaaagctttacgcgaatagctgacggtcaaagcacctacagcatcatgagtgaacgacacagtataggaagtcggctcaggcagcaatccaagcttgcttccattggcctgatatgcgacaagacgagattttagagtcttacccataagcatccctcaacttaaaaagaaagaagccagtggaaatcaccaccagcttctcttaaacctgcacgccacattcccggaaccagtggccttaactgcaatcctgtagtcaccagaaacatcaggattgacttgcaacctaccggaaggcagataatccaatccgactgtctcgttctgagaaccgccagaccatgcggaatcactatcggaactccatgcagtcaacgatcccgcatccaaatacaagtaaggccgagcatccacgcgcgtgccagaccatgtgataccggtaccggataccgtatccttcaccgttatgcccgtaacatctttcgggaaacgaaacaccatgtctgttatgggagcgtcaccgcaactatacggaagttgagtggaaagcacactcggactagcgttcggaacgccctgccagaacgtgtagtatccggcggacggcatcaccgaaccgccggacatgaccttcccaccgttcaaaggcagtgagacggtctcatgcgtgacggaacgccaccacacgtcaggcatggcgaacacggcagtgaacggaacaaacctgttcggatgactctttgaatcgtcaggactcaaagaggtcaactcgacacgggtacgctgctcgacaccatcgacaatccgactcatgacaagattcggcatcgtgcacaaccgcatcagcctggatgattcaccaagcacatcaggctcccaagcgcatacctgcaacgacaattgacgttccgaaaacctaggcgtcatgccggaagggatagaaccatgccgttgcggaaccgtcgaaacggtacggtcaacactgatggcgctcaacaatgtcgaaccaacagtaacgatgcagttctccgaatcaagaggaacattattcaacttgtagaaacacgtggaaaaagccacgatactcccctctcacatgccgatcatcgcagccttgtccaacttctgattcgtctgaaccgagattggcgtgatagtcggatattggaagttctgcgtgatgttgtatgtagggccgctttcaaacttgacatcgtcggaagaacctgccgaatagtcagaaaccatggaaggcatcgaaacacgagtcatacgacgcgcgttcttcaaatactggcttggaatgtcgccactcgcattgatggcgctcatcactcccttgccgtacagagcctccatgctatgcactgcggcggcacgcacaacatattcaccggtggacacgtcagtggaatcgttcaaagcgatggaatcgctcgtgttcgttccgcgtccgacgatcctgccggtgcgagtcacattatcgccctcgacctcaccgcctgtcgcacgccttctcttggttccgaaaatagcgttgaacgtcctgctcgcccaacttctgccctcggcccacaaagtgccgagcattccccagaaactaccggaaatatttccgccgaactgtgcgttatacgtgcttccattccattggttcgcggtgcgctcagcactgcgtttcgccggctgggtgttgtccctcgcgccgagtgacgcggtgggtctcaacgaaccgtaggcgttggcgtcgcctttcaaatagtcaatggtcatcgaagcaagatcggaagccttcagattggtcgtatagccattgccatcagtgcctttcttgaacaggtcggcatgtttcctgacctcatcggtagcgacaacggcctgattgccgtctgcgtccaacacgatggtgtatttgcctgaaccgtctgtgctcgcattgttcatgagattgttcacggttgattgaacctcatccgcgctggacaatgctccgctgttgatgccgtcaaggaccgtggtgaagatggccgtattgccctcgccggggaacaatgcccgcaaatcagacaagtaggatgtcagattctgcttcgactgttccgtttcggtcttgaacaatgtcttgacctcttcaggagtcaacccatacagttgttgcagtttctgaatctccgactccggtacgcccatcgccttcgccgtctcgtagaactgtgttgacaattcctgctgtttcgcattcacctcatcggttgacgcgccggaagcgaccaactgttcaagccaatcatggcctgtcgtagcgagattctgcaagctggtctgagccaactgtccagcctcggtcatgttattgaacgagtctgcggcactgtcccaaacgttctgtacgcccaattccttgatgcgttggatggaatcacccaaaccgttgtaaatctgaccatattccgttgcgacactcaaagcgttctgctgcgcggtacgctgattgttgacaatgtcgttgtacttctgtgcggcactgttcaacatctgctgacgttgagattgagtcgcaatggcgatggaaaccgaatcggaatcctcacccatctcgatcaaactcttcgcatagccggcagcatgaccattcgcgacggaagtcgcttccgcattatcgatgtactgctgacgtgccttttccattactgctataagcttcttggctgcaccagcttcattaccgtaattctgcgtcgcggtagccgaataagtgctgtgagcatcatatgtggccttcaactgattcatcatcgagttgtaagccttcgtactgccgctcgcagccttgctcaggtcagtggtcgaaacaccaagcttgtcggcggcttcggcagtattcttgaatccagttgtccaatcatccaaccagctccaaccagtctcagcataattaccgtccttgaacgcatcctgaatcgcggaagcgacattggataacgcgccggaagcttcggcggccgaatcaggaatcttacccaacgctgccgcaatattctcggaagcacgctcagtcgcctgagctttcgcattgtaatcggaatacgctgcgactgctgccgtaatggcagccacgccccaagtcaccggattggaaaccgtagacgcaagcatcccacccaaaccagacgcaacagccttcaccttgcccatcgcgccctcagcagagccgacattcgacacgaacttagaaacagcgggattagacgccgcccacccctgagcgacattcttcaacgtcacaccagtaccggcggaagtcacgcccaactccatcaaagccttctgccattgcagcgacttcatcgtgttctcaaccacggcaagcttcaccgtgtccaaagcggtcttgccagccttgccgaacgtggcgaacacgcccaacgcggcctgaatcggttccggcaacgcgctgaaagccttagccacagcctcggcggcggtagcgatagcctgaatcagcggagcagaagcacgaagagaagcagccaatgtgccgccgaacgtcttagacagttgcccgacagtcgaaagcagctggctgaacatcggactcacatcgccaacagcgttgaacaccttctggaaaccatcggaaacaccagacgagaaatcggaaataccaccgctactgttcttcaacaggcggctcacattcttcgtgaacgaagcaatcgtcctaccggcatcaccgaaaacatttcccacggtatgccgcagagaatagccagcgtcaccaatctcggagaatgaatcacgcatcgcggactgcgccactttagcgccaacggcccacgacttcaacgtgtcttggaactttgccgaattgacagccttatccgccttctgcaactccttggagaagctttggatgccattctggtcctcagccaaagcggaatacaagccggaagcaatacccatgagcgctttcacggaattcttcaaatatccagcctgttcaatgacacgctgcatcgacttctcaatctcaccggacgcgcgtgcgttatcgacccaacgtgcgaactgatccgcaagctcactcacataccgtgtggcacgagggagatactggctagttgaatcgccaagattcaggaaagccttgacaaggctctcaacacccggttccaaataagtcaacgacttattcacatcgttgaaaatgctggatacgacgcttgtcttatcggcttccttgaccatcttggtcatgccgacgacgattcgtccctcatggtcggcaagagttgacatttggggaatcaacgtgtcggcaatggaatcagccaatccacggatggccggacgggcctgaccgtagaacgcgttaaccacgctgtcggacagcttgcctaactttgtggatgcaatgtcgatctgctcgctccaagtggcgcccttttcgccccaaatcatcttcacggacgcataggcggcgcccaatccaacgagagcggcaggagcggccaatgcggccttcgacatggaaacaatcgaagagccgacgccgagcacgctacgggacatgttgatagcgccagcggaaacaccggcgaacacggtacccaatgcggagaagaatggaaccttctcatccagcgagtccatgaaattcacgaacttctggaattgattgtttacagcacgcaagcctgtcgcgccatacgtcatgccatccagcattttgccgaaatcagtggcatggagtttcgcgtaaatctcgatggaacgcgggcgggtgagcatggcaagatgagtacgggcaccagccgttttaaggtcgatgtccatttcaagcttcttataatcctcttgaagcttcttggccttctcacgcgcacgggtcacatccaaatcaagattggcctcatagtggtagttcttatccttgccggcatggaacgcagcaagattcaacttgtcgatggctgaccggtagtcggtctcgatgtcgttcggaagactgcggaatttccgcttcaacgcctccagttcgcgttccatgcttttcgcgccgtcgagatagaccttcgcatgggcgtccatcccatcgacctgccgcaaacgcttggacacgttctcaagaacgttgacaacctcggaaacatcgttgacgtcaacacggatgctcgccttgctgttgcgcttcaactgctgcatcgcattgtcgagctgttcgacgagacggttggcgcgagccatcgagacattgttggaactgcccagaggcttgaccttctcgatcgcatcctgcatactacggatgtgcttcttgacgttatccaaaacgtcgatctgcttgttcgcgtatgccgtggtcaaccgcgtgttacgtttcaccgcgtcctgatacgatttgcttttcagcgtgaccttgcgccaagcatcgccaccattggcgatacgcttgttcatcgcggaaacggccttgtcggaagactgaacttgcttgcgcatcgttcgcagatcacgcaaagcgtcggtcagctcgactttcggggatactttacgtttatcaatgtcccgaagaacacgtttcagatcggagtcatcgccacgaatctcaacattctggacgatgccatcatcctcgatacgccttttcgccgcacgccaacgagacatgtcaacgtcaggcgtcacacgaacatcgaaatcgtcatcggcgtacctggcgagcttacggcggagttcttcgccaaaacccttggtgttcggataaatatcaattccaacggaaccggcgagatactccaccataagaacccctgtttttcaatcacatgcccagaaacgccttcatcgactcgaagttggcggaaacacgcctatcaacgccatcggcggcgtgagggggcataatcggtttgaactcagggtgcttgccatccttgaactgcaatgtgccggaaaccagcaagccgacctgattgtaaatacccaacagcagactcgtatcctgagtgaacccgtgaaaactcaaaccggaatcactctcggactcggcgctggcacgctcatcaggatggttcagcaaccattcccgatacaacgactcgtcatagccggcaagaccgccgataagggtcaaaagaaaaccgccgtcatactcatgcatggcggcgggaagattcagattgtagaacctacggaaatcacacgtaagctctactttgcatttccggtaggcgtccttgacgcttcggattttcccaaggacgcaccatagaatgcgttaagcagagtgaacacctgcaccagaacagtcggagtcctgccagtgacccacttgtggtaggcgtcaacgtccttggcgatcttctcgaagaaactatcgctggcagccaccatcctggctatagccagacttgaatcgacatcatcggaagtcttcttgcggaacacgccgtaactgtcggacgccacggcatcgacgaccatgaaatcgcatgtctgcgccacggagaactcatgagccggaacgaactcagggcatccggccagttcctcgtgctgttcgacgaactcagccagcgtgtcaggaatctccggaacggtcttaacggtgttcttatcagttttggaagccataatctgtaatccccatcaaaaacccatctgccaatcgttggaaaggattgcccccgcacggatgggtacatgcgggggcaataggaaatctcagcctttcgaggtcaaacccgatacggtctgggaggagtcacccggattcttaccgctggaatccgggctggttattttgacacgaacgtctccggggcgaaaatctggtacgcgccaacctcaccattggcaccggccttcagcacgctagtggatttcacgacggcgttgaagctgaactccgcgaaatcctcatcggcgaggctgacgttatcgaacgtgaaatcggtctccggcagatacaatccgaagctcagcttgtcggaatcatcgtaggcgagaacgaacaacgccagatgctgcaccacgggctgcaacggcacgacgatgccgccctggtcgccggcccagccgccagtgaccttcgtgattgtggccgaatcaccctgcacggacgcgccggacacggtgatggtcggggcttcggtagaactcttcgcaccggcgacaagccacgtgtccttcgtggtggtgtccccgccatccttgctgaagctgatcttgttgttgttggaggtatggccgatattctcccaattcgcgacggaaccgctgccagcggcggcaacagtgccactattcaacaagaacgaggaaactttggtcggaagagcggtcttcgcgggagccgtgaacaacgtaccgcgagacgcctgaatcagaccatcggcattaatagccataatggtgcctttctacttgaaattgataaaagaaaaggcctgaccgataccggtcaagccttgaacgaatcgcgggcagtcacaacagccgacagcccatactccttgacgttcttgccttgattctcttttgaatcagactgcctcttctgcgccgtcacagacacggtgccaaccgtcccagctgtcgtggactcctcgaacggccaaccctgcaccgtcttatacaagtgacgtgcaaaaccgtgaggatcgttacagtcagcggccaaaaccgtgaacgtcacaccgaaacgccacaatccacggtcaaactgttcgggagcggaaacataatagagaagaacctgtccacgttcaccgtaagcgttcaaaggcaagtcaagctcgctgcaaaccttcacatcaggccactcctcgcacggatacgcccgattcaacagttcataaaccaactgttccgcatcaatcgactcacgaacatcaatggcaagacgctgaaaaatgttgtccgtcacaatctcacccgactcaacgaatcaaacatgatatgttttcccggaatacgcgctctcggatcacgaggcccatacttgtgttcaagccaccggttgaaatagccgaactccaaatgcggagcgacctgcgtgccatcacggcccatgacggacatgacaatctgatgatgccagccgactttgcgaacggaaacctcgatcctatccgcaacgcttgaatgcgtagcggcctcattcgccttcgcgcggacggcagacacgctatgcacggcggcgcggcgtgtaagttccggcccatacatcttcgcaatatcggtagcgacgctacgccgaatcgtgacccttcccaacgccacccacctccttcacccattcaggctcggaaatgccgccatcaagataatcgccaataacaacacgacgtgcacgaacctcccaatgccgggagaaacgagaaccactcccacgccacgtaggagcgccgtcagcatcgtaataatcgcccttataccagatccgggaataaatgtcgccgggccattccctcgcaataatctgcaaaggagtgacctcttccaaaccgccggggttatccgaagatggcgtcttatcctcagctccagaaatagagaacatgccagcctgctgcgcacgaccctcaacacagcagatgaccttcaccggatcgccagtctgcacatactggccgccgtgcgcgtcctgaacatgcttgcgaggaatcacaacgacataatccgtgtcgaacagctgtttctgaccaccgtaatgggtttggtcatcctcgtagaggtaatggcgttcattcgtatcatcgtcaaacagaaacgccatcatcaacctccataaccggggtcgaaaccaagactgatgtgtgacatcgtgccagcggattcagcgaaaccattcagaatcgatttctcagctttcgacaagaacagccggggacttggatcatagccaggctgattctgctgcggatcatgctccgtgtacgagtaagaaccgttcgcttcggttttgaaccggttgaaacgtactacgcgtaacaccatttcgcatacgaccgacgcgaaatcactttcagagagacgccctttcttcaagcgtgtccggacaatcgggcattcgctcaaacagatgagagcggccttgcggcattgagcggaaatccaatcagtgtcgaaatgctcttcaaatgaatccgcgtcggcggaaccgtagacgcgcatatacttcaaccagtcgatgttgtcgatgattgccgtgctcatacgcgcctcctacatcatgcggccagtacagtggccttcaaggtgctgttggactgcactagaaccggcaatgcagtaccgttcacgtaagcctcgtatcccggagtcgaagacggggtattcagcacggctccgatagggccagcgttcttctcacggctgatgccatatgcaggagtctgagcttcagcggtcggccccaacgcggtgtaacccatgttcacgtcaccgaaagccggaatcagcaggatggtgttctcagggaagaagctcttgacgccgcccggaagagtaatcttggactggcgggcgaaatcacgatacctttcgtcaacaacgtaaatatcctgaatgccggtgtacaggctcaaaacgctcttcacatcattctcggaaacaagagccggaagggtggaaccctgaccacggaacaagtagttgatgatggccgcgttggacgtcaaagcgttcacaaccttacgggtggtgaccatgatggtaggacgcgcacccttcttatcgtcgataaggtcggaccatgcacgcaaatccttgaccggatcaccagtcttgtcccaagtcttcgtagatgccaaagaagtggatagtgccgaatcacgcgcataatcccaagctgcatcctcattggattctgtgatgccgagcttcgcgtcaacagcgacagccacacgcgccttctccagacggtaggccaattccttgcccaactgaacgaaataatcgctcagagtggtcttcaaatctccgttggccatggaaatgttgccatttgcgatgtccttttcggacacgcgcatacgcttacgcaacggcagcatggaagtgtaggacagcttctcaccgccaacagtacgaccatacggtgcctcagcatcccaagtggagaacttcatctcatcaacctcaggatcatcctgattcggagtccattcgacagacaagccggtgaactggtccggcaggatggaagcgaacggcaaagctgccgtagttgtctgataggctcccagcacgatggcggaagcctcgtcgggagtaatgatgtccttattcaacagactcattgaaaaaccttcctaatatgcgaaaacccgccatgatgggcgggtttcaaacgggtagaaactaaactcagtcagtatggctggtgtcacttggatgcggcggcagttgccggattcaacacggtcacatgcggagctgcggcgcccttgtcataatcaaggaacaatccctccaacttcgccttgctgaaatcaacggtgtacggcagattcttcttatcgataacacccatgtagcggacgccgacagtcggatactgatcctcgaaaccggtacgagtgaactgcacatgcacctgagactccaagaagccgatgatcgtgccattacggccatcgacggcattcggatcgtacgggccatagttattggttccagtaatctgagccagcggaataccggatttagtccaagcctcgtaatcatcgtcggtaatggacgcgaagtaatcgttctcatgcgacttatccttggtgaacgtagacaagtcaagctgcgcttcacgcacaccatcggtgatacgattgataagccaagactggtcatccttcggagcggtcttggcgacagtatgaaccatctgattggccatatttatctccttataaaactatttcttgatttcggaatgcttcacgccgtagttgtaagcgtcggaaacgcttgactgcggcttgcacacatgcatgtttctgctctgcaactccttcgccaactccggcgatggctcacatggagcattcccatcattctttttctgcaccgcttcaaccgtttcagtcttgctcggcatgaacttcacaaaagcgtcagcccattcggaaatcttttccggctcagtctccccacacaaagtgtcgaaagcctcgtcggtaatctctggatgcagtttctgcgccttcaaacgggctatctgcacgttcgccttggcaagagcgccctcagtgtcggcaagcttcgcttcggcggcattggcacgatcacgattctcatacatcttctgctcgttctcacgagcctgatgcttccacatgcccaacttctcggaaaggtcatccgcaccattcttttgagtcgcggtatcggcggctacaggagaagtggcagtgtccttcggctgcgcgttcacgcccgtttcaggcgcattcgtggatgccgccgtttcagcggtattggtattttcatcagccattaggcttgaatcctttcaatagtgttatgcggcttcgccaagcatcgaccgcatctggttgagcatggtcttctgccatgccatagcctgtttcaaattcttggaaggcttgaacgtgaacgtcctaccctcatagcggaaagtcaccggtttaccggccttctgcacttccttgtaacgccgattgaactcgattgcccgattctccatacgacggcactgagccaacgtggatttacggtcaggcgtatgccaagcgtcagaagccttcgacggaactggactgggcgtatccttcgcatcctcggcaagaagcacagggcccaactcgccatgagtaatggtcttgaccttcacctgcttcaacgcggacgcggtagtaccaccagcctcggcgtacaagcgtttcaaatccttctgattcaactggaaacccggatcgtaatcactgccagccggtgccacaccacaatgacagttagcgtgcaacggcaacaagtcagccgtcgaataccatcggtcagccgccaccacgcacaagccacaagaacccgtcttggacagttcgggatgtaacaccctgcgatactccaacaccttgctatccttgtaccgttcaagcgtggcgctcgtctgcgccctcgaaacatcctcgtcaacagtggtctgcaaacggttgaacgcctgttcaatccacttatcaacctcgctgaatatctcatcggtcttgctaggccacgtttcaggacgaatcgtggggtttttcaccgcaagactccgatacgtgtcagccggacgttgcgccacaagccacggatcggtattgtcacgaggaaacaccaaactaggcacatcccccttcggagtgacgcccacaagcttcaacgtctcattcgcataggagacgcccaaacggcgcacctgctgaatcaacgccatctccaacaacgccatacgggatgcgacggcaaacgtcataccatcattccaccagtcagcgggcgtcagcatgtcccacattctgtgggcttgactcacatactggttcaccagcgttgcacgagcctgttcaagcgtgttagacaacgattcaagcgacttaccggccatcaggactcggactcgccttcatcgacaagctcaccctcgacgttcggcaaaccatccacagcggactgggtttcatcatcccaacccgtagccggttccacagcagcaacaggcttcgcattactcttattagcctggccggaaatgttgaactggtctgcaagacggttcatatcatcctccgacacatcctgagcggtgaagcccatcttgtgcgtgagaatcgtcctacgcgccaacaagccactctgatacaacaactggcaagcctgagcctgttccagcgaactggtcgtgtccatcggcttccacaccatctcaaactcggacgccgaagcattcgcggttttagacgcggccaaagccatacgcaccatacgcacgataggctcagaatccaactcgttcatcgtctgcactttgaacttcaacgtctcacgcttcaactcagcaccattggcggaaccctgcacgtcaggcgaaagaatatccaacggaatgccagcggcggaagccaactgcttcacatcggccatgatgttgttctgcaaagaaccggtatcagtggtctgagactcccaaatatcaacaccatcaggaagcttccacaacgccgcagggccaaccgcgaacgtggatgccaaatcaataggatcaccagcctgcttgtctccgtcgatgacttcctgatcctcttcggtgtacgtggttggaacggtgcctttgatggcacgctgtcggaatgcttgcatcatcgtgatgcacaaacggtcgaacgtttcacggtcgatacgtttcagcatcggcagatacggctcgaacaatccctgcccgtcaaccgtgctcaaacgtacgatagggagcgaatcgcatccctccgcataagagaaatcagatgcttgtgaatcctcagcccactcccaatcgctaccaggctcccaagctttcgcatcagacgcgaacttagcaaccgacgaaacatcgttaggatcaacaacggaacgatcatgttcacgttgtgccgtcttggaatacactttcgtcgtggtcttgctgtcatcaacaacaagacgatacaatcgaatgacttccttgttctcgcggtccagatacgtgtattggatagcagcagtctcaccaacatccatccagcattcccaagggctgagaggcgtgatgaatcttccacgtccagcattggaaaccaagccaaacgagcatccgtaatcgcctttgtctggcagcatattgcgacgaagaataaaattcaggccgcattgtttcgccatcctatcggcatcagtgtccttcaacgaggaatcctcgaccttacggaaaccattaggctgctgacggtcggtcacgctctcactgatacgacgggcgagattcacgacacccaactggcgcatcagcttgtacactggggcagcgttcggatcagtgccttgaggcacactgttcgcatccaccatctccctgccatccttgaacagtttcaattcggcaagatacggcagacgagcgccccactcccgcgccagattggtaatgacgtaagcatcatcgtcatcatcggaagcgttcttaatcatcaacgagtcagacactcgaaatcaccacctagtagattctcatcggagcggaacggcgtttaacctcagccaactccaaatactttccacgagccgtataagccaacaggccagccatgcacgcatcaatcttgtccggcgaattaggagactccttataaatcgcatacccggtacgagtctcacgcctacgagcattacggaaatgattcaccaaccgcggatcagcaagcaacgctatatcatccttgaccggcttagacttacggtcaggctccgtatacgggtaacggaacgcggtatgcgcgttatccaacgcgacctgcatgtccttataccagttgttagtccagaacttgatcttgtcgccgctcttacgcggcccgaccttcaacttcttcccgtaatccttctcccaaccgccaatcatctgctcgaaatacgcgacatcagcgaagaagccgaccacattgtagttgtccatcatccaacgggccatgccgtcgaacgcatcacgattcacacgccaagtggccttctcaggcccgtcaggagcggactccaacttgataaggaacaacatgccatcggacacgcggcaacccacaagcgccgtcgaatcatccgacacggaaccatcgaaccccaacgtgataggctcacgtttcgtcacgaaccgttgccacgcgccatccaaacgaatcgaattgaacgcggtatgcatttcatcccgatacagcatgtgggattgaatgtcggactccgtaagccaagcatcatgcacgctcgacaaagtgttgaaatagtagcgcatcgaatccgcagggtctgaatcaggctggtaaatctgatccatctgaccattcaggtcaatccacccatccttcgacgggccaagctcaccatcccaatacgtgtgcccctcggggtcaacaccatcggcgttcaacacggtcatacgaccatcgggcaatatcagatgatccttaccgtccgaactcttcgcactcgcaccatacgcgacctgcaaggcgcggagaaccttcttctcgtcagcgaaatcatccaagtcgatgttcgcatacacatggtcgaagtagatgccgctacgatgcttgatcttgcccgaagcggtatcccacgcatacttgtacgatgtttcagcgatggactcttcgcccggcttgtacatggtggacgtttcaagaatccacgggtctgcatcacctttacgtttgccgaggttacgttgaacggtcttgtacatgttgcgaagcttgttcgtgttgtacaagtgggtttcatcgcaggcggcgaacgtttccaaaccgccatccttggacgcggcaccactcgtggtgggaacaatctccccaccttccggcaagccgatacgggtacggccaacatcaaggccgacacccttcaactggcttaaagggccttgatcgcagttgtagtaaatcgaatcgaagatgttaccagtctgaccttcggcggtagccaagcagagaatctgcggcatctgcaccatacgtccgacaggctcacccttcgcatacgggtagacctcgcccagaaactcgtaagtctccccttcttccgcccaatggtcgaacctgcaaggagccaaaccctcgaacgcgcaaatgccagcggccttaccggacttgttcttacccttcgcacgcgaatagaacacacgattgaaccggcgggtaccccactcggtcaacgcataggcgtgaagcatgaacacgtactcgtccatgtcgaacgtctcgggcaagccaacgccgccaccacgacctacacggaagaaagtctcaatccaccagaccgcgaacattcccatcgaacgagtcaaatcctcgccatgcaattcgggaatgcgcgtatgcatcaggcaccaccgtcaatgacacgcaaacccaatgcggaagcacgctgcctgttccgttgaacgttacgagcgccctcggtatcgccctcatacgcggaagccttcatatcgtcaggctgcggagcatcgaacttcaaccgcacccgagcctcgggtgtaatgcccaacgtggcctcacgctgacgaatctcggaagccaacatccaacggcccttagtcttcggacgccagaaatcatccttcaacaacgccaaatcctgaaccgcgtaccagtcggcctcaacacccatacgctgagccaacggactgacacgaagcgactcataccacttcttcgtccgttcaagccactcctgcccatcagggcgaacagcaggaaactccaaacccatcggactatcaggcgcacgaagaatcggattcttcgacttctgcgcaccacgaccattaccagccacagccagcctcacaatccgcccgtttcaggcaatacgcgaagctaggacgttccaccctcgcaacgcttgtgaaccagcagacgattcgccaaagtcgcactatgcgacttctccaacggaaccttccacacgaaagcggcaccatcggcaccactcgaaccaacatcaaccggctcatggcatttcgcgcacaagccgccacacttctcaaccacctgagaatcagtaaaagactcaacaacaagctcggactcaagctcggacacgtcaaccggacgcacgtacatagtcgtttcaggcttcaccggcaacgacttatcatcatcacgagcacgcttatacgccacacggcaacgcccagaacaaaacaactggtcggaacgcttcggatcaaaccacgtatggcattgaggacacatgcgctggcgcaacggcttcagcggagaccccgaataccggtcacggtcgtaatgcgaacgacacaatcccttcgcacacaccggattagcgcaaccggcaaccgcgcacatgaactcattcacttgaaagccgggtgagaataccaacgcttctccctccgactcctacccttcgcacgacgaacctcagcagactcaccctcggtcttccgctgatgatgccaacgacacaacacccacaaattctcaggacgatcatcatcatggacgggattacgaaccttatggtcaacctcattcccataccgtccgcacaggcgaacattcccgtaatcatccttgaccggccactggcacctatgcccatcccgttcaagaatcatcgcacggacacgcggccaatcaggattgaaccgttcatcacgatgggaactagaccacgccacagtgacctccacaaaaacagggttggccggtgctgagcaggaaaacacgccaaaggggaaacatcccagcaggaaaagttctcagatcaaccaacccaagtgctccgggagggattcgaaccctcacaccctacaggtagcgcattttgagtgcgccgcgtctaccattccgccaccaaagcaaaagaacaagcgtctcacactccacccacaacaggagcatgggacgctcgttcaacccccagagagccataaggaaccaatggcatcatcacaatggctttttaccgccagccacggcgtgcggatgctgagggagtcgaacccccgaacccttgcggattgccaccttagcgaggtggtgcaataagccactctgccaagcatccaaaatgcaagagccgccgcagcgactcaggagactgttcccgcagactaggcgggtcagctaaaactagagccgccacaagacgactccgaagacctttcccacaacctgtgggtaggctgagcacagcatgttggactcgaaccaacatcgacggttttggagaccgtaatgctaccggttgcaccaatgccatatacccgacttagttaacgtccaagtcggaaagacgttcggcatggtggaatgggctttaccaccaacggcaaggaacgtgaaacatctatgcacccgtttggccgtgcctccccttcggtcatcaaccacctgattaaggcagggagcctcttatcccccacatgttccagcggagatattcgagcaatgccatcgatctcataggcagctaccccatgaaacctagagcaaaccccgggaatcgaacccggcaaccaaaaggctgtgccaacaggattgcagaccagcccaaaataataggtacgagtccatataggccacgcccgggatagaccggtcggactgctgaccgtaccgcatctagaatcctcacactccccttgtgagtggacggtcagacgttgatgtggcttaagctagcttcaccgccatcaacatcaatccaaggaacattatacacaatatgtagggtgcaacaacggttgcaaccactaaatatgtgaagacttcgtgagtaacgggtaatccaaaaatgttccagcgagcattcagcgtcagcactagagagccagcggccccggcttttcaacccggggggaccctcccccacccgggggtttgttgtatatgcaacgttggaacgtttgttcggttgacgtgttgcgtgtcgtatggtatcgcgcgggcacgttcctttgtgtgcgtggttgcaggtgacgtgactgtgcatgatcgtggccgtgtcgtgcctgtgaccgtcgtgcatggccgtcgtgcctgtggccgtggtgtcgtggccgtcgtggtctgtggtggtcacgtcgtggccatcctggttgcgtgtgtggcgtctcacgtctgtggcggtgtcatggctgtgacgtggtggtgtgacgtgtcgtgattatgtggtgctatgcgtggttgcgacacgccgatgaatgctagtgtttccaatggtttatgcggtgtctgtgttgtatcgacttgccattcagctgaatggcgcgtatagtgatagccatcaagcaaacgacaacgaaaggaacagagatgaacgagaggccaccaccacggagaccaccaccgcaaggacggtgacacgaagccccccctaacgggcgcggcatggatgattgacaactgaagagtggacgcgacaatgaagcggcggagtgcgactaggcatgatgcaccctcacaccatgcaaggccgaaccgtcgtcgagtcgccaacgtggcgcggtgtccggcatggaattgtcccgcgctgtctgagtggtctacaatggcctctaatccaagttaggagtagggccatgagtttgaaagaattaagaatgaaacgcggattaacgcaacgtgagttagaagaacgcagcggcgtgcatcacaacgctatcgctaagtttgagactggcgagagaaacatacgtgacgcgtcgcttgatactgccttgcgcttgtgtgacgctttgcgtgttgctaatccgcgcaaattgcttgattctgattctaagtcttcggcggagtgatccgccacagggctagcgtagtctttatggcacgtctagcccacgaatgagtagagccggatagttgcagctatccggctcaattgctcagtaaatgtatccaatcaattaaccaagcggctctaagtctagcagggccgctagataggagtatcaaaatgtattcgatcgatgagacttacaagaacatcgaagccgagtttaagccccgcagcaagtgggaccagggcgtgaaggaaaccgcgctggccgtgcttgattcgctcgacatgcccgaaacggttcttcccgaccacttcggatcgcgtcgcgcgctgttgctgaacggcgcggacaattggcgggaatacagttacggcgggtgcgctctcgtgtgcaacgtggatatcgccgcccggttcttcaccccgtccgaaatgcgccggtacatggctgatggtcatgatgcaagcatggcgttccgtggcgagcctctgcttgacttgcaggcgcgtgccctcagccaggcggagcgtgttatcagccggtacgcgcgggaacactgaggggcaagtcatgtgtgagaagtgccccatcgatcaacgttacccgtactacggttttcctgtgacgccagattcccgcaagctgcgggatgaggccgagcgttaccgtgagatcgctatccgctgtttcgttgccgagagcgattgtgccgacgtgaagctggcggatgcgctgtggcgtgagatgtgccgtgccggtgatgaggcgcggtttctgtgcagcaatgcgcgtcgtttggagatggaagaagccctacagtgtcgggctatcgaatatcccaattgtcctaatcgcaagcgtatgcgctgacttgttccaggctttcgggcgtgagcctatcaatcacgcccatatagcccgttcgggcattacattccaacacaatcgaggtgctttaaaaatgtcttttgttacagttgattttcctgatattcgtgaatctgattccgcagagtatgcgtatctcgccaacgtgtacaacactacgtattcacacaatcaaaacgcttggcgttcgcctgatgaaaacaggcttgacggaaccacgtatgccgcgtggtggttgatggatgaatactatacgcgcggtgaacatgccatgattggtgagtgccgccgcctgttaacgaaacgttgccgtgcggaaatgcacagcgaacacaatagagagttttgcaccggattctacacggttgttgattccgttctttccaagtgaggtgttcgcaatgcgtaagaagattactctgcttgttgccgtgcttgttggcctgttggctttcagcgtggcttgttccacagcgctttccgatcagccggttgccgatccgcatggcacgccagagcagcagtggacgtggtggcgtgagacttatgccacgaaggattacaaccaagctgacctagcgagctaccgcgagttgtcagccattccgcagtgcggcatggaggacggtagcacttcggacggttacgagcgtatttgcgagtggcgtggaagcgttgacggcaatcaatccggcacgtcatatgtgctcgtgagtggcagcaaggttttggaatggtgaaaccgctcagggccgtgcggttgaacggcccaatcaaataatcaagttttttatacaagggagttttaaaaatgtcgaacaaagttaacggcctgtgggcagtcaattcgtccagtgtcttcatgtttttcgattccgtcaatagtccgagcgtgtggcgtttcgagatgaaggatggcgttgaatcatggcggatgattccgggcgtgaagaatgctcaggcggtgcgtggtgtagctgccgcgtatcgtgctgacggtggtacgtggcttgaccctaacgggtctgattatgctcaggccgtgagtgagattggtgacgtgccgttgatcgtggaacgtggcgattgcatggtttcccctgattgtggggattatacggcgcatggcgtgagcctgtcggacgccgatagggagcatggttgggaattgtcttatgaggatggcggcatggttgtgtcacgtgacatttcattcctcaccccggccgagcgtgaccatcctgagatgtgcgagacttacgatgatttgccggttgtcgcccctgaaccgcaggcggttgagcctgaaccggatacggttgagattcccgaagtgccgccgacaccttccaaggatacgccgaaggtgattgcgcagcatggcgtcaaggcgcgcgtggtcacgattccaggtggcaagtcggtcaaggagttggctgacgtgtttggtggatatgtgcataagccgcgtggcttccgtgattccaagggccgtcgcgtcgcatatgtcgcgttcgacggtaagagtggcgtggttgcgtaccgtgactactaccagcgtggcagtgaccaaacgttggaagagtccgtggccgcgtacctcgctcagcatgagattgtcgaggtggcatgaaatgtcacgtgtcgtcatcacagcacagcaggtcaaggccgctttggaggctaccggctattcgtccatcgagtcgaatgttcaagccgtgttgagggagattggcaagcgtcccgcattgataaccgcgtatctcagcacggttatcaacgcggctgccgacaatctgcctgatccgcgtcatatggattgcctgttctgaaaagtttggccggacggtatgcctagtaccgtccggccattgcaaacagtaattaactcaaccaaaccatttgcaaggagattctaccatgtcccgccattattacgctgtttattggccttacggtgtcaacactttcaatttcgaccatgagccgattggtactgttgtcccattcgatacgactaaagcgcgtgacgcttacgttgctgctgaccggttcgacggtaattttcataggagcgcgccggattatcgattgacgcgcaagatgatgcttgaggcgctgagagagttccgttcgttggattccaagggctacgaaggttggcgtgtggatggcgtcttctatgagtctcttggtgatgcgtacaaggcgatgttcgatgctgatgcgcagttgcgttatgaactgttcggtgacgttgattcgagggaggcgtgagtgtcatggaaacattgaaattgtgggctgattttcatgttggtcagcaaatgtatgcatatgaccattttgatgtggtcgagcgtaagcgttattggcgtcccgtgtcgaaaacgtatcttgtgtgcgcgtggctgcgtgacttgattcgtgggatgcgtgatgcgcgcttgggtggattccagggttggttgtactgcgttgtcaaggatggcgggttcaccactcaggagttcatggggttcaacgatgaaatcgaggtgttgtgatgattgacgtgaatatgctgccacgtgagcttaccggctatgtcggtcatgtctgcggcctgtggttcggcagttattttattgattttgagcatgtgttcgtccattccacggcgggcatcatcggtgaactgtacgaatacctggtggatacggttcaggacaattcgatgaatggcggcttggattatgaggatgcggaagagtacgcgaagttggcggctaccgttccgtggtctatggaagagattgaccacgtggcggaacagtctttccgctacgtgtctgaccgaacgttgcaggtggcttacgccttgtgtgtcctcacttttgatgcgatgttcccgcagaaaatcgaggttgtcaaaccggacgtgcgggagacgttgttgagcgtggcgttcccgcatgattggcagcgccgcatggcggagtctgaccatgatcgcgtgagcgtctaccgcatgggtttggaatgcgtgacgaaagcgtatgacaaggttttcgaccgtcttggggaggctgactgacatgacgcgcagtaggaacagacggcttcgcctcatcccatcgcaccttccgctgatccgcgacaaactcgcggaatacgagcgggtcgcattaaaggaggagatggctgcgcactctcaatacgagcggagcatggaagcggcttggaattccgccgacaatctcgccgtcgcgcagctttggtggatcagccgagacatgacggcgctggcggaagataccgtccaggcaggcgatttcccgaaaatggacgcgccggcgcaaagcgggcttatcttcttcgacgggggtatccaaaccgtcacattcaccgtgatcgacgatgcgacgggaagtaaggtcggagccgcccacgtgtcggcactcttctggcaatgcgacggcgacggcgatatcgaactgatgggcttcacggaccatccatgcggccttacggaatgcgacgcgaaatcattctcgctgccggtcgtcaaaatcaccagcgacgttttcaacaggcatgtcggcggtatccaatggttctacgatctgctgcacgcggtatgggcgttgagcgcggaaccgcatatctgcgaggcaaaaccggcgaaacctaatatggagcatccactgccgccgcgtttcgaccccgaaatacgcaaggtcaagatgctggtgctgcgcgagaacctgcatcgtcctggcggaagcgccgatgatgacgagcgggtgcgacgtgagtattcgcatcgtttcatcgtgcgcggcttctggagggatcaggtgtatggtccgaatcattcgctgaggcgcaggcagtggattccgccattcgtcaagggtccagccgataagcctttgatctgcaaggagacggtgcgcatatggaaacggtgagcgacatgatcgccggttttctcgccggcctgacgccgggtacaagggcggggtatcggagcgtcgtatcgcgatggctccgctggtgtgcggataacggcatcgacatgctgcgggcgaagcgcacccatatcgaggcgttcgccgcctatgacggcggcatgcggccagcggcgaaaaacacggtgtgcaggaatctgagcgtcgtttgctgcctctaccgctatctctgcgaggaggggtatatcgactgcaatcctggcgagcatgtgcgtaggccgaaactgtacggtcattcggatggcacgtacctcacccgcgagcaggctaggctttttctgaccgaagcacgcggtatgggtgcgcggacggatgccctgtgcagtctgctgctgttgaccggtgcgagggtcggtgaggcgcttgggttggatgtcgaagactgtcatctgaatgacgggcgtccgtgggtgcggttcgaccgcaagggcgactggtctcagcgtgtggccattccctccgatgcggccgaagctctcgcacgactcattggcgaacgtaggcgtggtgcggtgttccgtgaggattccggcgcgcgtctgcggcagcagaccgccgtgggcatcgtatcgtccgtggcattgcgcgtgggcgtgccggatatttcgccgcattcattgcggcgaacgttctgcacgctctcccgtgacgctggcgtgccggacagggacatcatggccgcaggcgggtggaacagtccgcagatgctcgactattacgacatgtcccgtcgcgggctgaatggcaaagctggcgacggattgcaggattatctgggcaaggaggattgatttccacaacacgcccgacttgaaatgttacctttggtaacatatattgtagttagcaacaaacgggaagcatcaaggcatccccacaatcacaaggagattgaaatgattaccattcgtatcgaaaaaaccagaggccacaagtggaatgagactggcacattcgcactggagttcccgaagtcggaattacgaaagcgcgtctatgattgccagctcgacaaggacggcgaaaccgaagacgcatggctttgcatcccgtccgaacggctccgtgccaagtatgagcggctcgtcgctgacgaggagtccacgcaatccgattacgacaagctgtacgaagagctttcggcttactcagacacgttgaccaccgagcagctcatggactggttcatcgacctgaacgatcctgaaaccatcagcggatggaccgagcgcatcgaagcccacaacgcctacatcgacgtgatggagccgaacaatgcggtgctcaggaacccgcttgacgtggattcgacgttccatatccgcatctacgattacttcatcgatttccatgaggatagggagattgtggacgacttggagttcaccccgtccgacgtggaggcggatgattggacggaggacatcaaacggtgtcttgaggaaaacgggtggcgtcttgactccaagatcggaacggattccgatgattccgatttgctggtgttcgattgcgtcaaggcgtgacgtattccgctgaaaatcgttgttctgccggttccagcgtgtttttcatgctggaaccgacgttttccgtgttttcatgattgtctggaggtttgatgacgtttggatcgaaggccgcttttcgcgcggcacgggaacgctgcggcatcagtcagaagatgcttgccgaccgtttcggcaatgccgtgttgacggtgaaacgttgggagaagcctggcgaggcggaaccaccggcagacgtgcaggcatggttggaaagtatgctcacgcagcatgtcgaagcggtcgaggccgcgttggatgcggtggacgggattgaggaagtccaaggcaacccgcctgaccatgttgacttgctctactatcgttcgcaggaacactacgaccgttacggacgggacaaaggcgattacgcgatcgtcaatgcccgcagcagggagatagccgcgatccttgaatcgcagggtatcgaagcgcggttccgttatcccgaggatgatgaagccggtttccaacgtttggcgaacactcgctaaacgcatttgttgttaacagggccattgtagaccactcagacgttgcttaacgcggtttgtagccagttgtccactaattcggcttcgttgactggctcgaaacaccatgcgtctaatccgacgttgatctcattgtgatgcctgccgaactcaagcgggtcatgcgcgtgcgtgtgtccgtgcaggagcagagtgttgttcatgcgtggtatcgcgtattcggctaattccggtgcgttccaattggttgagactgcgcctaggggtttgctttgcgtgaagtcttcacgccattggtagtggcttaaaaataccgtgtgtggattgttgccccactcgtctctgatttcggtgatgccgactcttccgacttccacgaacacgcttgccaacttttccagcgtgcgggtggagctgtgtatttcgtggttgccgagaatcagatgcctgttcttgcgtggtacatgcaggttttggatgcgcattatcgcttggtctacgctccacgtatcaccggaactgatgtctccgaggatgtagagttcgtcttcctcgccaacatacgtgttgattgcgcgcacgatgtcggcatcatgcttccgccagtcaacacagttcttaagcggcttatgctcacgttcggcctgttgtttgatcgatgcatccttagcgtatccaggtagcgcgtatccgcgtagcgcggccacgaacggatgcgcgaaatgcaagtcagcagtaaaccacttcatgcgtcctccatgtttttcaaatgcccgtatttttcatcccatttgtccaatgcttccagcacttgcggtaatccgaaatcccaatacgtttcgccatactcttcgccttttctggtgcggtacgagatgactaacgtttcagggtcatcaccgcacgtttcgcagacttccggcacccattcgtggtaataccagtcggtgacttccacaggcgcatcatcagtgccgtcgaacagttccggtgattccatcacgagcacgcgtagcatgagttctttagtggtttttccactcatggtttccccttatttatggcatgtacaatcgcgttaaccattcgatttcatccttcctcttcgattctcagttccttgtcgccattcacggttgcggcgatatcgtcgttgaactggttcgacaattgaaggacgatgcacgcgcgcgtctcgtaccgcaatactggtgtgaaaccggttgaggatgtgaagcaaacgtcggatgtgaataccggctggtttcccaaccgtgtttcaaactttttgagcgtgccggacatgaccacttccccattgtctaggatgctgacgcgcttaccaaaatgcgtggcgttgaggtgatcagcggtgatggtctgcttgctcattcctcgtatcctccaaggtaggttttgcaatgcgaatcgagtatggtttcaaaaatgtctacgactgcacaccggtgttcgcgttctacgtcgtgtgcgcgtgattccgcttggtcgcgcgtcttgtaagagccaatgagagtcagctcttcacctctgtacggtacgtgcccatctggagtcatgtatgcgattacaagatagattttcatgcgtcctcgattatgattggcgtgtcaccgtggatggtgacgttgatcgtgtctcttgtggtcaggcggatttgcgtgtcgatgcggacgatacgtttgccgtgtgttggttcgggtggcgtgtcttcgccataactgttgacgcgcctgtatgtgacggtgggcacgtagtttggtctggatgtgaattgttccagtctgccttcgaccactatcgtctggctgatcgggtctaggatggtgatgggttttcccacgttgtcggctttgagattagctcctgtggtttcagttgatgccactgctaccgaatcctttcgtgccgcgttccgtatttttttcaagggtttcaacgtggtctaagggcatgtgtggcgcacattgcgcgaacacgatttgcgctatcctgtctcccttatgaatctcgaacgcctgttcgcccatgtttcggaggattacgcatacttccccgcgatagttggggtcgattacaccaggcgcgttcatcacggtgatgttgtgtttgagggccaagcctgagcgtgggcagatcatgccgacgtatccggctggtatctgcatgtacacgcccgtgtgcacgagtgcctggctgttggcgcagactatcgtgtcctcgttgcttctgaggtctgctcccgcatcgtttgggcgagtgtagccgatgttttctctgatgccgctgaattgcattttagttgaacctttccgaaatgagtacgccgatgatgccgatcagccatgcgagaagcatgatgaccatcatgattaggatgatgccgaatggaatccagacgggtgcgaacacccacagccacgagtaggggaattgtcccccgattttcaatagggcgagaatatctgtcagcaacactaggattagcgaacagtcgatatgcaccattattcctccgtgtagaaggtgatcgtgtggagtttcttcttcacgtcgaattgttccccgaacatgcctgattttttgacgggttcgatcacgtcgcgcatgtgatgcgcgtgataggtgatggtcttgcccttgtcggtgatgctgatggtggcggtcattggatgatttcttccactaggctgatgttgcttgcctgaaccgtcttgctgatgccgttgtacaggtttttgaacgtgaatgaaaatggtttcatgcagttctcatcttcgaagtcgatgatgcattccatgtcatcccaacagtcaatccacggagagccgaccagtctggggctggcatgagtgtagacgatgacgcctttctcacagtcggtatacgagtatgcgaatccgagttctttaagcttgacggcgtatggcggattcgataggtcgattttcactttgcatcctttccgacgagtccccaaatatcgtccactggagtggtttgctgcatcagcatgtacacgtccgcgatacggtagatgggatgccgcccttccttgcgtaccggggtgagcttgcccctgtgcgcccacgatttcaacgtgttcgcggatacgaggtatccatcctgttggagtttgcttctaatgtccgaagcagtccccgtgtaagtgctgtgtttgatcttgtcttgcatgagtgtcctcaaaaagttgatgttccaaacgttcctgcatccacggcatttgacttgttttgccgtctcgtcagccgatagtggcatgttgcagtcggtgttggggcaattgcccaagctgacagtatggccttgattcaacaggcgctggcacttgtcgcgtgcgatgcggatttcaagcgcgtacacgggtgttgccgttgagcatagacacgcgggttcgccttgcttggttttcttcacggctatccgctgcgccaacacgttcaacggatcgtgattcaggtattcgacgcctaagcatttagcgaacgcggatagtgtgccccacacgctatccatgtgttcgtcaccctcatacaacaggtcgaacacttgctctcgcaatggcggattatcagagtatcctcccccgccaccgttagcgtcatggttcttgttgatgcggttcatcttgtcggtttccaaaaatccgatgttcttcgtgaaccattccaagtcggctaggagccgctgttcacattcagggcagagttgcctggtatcgtctcgttcacgcccgcaccgcaacagtttgcagtcagccaatcgcacgccttccaaaatcatggtatgttgattccgcaccggtgcccgaaggcgtgcgattaatgccggaacatgtctagtataccggttgcacccaaccttgcaaccggtattggattaacgtctcaaacagtctcccgcttccgttttctcttctcgggatgaagcaggtagtagttgcgttcgtaggccgcctgttcctcacggctgaaatggtggaatgtcggacgatgcgcaagcttgtatcggcggttgcattccaagacttgctcacggtgggccatccgccactgtcgcgtgtgctcacgtttccgtgcgagctgttccgcagtaagcttgaccggctttttcgacgctttcgccttcttctttccgactggcggcttctcagacggcttgcgcctaccacgacgaagaaccgctatgtcaaccgcgaacattttcatgatctcgtcggcggtaggctcattcattccgtttgctccaatgatgcagtagtcctctcgatcacgtacaacacgacggcctcattgttgtccaatgccagtgggttcgctgccgtgacgttgatgattttccacccatcatccagatagtcgatgagtttagaatcattctgcacacgcacaccgttaccggtgaacttcgtgtatacggggattagctcatgttccattatttcgtttccccgtccttgccgctagcattgtcccaatcgcaggaaagaccgcctccccccttgtagacgttgaacctgatgcatgtcacggccctaccgtcgtgcaactcgattctgcactcatcgacagcgaagtcgcctcgcacatcaatgcagtcactaccgccttcaacatcgtcagcatccgcttcgttctcgcatccggccagcgggaaaaccatcgctacggccataagcacggccattagccctcgttgaatattcttgtttcctatcatttcgtctccttgattgtcttatcccgtcgatttcgacgggtttgaatgtggtctagaagtgttttgccatccagtcggcgatgaacaacgcgacgatcgacgcaaacgacgcgaaagaaagcaaaccgaagacaatggtgaaaacaatcaaaacagccttcattccgtcaccgccttacgtgccacttcgagcacttctttcgcccgcgcgatgtagtcttcctgatatccgcagatttcaccggcgtaatcccatgcatcgtcttcgtccttcgccacatagtcgctttcgatgccatcccattcgcagctgttccagcagagccgtttcgccacggcctccacctcggcgtcggttggtggagcggaacgtccggccatgtacgctgtaccggcaagctcacgaaccgtctgaaaagtcaaatcatcatccatgccacgctcgtaagcgttggcctcgtcaagcatgatgctcaattagtcctctttccgttagctttgaccatggcccacaggatttcgcttgccggacgcctcctgtatgacaggtgcggcgatggtactgcactcgagagggtgtgggagagtagcacgccgccgcttcaaacgttgggggttcccgtcgagcatcctgctccgggaaccccatttttttatccccgaatcttttgttcctcctcccggttcttccggctgaccccatgcgggttcccggaagggcttttttatttcccgtatttccttcttccttccgggactcccgtggggcttggcttccggggaccccgtctttccatccttgatttccatctgattcccaggtctcccgcaggggcatggaaatcctttccactcctggttttttctcttcggcgccgcggattcctgttagaagaccggaaaaactatggttttgggacctcgtgtgtgtcccatgcatcaaagcgcttagactggtcttatggcaagagttacggtgtatgacgttgcagagaaggcgggtgtgtctaccgcgacggtctccttcgccttcaggcatcccgacaaagtgaaggatgataccaaggccaaggtcctcagggtcgccgatgagcttggctacgttcccagcggcaacgcacgtagccttgccaaaggcaggacgggcacgttgggcatgtacgcgttcgatatgctgctggagaagccgcaggggagtggtctcgaagaagataggtccgatgtatcctccatgccggccagtatgtccgatgacgacgagccagacgttctcacttatcctctatacgttgacgaggtgctccgtggtttcgagcttgaatgctggaaaagcggcaagggcatgctcatgggggctgcgttggcgagggacgaccataagtcggtgaccgacatcgccgggcgggtcgatgggctggctctgatgccgagcggatataacaacagacttcccctcgccatgctggcgaagaccgtcccgcttgtgatggtgggtgtgtccgacgagaacctgcctgccgcgtacctgcaatgcgacaacacctcgggaatgagacagatcgtcgaccatcttgtagacgtccatcatgtcgacgagatggcgttcgtcggcggcttcgattcggacgacgtcgtcgcccgctacgtcgccttccggaaatgcctcgaggaacgtggtctcgattccagcgacgcgctgctggatgactccttcgccacgtccgatgaatacatggtgggtctgtgcgaggcgataggatccggcagactgccgcaggccttggtctgcggcacggaccagaccgccttcggcgtgatcagactcctcgaggaggccggtgtccgggttcccgacgacgtcatcgtcaccggattcgacggaatcctcgccggacggctgatggaaccgcagctgacgaccgtccgccagcccatggaggacatggggcgcgaggcggctcgcatgctgctttccaggaacggggagccttgggagaaggctgaaagacgagtactcccggttcgcctcattgtgcgcggcagctgcggatgcaatcaaaaaatctaagcgcataaatcatatgggcgtgtcgccttgacttccttaaatctaagcgcttaaattgtaatatcaatctaagcggttagattgatatgaatcaaaggagatttcaatgaggaagccatttttcaaagcggtcgtggccggcatggccagtgtggcgatgattgccggtatgtccgcgtgcggacggtccgcgaacaacgcggattccgattccgatgcggtcaagaccatcgattcaagcaaggccaccggcgacctgaccatctgggccatgggcaacgagggcgacctgctgggtgatttcgtcaagggattcgaaaaggagaaccccgacgtcaaggtcaaggtcaccgcgatcccatggtcctcagcgcacgacaaactccagaccgccatcgccgcgggcaacggtcccgaccttgcgcagatgggcaccacctggatggccgatttctccaactcgttctccaccgtgcctgacaacctcgacatgtccgacttctccgacgggtctagggctactggccaggtcgacgggaaacagctcggcgtgccttggtacatcgacaccagagtgctgtactaccgtaccgacatcgccgagatggctggttggaacaaagctccgaagacttggaatgagcttaagcagatggctaaggacatgcagaaggtcgatggggtcaaatacggcatgaacctcaacccatctggcactgacgcgttcctcggaactttgccgttctcctactcggccggggcgtccttgactaacaaggaacagacgaaatggactttcgaagatactggcataaagaagggactgaactttaccaccagtctctacaaggacggcgtcgcgaacgtcaacgccgacgtaagctccggtgccgacatagcgaacttcgtgtccggtgacactccgatgatgctgcaggggccgaccgccgtcagccagatcaacgaattgggcggcgatggcttcgaatccaagtacgccaccgtgattctgccgtcgatgaacgaatcctcgggtcctgccacgtccttcgtcggcggcagcaacctcgtgacgttcaaggactccaagaacaagcagtccgcatggaagttcatccagtgggcaagcaagcccgaggtgcaggtcgaatggtacaagaagtcctccgacctgcccgcctctcagaaggcatgggatgaggacgcgctctccggcaacgacaagctttcggcattcggcgaccagctgaagaacaccatggctccgccggcgctgtccacctgggcccaggtgtcctccgctgctgaccgcatcctcgagcagataaacaagggacaggtctccgttgacgagggcttgaagaacctgcagtccgaagccgactccatcggaacgggaaactgatcccatgagcctcgggacaagaaagacgaagacggagggctcgggcaacgtcctccgccgccgccgtacgattctcgcatggggatttgccttgcctttcgcagtcgtgttctgcgtattcatgctgattcccctcctgtcctcgatggcgatgtccttcaccgacatcacctccaaggaccttcgcaccccgttcaacgtcaacttcgtcggactggaccagtacatcaccctgttccacgaccaccgtttcctgcacgcgttgggcgtcaccggaatcttcgtgcttgtcggcctgccgatcaccatggcgatcgccctcgcattcgcggtggccctcaacaagggatccaagcacctcaacgcgttcttcagggccgtgttctacgcgccggtcgtcgccagtgtggtcgcagtctccgtcgtgtggaggtacatcctccagaaggacggcctgctcaactcgctcttggccgtcttcggcattgccggaccggactggctgcacgacacccgctacgcactgcccgcgctgatggtcatgaccatctggcgcaacatgggaacgctgatgatcatcttcctcgccggcctgcaggccatccctgaggagctgaaggaggccgcggccatcgacggcgcgggcaaatggcgcaccttccgcagcatcacgcttccgctgctcaagcccacgctgctgctgggagccgtgctcctttccgtcgcctacctgcagttcttcgaggaatccttcgtgatgacccagggagggccgctcgactcgacactctccgccgcgtactacgtgtaccagaagttcggtttcggacagtacggaatcgcttccgcagccagctgggtgctgttcatcatcatcgcgctggtcagcgtgctccagttccgcattctcaaggaggattgagatgacagccacgacagtcgcggcctcgaggccgcaaagcaacaagcagtcgctctggcgccgattcgtcaaggggcgtggactctcctactgcgtcctcgcggtgatcggagtcttctggatcttcccgttcctgtggatggcgctgggctcgttgaagacccagagggagatcctcgccaaaccgccgaagctcctacccgagcacgcctcgctcgcaaacttcgcgaaatggttcggggagctgaacttcggcacctacttcaccaacagcatggtcgtcgccgtgatcaccgtcctcgggaacatggtgttctgctccatggtcggatacgccctggcgaagatggacttcgccggcaagaacatcttgttcggcgccgtcatggtgacgctcatggttccgagcgtggccacgttcgtccccctgttcgtgatcatctcgaacatgggactcgcgaactcctacgcggcgctcatcctgccgttcctgtgccagcccatcggagtcttcctgatgagacagttcatctccggaatccccgacgcgctgatggaggccgcgagggtcgacggcgccggtgagctgcgcatattcttccagatcgtcctgccccagtgcgggccgccgctggcgacgctgtccatcctcacgttcctgtcctcctggaacaacttcctgtggccgttggtcgcggcccagaccgaggagaagtacacgctgcccgtggcactgtccctctactccaccggccagaacgccacgaactacagcgtcctgctcgccggagcggtactggtggtcaccccgatcctcctcctgttcgtattcctgcagcgctacttcatccagggcgtcgccggaacgggcatcaaatagaaagacatgtcatgaaagaacaatacgagttcccgccggaattcatctggggcgcgtccacggccgcgcaccagattgaagggaacaacgtcgcgagcgactggtgggccagggagcatgccgaacgcacggatctcagcgaaccgtcgggagacgcggccgacagctaccaccgctacggcgaggacatcagaatgctcgccgacgccggattgggcatgtaccgcttctccatcgaatgggcccgcatcgagcccgcggagggctgcttctccaaagcgcagctgctgcactaccgccaaatgatcgacgcgtgccacgagaacggcgtcgagcccatggtcacgctgaaccacatgacactgccgctgtggctcgccaccaagggcggatggctcaacgccgatgccgtcgactacttcgcccggtacgtgcggtacgtgatgccgatcctccacgacgtcacctgggtctgcaccattaacgagccgaacatggtcgcgctgacccgtggcggaaccgaaggcagcgacttcgtggccgcctcgctgcctgcgcccgatccggacatctccgccacgctcgtcaaagcgcacaggaaagccagggaaatactgtccgagaacccgcgtatcaagtccgggtggaccatcgcctgccaggcgttccacgccatgcccggatgcgaacgggagatggaggaataccagtacccgcgcgaggactacttcaccgaggccgcggccggggatgacttcattggggtgcaggcctatctgaggaccttcatcggcaaggatggccccgtaccgatccccgaggacgcggaacgcaccctcaccggctgggagtacttcccgccggcgctgggcatcgccatccgccatacttggaacgtcgccaaacgcacgccgataatcgtcaccgaaaatggcatcgccactgccgatgaccgccggaggatcgactacaccttcggcgccatagccggcatgcacgacgcgatggacgacggcatcgacgtgaggggatacctccactggtccctgctcgacaactacgaatggggctcgttcaccccgacgttcggcctggcctcctgggacagggacaccttcgaacgccatccgaagccatccctggactggctgggatcaatcgcgagaacgggggtcatggccagatagaagccgtttcctctccatccattacatgaaagggcgcacgttttgaaacgtgcgccctttcgtttgatttggcggattcaatagaaaacgggtatagccctcgatctggaagaacatgtccgtccggcggccgatgctcgcggctggcatacgccgaaaacgcagcactgctgttcccgtaaggtcgcatctcccttaacgtgtcaagcgtctcctgatacgttgctgtatcgacgccggtttcgtcattccttgcctttcccgagtggccctgtcggccaagtgcgtttcaactcgagaaaatagccgggttatggcgggccggcggggaggggcgtgctggacgcctgcgcgaactcggtctgacccgattcgctggatgtctagccacaatggaatgacttgatgcgtattccaagccggacggaggatggaatgcatctccacgcggatggcggccgaattcttaagtgtttgcaccagcgttacataaaacgcttagcgaaccgaaatgatgtccggcggaacgtgtccttgcgcgtcttggaaacggatatccgtattcgttcgaaggtttctcgaccaggggatgggctttgctttttcagattgacagtccgtaatcatttcggatatgtcggaatttagacaggaatcccttggatgcgccgcgggcgataaatacgggccgtggtgcgggaaggacctcgaacatgacgattcgaagaacacggtcgcctatttcggcgagcgtgtcgcttcccaccctcggcgaggtcacggccggcaccgcgagcctcagccggtaggagctacccacaggatcattcgtgttggtcggagttctctcgttcggcgacggaattgtatccgtggggtacttcgtcgttgtttctacggacggatccgagggtgtccatccaccagtgttcgcggtcgatgatctctttgggtgacttgttcatgtcgaagatctccaggatcgagtactggaagttcttctcgatgtatccggcgccgaggtttctgagctgcttgtttcccccggagtggtctccggacgcgtattccttccaacgcgacagcagaccgtgcgaggctcctttccgtgagtaggcggaccccacgtaatgccatcccgttcgtctatcggtctgcagatagaccgcctggacgctgccgagggccgcccgccattcctcgttgttcacggccgccacgagctgccggtgcgtcaaccgaacgttctcgtatccagagaacggtaacgcggatacgggggattgagcgattttctcaagggtcatcgtcttgagaaaatcccggcgtcgttcttcattgttggacaggttaaagacgactcccgtgtaacccggatctcttttgtagtacactaccgccctggcctttagcgaggcgtattccgggatctcattgtaacggtatagaatcttgccgtcgttctccgtgtactcgtcgaggacgtcgtaggctccgacgaacagccattgtgtggggtggggattctctggcttgagctgaatgaactggaggactttacgtgtgtgaatctgcgctgttgccttatccttatctggccatttcttcgtgaaaatccacttcatcaggtcatcataggaggaatagtaggcgtcgggaagatcactccatttgccccattccgggttgctgccattcagacgaatgctatagccggctaggtcctcttcgtcgagtcccaatagttcgaggaaccggatcggttccgtatcctggattccgtcttcgatgcgcgtcattgccatcgcctttccattcccgattgccgccggacggtatgattttccggtttgtaagacagtctagcgtcttgatgatgaggattatggaaccggctggctccttgccaggtggacgtggagtccgacgaagggttgcgggtccggctgtcttcgtggaacgacgacggtttgacgtggccgagtgatgggaatgagaccggtcgcgcggtgtctgggcgttatctgttgtcatgtcgccatgtcgcgaaatcggttcgttgttggatgagtgtggtcctgtgaattcttaaatgttgtaccgaatgcaacatgcaacacttggtgaatccgactaggaccatcggaatgcgtcttggaccatttcgaaaacggacgttttcggagcgtaaaccggactgggggagttgtctccgacactccggcggaaagtgtctcaaaacccgtcccgtaatcaacgttccgaaactccatgcctttgacgggtaatggtacggtcggtcaaattgcggtgatgatgggcgttgggcaatccactgtatatcggtatctgaatgaagcggatggcaagcgctgaacagtcgtttcctaaaaatatgttcatatgtcgccggcgtttggcgaaggatcggccgtgcggaccattgtgaccatggatgggaacggcaggctcgccatagacctgcgtcaccaaggtgagggcattggcgcgatgctgctgaagggcaccgcggaataagcctgacctccattccgcaagccggccgggtcgccgcgcgacgttttaccgttaatctgtagaatcgtcggaatcggcgtttgatgcagtcgcgcggtcggaacagtgccgctcgatatccggaaaagtgcggaaatcgggtaaaacgggttttcaaaaagtgcggaaatcgggaaaccagggatgacggccatgttttgacggggtgcgcaatgccatgctcggatgaagggggtgatttcatggcggaatggcgccgttttttaaggggtgcatagggtgcgcaggtggccatggaagggtggctctccctcatgaaatgttacggaagggcaaaaactcgctcataaaagtgtgagatgaggatgccggatgtttcagagaaaacgatggcaaggtcagcgatgaccacatcaccgtatcgccattcgtcacagcagctcgtctctcttaagcgctccgaacgggtcttcctccgtctgatattccattgcatggtctttgaatacgtttgatatacaaaacatatttgttgtgggctgcaagtgcggaaccgggcttatagagacaaagtgcgagcgtattggacggttcgttgtcggacgggtcgtattagagaggtagttcccgatagaccaaatcgtcacggaccgcaaacccctgatgctcccagaaatcgttgccggcatcgttgtctgcgggcacaccgacggcgactttcggcaggccgatcgcacgaagcgcttcaaccactcggcccaccaaaagcgagccaatgcccataccgcgcgcgtcgggatcgaccgccgtgtggtagatgcgcgaccgtctgctatcgtgaccggcaagaatcgctccaataatccttccgccatcgtcttcggctacgaaacaggtgtcgggattgcgtttgaggaacgtttttatcgcatcctcggaatcgtcgatgtccctcatggtgaaaccggtgcatcgcgtccacaacccgtataccagcggataatcttcaattttcatacgacggatggttggtgcaggcccagtcatatttcctccttttctcgttgaacgttagtttcgattttcgtatcgttcgcggtattcctgcgcgcgtatgccgtatttgcgttgcacggccgtctgcagcgcgcgcgtatcggggaaaccgcattcccttgcgatgctggctatcgacgcagaggaacctgacagttttctgcaggcgtcgtccaatcgcaggtcggtcagaaattctttgaacgttttgccggtcgccttgcggaataggcggcagaaatgttccctgccgtatccgaattcccgtgcgacgtcggtcgcttcgagatgctgtttgcggtgcgatgtcatgtatccgatgatctgcatggtgatgtttcttccggatctgaccaattccggccgccgtaccccggaaacgaacctcgaatacagcagcgatagcaattcgtacagcagcatattgagcttgaatccacgaatggcctcatcggactgtccaatacattgtagccaatccattttcattgaaaacgaaatttccgacattgatggcaattacgctttcaaacatgataaactcgttactaaacacgtttagttgctgaatttccaaggaggtaggtttccatggccacgatcagggagatcgcggaaaaggcgggcttctcccaggcgaccgtatcgagaatactcaatgacgacccctcgttctcggtgaaggaggccacccgtcagaagattctgagcaccagcattgagatggggtacgagaacgtcccccgctaccaacgtgtcaccattccgcaagacatcgcgttgctgaacaactccatccacgacaaggggcttcaggacgcctattttgacgagcttgaagtttcattacgtcgccatgccaaggacgagcgcatgagagtgacggaatacaacgatgtcaaatccctgatgaaggacgcgtccaaatacgccggattcatctcaataggtccggcgccgttcaaaaggaacatgttgaagcgtctgcacgcggtccttccgcatggagtgttcatcgacatcaatcccgcgccgagcctgttcgattcggtgcagccggatctggagcagaccattctggacgccttggacgaattgatggacgccggcaacaagcgaatcgggttcatcggagggttcggcaacatcatgggcgaccatgagtatcccgaggatccgcgtgcgttcgcgttccgcaactggaccgtccgtctcggtcttgacgtcgacggcctggtgttcgatgaggggcctttcaccgtggagaacggccgtgccttgggagagaggttcgtggccgaatgtggcgacaggctcccggatgctctgattgtggcggcggaccccatcgccgtaggcgtcttgcaggcgttcgcggcgtccggcattctggttccacgcgacatgcgactggtgagcatcaacaaccaggagatcgcgaattacacttcgccgacgctttcgtcgtatgacatcaacaaggacgaattggccaaggccgcggtattcatgctgtcggaggccatttccatggggcgctccgtcaaccagcatatgaggatttcaaccaagctggtcgcccgggacagtttcaccccgaaagccaggtagggtttaagaagaaagggttcggtcctcgttgacacgcgtaatacgtgccaacgaggaccgaacccttttgcatctgtgaggtgttttcgaaggaaagtctgtcaagccctgttcccgatatggaaacgagggcacggcacggggaaaacatggaagacgtgccgtaccctttcaaggcgccgtctccggtttgatgtcaaggtccacccttgacgacggcaccgtcctttcgccatacgtttccgcgtatggcgaaaggaaagccaagtcccggtttccgccggggcgcgccggtcagatcaggtcgagatcgacgtcgaggctgatcggctggtccgccgggatatggtactgggggtggaccggggacatccaggagtcatctcctccgacacccatctgctcggcaagcacacgcaggaacatgtgcttcggggcggggagctcgtcctgatgctgggcttcctcaagcatgaagctggagtacggctgcaggctcatcgcgaacggttcggcgccttcggcgcggcttatgcgaaggccatggcccttctcgtccgtgatctcggcccaacgcacgtcctcatggttgccggtttcctgcggcatgagatacggggcgtggtccttgaacgcgtcggtgctccacacaccgagcttggcatgcttgcgatcctggtaggtctcctccggaccagcgccgaagaaacgcaggttcgagtactggaccggaagggtccattcgatgccgaacgcggggatggtgggcaggtcgcccggctcgcccgggtattcgacgtgcagattcactcgtccggtggtgtcggcggtgtagctgacggtcaccttggtgcgctgcggggtggcgagctcgtacgtgtaggaggccttgacggtgtcctcgtcgatctgttcgatctcgttgccgatgcagcgggcgtaacggcctgctcccagccactgggcgcgttcgaagccgtggcctgcgccgcgatcgttgtcggtcagcgcgcggaacgtggtgaccgccggacggcgcagcacgaattctcgattgttgaacgtgtaggagaccagtccgccttgggtgcgggaaagcagtacctcgcggccggatccctgcacgccgacgttccaacggccaacggtgacgatgccgtcgaccggcttcaccggagcggaggccttcttggagccggcgacgacggtctggccgaatgccagctcatagccggctaccgcccaattggtcgccttggcgagacgctgggatacctccagcaccagttcggacgcgccgtcgcggtacagatccaacggccagtcgacatcgagcttctccgtcgaaccggccggcacgtcgaaacggcgttcggactgccataccggttcgccatccgcaaggacacgcaacacgaacgtgtattcgccagtggaggtgaacagattatcgttcttgatggtcacggaatcctcggcgacatcgatatgcacgttggaatacagctgcttgacctcctgggccttcggcgtgggcttacggtccgcaaacaccaggccgttgccggagaactcgtagtcgctcggcctgtcgccgaagtcgccgccatagcgaaggctcgtggttccatcgggctgggtggcgtagatcgcctggtcgatgaagtcccagatgaagccgccctggtacttcggatagtgttcgagcgcggtgtattcgtccatgttgccgcacgaattgcccatggcgtgcatgtactcgcaggagatgtaaggcttctgcggatcattcttcaggtattcctcgatggcgtcggcgtgcgcatacatgcgggtctcgatgtcggtcacgtcgtcgtagtcgcggttgtgggtcacgccctcatagtgcacgggacggttcgggtcgatgtcgtgcacgcgcttgtacatggcgcggaacacgtcgcccgtgtaggattcgttgccgagagaccagatcaggacgctcggatggttgtagtcgcggcgcaccatgctgttgacacggtcgacgcacgcgccctcccaatgcgccttgcttcccgggacggcggtctcctcggtgaggacgtcaccgggcaggcaccagctgccatgggtctcgaggttggtctcgtcgatcaggtagatgccgtactcgtcgcacagctcgtaccagcgctcctggttcggatagtgggaggtcctgatggcgttgaggttgtgcctcttgcagaagaccacatcgtcgatcatgtcctgctcggtgatcgcgcggccgcgcttgggatcgaactcgtggcggtcggcgcccttgaatacgatgcgtttgccattaatcgtcatgatgccgtcctcgatgcggaagcggcggaatccgaccttctggacggcgacctcggcgatgttgccggcatggtcgatgaccgtgacctcgaactcgtagaggaccggatcctccgcgctccacgggcggatgccgttcaacgatccggtggagatggaggtatcggggtcagcgcagttcgcggtctcccagacgacgttaccatcggaattcttcaacgtcgccgagatcgtggccgcgtcggttgcgttgcgcacggtgagcgccgcgtccaaagaggcgctgccggactccggatcccaatcggattcgatctgcatgttctcgatatgcacatgcggctgcgcggccagctcgaccgagcggaacagtccgtgcagacgccagaagtcctggtcctcgagccatgaggcgctggagtattcgtagcatgcgacggcaacgacgttctcgccgtcgtgcagcatctcggtgatgtcgaattcgttgggggtgaagccgtcctcgccatagccgacgaacatgccgttgacccacacgtagattgcggtggccatgccgtggaacacgatggagacggttccgccggcgttcttggtgtcggccagacggttcgccatcgtgaaggtcttacggtagagggcgacatggttgttctccggaatattcggttccgtcggattctcgtggccatcccacgggtattgaatgttcacgtacttgttgttcatcaatcccgccatctgcaggtgtccgggaacctggatgcgttcgaaggcggaatcgtcgaagttctcccttacgaagggctcctcgttgaattcgatgtcggatgcctgaacgacctcgaccctccattcgccgtcgaggctctgcctcagatcggaccattcgttggtctgcggatcgtgcgcgtagcatttgtggtcggaatgcgccgggatgcggttgacctcgaatacggtcgaatcggcgagccaggtctcggatgcgtgttcgatgcgggtttcgtttgccatgttttcctgctttcgttcattacatctttgtgaatgatggagggaagatgaacttcctttaccagataataaacattgtttacaaaaaaggcaaatcggttttacttgacgtcttaattccttcgtgtcagcggtatatgttgtaacgtatcaggcatctgattgataccgatatgacagtgctggtacacggtttacctaattcaacacgccgccaaaccctatattttgctaatggtttttactttttcttgtaaagagcgtatactcgacatgcaagatcaatgggtgatcttcaactccggaatcttaaggagaagaaaaaatgagcaacgaaacgacaaccgcggacggtggcgtccgcaagaagggcaagctcggccagcgtatcgcctacgcctgcggcaacctcggtcagtccgccttctacaacgcgatgagcacatatttcatcgtctatgtcaccggctgcctgttctcgggcgttgacaaggcgcttgcggccaagcttatcggtgtcatcaccagcctcgtggtgattatccgtatcgccgagatcttcatcgacccgctgctgggcaacctcatcgacaacaccaacaccaagtggggacgcttccgcccatggcagttcttcggcggcctgatctccgccgtcctgctcgccgtgatcttcagcggcatgttcggcctggtgaacgtcaacaccacgctgttcatcgtgctgttcgtcatcaccttcgtcgtgctcgacgtgttctactccctgcgtgacatctcctactggggcatgatcccggcgctgtcctccgactcccacgagcgctccacctacaccgccctcggctccttcaccggctccatcggctacaacggcatcaccgtcgtggtcatcccgatcgtcagctacttcacttggacgctcaccggtgccaagggcgaaggacaggccggctggacctccttcggcatcatcgtcggactcctcggcatcctgaccgcatggaccgtcgcgttcggcaccaaggaaagcaccaacgcactgcgcgccaaggcccagaagaacggcaacccgctcgaggcattcaaggccctgttccagaacgaccagctcctgtgggtcgccctgtcctacctgctgtacgccatcgccaacgtggccaccaccggcgtactcctcttcctgttcaagttcgtgctcgacaaccaggccgcctactccatgaccggcgtcatcgccttggtggcaggcctcatcatggctccgctgtacccgatcctgaacaagcgcatcccacgccgagtcctgtacatcgtcggcatgacctccatgatcgtggcctacatcctgctgggtctcttctccaccaacatgaccgtggtgttcatcgccctcgtgctcttctacatcccgggcaccctcatccagatgaccgccatcctctccctgaccgactccatcgaatacggccagctgaagaacggcaagcgcaacgaggccgtcaccctgtccgtacgtccgatgcttgataagattggcggcgcgctgtccaacggcatcaccggcttcatcgccgtcgctgctggcatgaccggcaacgccaccgcagccgatatgaccccctccaacatccacaccttcgaaatctgcgccttctatgtgccgcttattctgatcgtgctcagcctgctggtgttcatgttcaaggtcaagatcgacgagaagatgcatgctaagattgtcaaagagctcgaagccaagcttgcctccggcgaaatcgtcgatgacgaagctcagaccgccgagaccgtcgaggccatcgatgaggaggccaaaaccctgaccgaataaataccaatacttgccactccttccctttttcaccaagaaggccccgaccatgtcggggccttcttggtttatgtgatggtaatggtgcggtaagttatttcaaaaatcttctggcaaaccgatgaatatacaaaagaatcaatcggaatgacatgcggcgacggggatgacatgcctgcaatcaaggcataacgaaacaagagaaaaaagaatagcggcgaacggaagacaaagcgccgcggaaaaggaatgaacatgcagaacgacactttcaaccagatcctcaactccaacctcgcctccatggatccgggcttcggccagttcgccctcgccaaggcatcctccgacctgttcaagaaggtcatcaacaagtaaggcgcaaagacttcttctgtttcctttcaaaagaaaaggtgccgcaccagatttcgtgggaataatggtgcggcaccttttttcttttcaaccccggcgttttgacttggcctacaacggcattccaatggatgcgcttcgggattgacgaaagaaccggtttttgtctataaaaggaccttatcgggatcttatatcttctcccgcaatggagacgggcaaggaagcatggccttcgccacttccacaatacgagttttacaaacaatcaaaagagagataatggtcaaggcagtttaaaggggaactcctttggctccatttcaggagcgattttcacttaagaaagctgtgcgccttcgggttccggacgagatcgggaaagtgcgcgatgtccgcatcgcacgtttcccatcggttcgaagtcgaacgcgtgcgtcgtcacattaggtggagtcaatccacggaaattgtctgtagggcagatctcgattcgttcctgattggagccaaaacgcatcgaatggtgcatcgcaagatggaggacgccaggcgtatcccggatgaagcgaccggaatgaacgccagcgattgctccgtcggatccaaccttaacggatccggcatatcccgtcagaccttcgtgtccctcacagcagaaggtcctgacgggatatgtttcgatgcgcattgcgccgatgattcgtcggcggacacgacagaatcaaactagccggtttcgatgggacagatgggcggatgctttgcctctgggctttgcttatgcggaccggttcacgtgtcctcgtcttcccgtggctatccttcgacttcgccataaagggtgtacggcgatgaagaaagcgttgtatggaattgtcgcacaacgcttaactgatgacttatggtctacgacatcacacgaacttgatcctccaatggcgattcgttccaccggtatatgtccgattcatctggtcttgaacaagcggaacaggtctttttcacgaatcagtatgactgcgatcgccgttcccatggccgtggcgcacggcaacggcagaccgtcatgcagctccaggaggaaaatggcaagtgagtcggacggggttggattcatcgtgccgatgagaatgaacagtgccgaatatgccatgacgagtcctatgaacgtgggaatcagctgttcgcatagcatctgcgcgaggatgagcgtttttctggtacctacatgcagatctcctgcgatttcaagattttttaggcggggaatcctcgcctaaaaaatcttgaaagaatgacacgcctcatcaaatcgaaatccgaaatgcataatacgtggtggatcgtcccagtcggcaacattggccaaatcaaggcaaaggcaaccgccaaaaaaggtctcgcactatcactatcgatggaatcccatctaaattccatgcaatcgcatacaaatacattgacgagaagcgaacgtgctggggagtgatgatcgttatgatgatgacaaaacaaccaaagccacgcaagaaaaaagccatagagcacgaaccgccaatcccacagccgaacattaagcaacaatcacaaccgttattcgacaacgaagaacagctcggccatatttatcgttagcggtctactggatattatccttttgtggcattctccacgtctgtagaggcgaggagaatgccacacgcagagaagctggtagggcaaaagacatgcctgacttaacttaagtgttgtcatacgatataacacaacatattgtgaacatatcatcaaaaacgacgatgccatctgtcgtaagaaaggcgatatgccatgtgaacgttcacatggcatatcgcctcattaatgagccattattgtttgacgacgagtacgccattgggattgatggtaaccgtcgcgccagcacagtcggccagtgacatgacgaccgggcgtccctccaccagcatgctgacaggttctttggtccggttgaacaggaacgtgaaccgagcccccgtcgactcatcgacgcgctcgatgcgaagcaagtccggatccgaggagtctttgacttccacaccaagggtctcgaggatcatcggcaggcttctggcgatgccgtcacgtcccagccgggctccgacgtagacgctacgcccttcgccatatggattggacacgatggccgggcgtccgtccataccggtccatgggtcatccttgaacgaggcgagcaccttcgcgtccttcccgattgagccgatcacgtcgacgatgtcgtgtgcgacggctccgttgtcgagatcgaggtggtccggaactccgggccaatcggatcccataggggcgaactcctcgatcctcacaccgacgacgtcccggatggaacctgggtaaccgccgagccacacatggtcccgttcgtcgctgatgcctgtatagtacgtggcgatgagcttgccgccgttcgcgacgtagtccctcaccctatgggtgttctcctcggagaggatgtacacgctcggcagtatcgcgacatcgtactcgtcccagttcgaacggattggaacgacgtccgcggtcacgccgacgtccgccagagcgcggaaccatgcgagcggctcgtcgacatgatggacgttctgcgtcggggtcgcggtgtgctcgctcgcccattcggactcgtaatcgaacacgatggccacgctggatttcgccagcttggtgccgagcagtccctcatccgcaagcgtgcccagatcacggcccagttcgcacacgtcccggaacgtctgggaatcctcccccgcatgcggcagcatcgcggaatggaacttctccgcgccggacctggattggcgccactggaagtagcacacggcatcggctcccatggccacgtgcgccaaggaatcgcgcaccagctggccgggttccttgcgatagttgatcggtctccagttcacggccgaggtggaatgctccatcaggaaccacggatccttgcgggagatgccgtccaccaacgaagccgagaacgcgagctcgtccagatgcgcctcgcccggaatgaagtaatggtcgttcgacacgaaatcgacctcgccgccccaatcgtcgtaatccagtacggaaccgccggcggagaccatgaaattcgtggtcaacggcttttctggtgtgatttcggccaatgcgtcacgttcggccacatagaatgacttcagcgcgtcggagctgaagcgtttgaagtcgagcagcttgccggggttcatgaaattgccgtcgccgatgaatcgaggcggaacgatttcgctgaaatcgttcagatgctgggcccagaacgcagtaccccatgcgtcgttcaccgcttcgatcgtgccgtaccgttcctcgcaccagtcttggaacgcgcgttcggcgtcctcggaatagtcgaagcggttgtggcatccgtactcgttaccaacgtgccaagcgaccacatagggattgtccttgtaatgctccgccatcgcccggcagagcttcaatgcgtactcacagaacacaggactggtgggacgccagtgctggcgcgcgcccggctggcacacgtcaccgcggtagtccttccacagcacctcgggatgcgcctggggcagccacatcggcggggatgcggtcgcggaagcgagatctacggcgatgccggccttgccgagattgtcgatgattcggtcgagccagccgaaatcgtacacgtcctcgcggggttcgattttcgcccaggagaagatgcccacggatacgaggttcactcccgccttgaccatgaggcgcacgtcctcgtcccagacctcctcgggccactggtcgggattgtagtcgccgccgtaccagatacgggcccgccggccctccaacggccgaggccaacgatgttctctacgttggttcattgtcattgttcctttcgttcgtcattgaaccttgaaatcaattatctcaccggatgcccgttgcaccagacgcgtcgcaccgtccaggtttcctgatcaaggagcagcacgtcggccgcgaatcccggagcgagcagaccgatcgggaagcctgtcacgtcatttcgacggtcgaagccaaatgcccgcgcaggggtcagcgtcgccgcttccaccgcgtcgaccggactgatgccgagctccagcaccgcgcgagacacggccttttccaatagcagtgtagaaccggcgatggctccattggaggcgagtctggcatgaccgtcccgcacatctacatccagagccccgaggaggtaatgcccgtccggacagtcggtcgcggccatggcgtcggtgacgaaggcgattctatggggcgcaagcccgaatccgagcttgaccatgggatcctgcacgtggaatccgtcgttgataagctcgatggtgaccctcggatcctccactgccgccggaatcgggccggggtcgcggtggtgcagcccgttcatggcattgaacatatgggtcatgattccggctccggcgtcgaatccttttctggcagtctggtagtcggcatcgcagtggccgaccgccggaaccactccggccaggaagaaacggcggattgcgtcgattccatgcggaagttccggcgcgatggtgatctgtctgagacacccatcggcggcgtccagcattctggatacgagatccggagtgggatcgactaggcaattgggatcatgggcgcctttccgggacatggcgaggaacggtccttcgaggtgcgcgcccagaatatccgggcggtccggcatcatgtcgtggaccgtcttcaagttaccgcagatgacgtcgatgggattggtgatgaggctcaggacctgtctcgtcgttccgtgcgccatgtgtccggctcgggcggtcgtgatccccttctcgccgtcatcgaacgagcttccccatgcgccgtgcgagtggatgtcgacgtatccgggcgtcatcaccattccgttagcgttaacaatatgatcttgctcgacgtggatcagccggcaggccgtttcgaagtccgtttcggcgcatcccgtttcgactatcgaccgtccgtcggaaacgagccaaccgtttttcgtcattccacgcgcgtcgacgattgtggcgccgtgcaccgcgaatggcacgacctcctcgaggaacgcgtcgttgattcgttccgtctctctcacacgatccgcctgcatgctgttgtctcctaacgtcagaatacgggaagaggggcctgtggacccttccggccggcaaacccctgtttcctggacgtccgccggcgggaagtcgagggtggcgaacgcgcccagcaccaggcccgcgtcccggctccgtccgacggaatggccggcgatgcccctgtccgccaggccggccagcggacacacgtacgcccggtctccgccgacgcggacataggtaagatcgcccgccggatgcgtgtgcggggcgtagccgtcggacccgcggtccggcaggttcgcgagcccggcctcgtcggcccgcgtcctgtgcggttcggaccgtccgcgcgcgtatgcgccctcggctcgtcaggcccacgaaacgtatgattcttgctgtgggcttcggcatatgcttgagccgccgacttcttggccttgctgatctcaccattcgccgtggtcagatcggacttggtttgggcgatatccttctgcgcctgcgtcaaatcggtcttggcctgtgccagcgtcttggacgccgcgtcaagattcgacttgttggcttgaatgtccttttgagcctgcgcaatcttggaggtattgtccttcagcgtggcgttggccgtgccgatggccgactggttcgccttgatgtcagccttcgctgactcaagctccttcgacgtggcagcctgcgcctgctgattcgccgcaatgtccttctgcgcctgcgtcagcttcgcagaattatccttcaacgccgtctgattgtcggccaaatccttttgaatctgcttgacctcttcaggcgagacggcggaagccacggtcacagtggcaatcgcagaccagtcagacttattgcccgcatgatcgacagcacgaaacgcatatgtatgcgaagagccagccgtcaaaccggtgatgacgtaatcgccctgccccgactgggtggcgctgatgacctgcattccagccgcattgatgccctcgcccacctcgatatggtcgaagtcaggctccatctgcgcgccggcagcggtcttgccgtcccagtggatggtgaccacgccaagctcagaggaaagcaccggcttggatggtacggcgcatggcgtcgtatccgactccacagttgccaccacgacggccgaccattcgccgagcttgtccgaatacgtcggcacagccctgacgcgcacctcgatttgcgtgccgcaatccaagcctccgaaaccgagctgcgtcttgtcagccgtgccggcggaatgccagggcgcgccatccttgtgcagcttccactcgaccgtataggtggagatttcgattgatgtgtcgttcgtggcctgcgtgaccgcgctccacgaggctgtggccagaccatgcgcatagccatccgagcctatataggcgtcggtctgcacgacaagtccctgcggggccttcggcacgcgatggtcacggtcggacgaggcggtcgtgccaccctcgctgccggccaacgcggcgccacccgtgatgccctttatcttcttcgcctgcttgaccgaggcatcatacttgatgtcgttcagtgcgaggctggcggatagtccctcgccctggcgcatgctcaggtcgatttcctgcacgcgcaccttctccccatgggagacggtcggcgccgtaatccaatcgccgggatgatagtcgacgagcggcagactatccacgtcattgacgatgagattgcgcgtgtactggcctctcaccctcgccgcgtcatcgagcgtggattgcatgaaagcctgcgccgtgtccttgtcggacacgccaccctgcgagctgtaggattcccacttgccccacggcgtcggagcagccggattatccatgcggaagaggaggttattgtcaccctcgacgaggatggtggacgcgaggtcggcgatggactcctcgaagggtgcctcgctgatgtcacgtgcaagctggagcacgacgctcttgctcaggtcgcggctcaaggcggtgctgtcggcattccacagcttgagcgtcctgccggacgtgcgccagtcgcagccgccaccattgacaagagcactcaggatggtctgcaaatcagtgccgagcgaatagtacagagtgtacttttttgcccaattactgccagccgcgtccttggccgtgtcgaagcccaaggtcaggccggtggccacgccaccacgcgcccggttttcgtcaagcatggtcttcaaaatcacgcccggattagccgaataaaatggcctcttgcctttgttgtcaccatccgcgagcagatgcgaagaatcgttgttctccgccttgctcagcagccagctgatcgactggccggaataggtgacggtgcgcgtccggtcatcggtcttgccggaacggcccgtgatgacgaaacgcgcgttgtcaggctcgcgatagccggttccgtcagacacttccacggccacctcaagaccatcggtaagctctcggtcgaatgcctgcgcgtcaccggacagcagcgagtattcgatgctgattgcgccatcatcattgtggagcatggacgcgctgaagctcaccggctcggccagcacaccgatgcgctcaccgaatggacgataggccacaagacgggcatgaagggactttgccatgaatcactcccaggattgcaaaaaccggcagaccacattgtccgtgccgccggtctgtttgatggtgatgcgataatcgccggaatcgatcgcgggccacacttgcagtggctcggtggtccagtcgatgccattcgatgcgtccgtaccaccggaccatgcgtcggcattggccgccgtccacaccttgcgattggccgcgtcgacgaagagataaggtcgtgaggcgtcacgtttgccaccccacagcagattcgtgccactcaccgggtcactgatggtcacaccagtgactgcgccgaaacgcaagaccagtatgccgattggcgcattggacagccagccgtccggcatgatgtcgaaaagctcggacggactggcgttaggcaatccctgccagcgcgtccaatacccattgctactcggcttggagaccccgcccggcagcagcctgccgcccgacgcggccaacgtcgcctcctgccactgcacgccacgccaaaacacgtcaggcaattggaaaactgcggtcatgacgcgcaggtcactggacggcctctcatcatcgtccggctcgcaggacgtgcacacgacgcgagtgaccatgctgcgcgacctgccgtcctccgtggtctccaccctgccgagcgtgagcttcgcggcagacaggcacatggcacggaaacgcgagatcagcgcatcggaatccgcaccccacgccgccaccttgactgtcagctccggagcatccaacaccggaatggacgagccgacgatgaagccgtgccgtccaggcacctgcacggtgtccacgatcggcgacagcgccgtgtagtgcgtcgtgcctacaagcacgcgcatccgctcggaatcgagcggctggccgttgagagaatagctgaccttcatccggattccttccgattaccattgcggcatggccgctgtctgcagcttctgctgcgtggaaatgctcgtcggcgcgatggccggatagttgaacgtctgcgtgatgttcgtcacgctccccccattgccgtaggaggcagcgttaacgccacgcgaggcgttggcgacgccgacggaatacgaggcgtcctgcgaaggtagaatgccagtcaatcgtccggcagccttcctcaccttcgacgcgctctcgtcgatgccgaccgccatgccctcgccgatcatctcaccgacctgatcgcggaacacgcgtgacggagaatggatgccaagcttgcgtttcacccaatccaacgcgttcgtggccgcgttgactgcggcggtcacgagtctgcctgccgcgcctgcgatgccggtcgcgatacccgtgatgatattcaggccgacgctcccccagttaaccgatgtgaaaccgcgcatgatctggccgaccacgccggggatggcgccgataagccgtggaaccgacgaaatgaaaccgttggccagtgcgaagagcagctgtacgccagcctgcaggatctgcgggagacgattgatgatgccaccgaccagttgtccgataaggatcggagccttgcctaccaagtccggcatggcgttgatgaggccctgcgccagtccgaggataagcttcaaaccgctgtcgatgatctgcggcaggttgttgaggatgccttgcacgaggttaaggacggcgttgatgccgatagggatgagctgcggcaactgggccgacaatccatccagcagcgtcgtcagcacggtcaccgccgtggacgcgatctgaggcaatgcctgcacgatgccctgcaagaggttcgtgaccatcgtcgatccggtttgcaaaaacgacggcagggtcgacgtgacccacaattggaactgggcgagcagctggggcaggctcgtcgagatccatgtcgtcgcgctggtcagcagcatcgtgccgagctgtcccaacgctccgagcactggcggaagaatctgcatgaccagtgccggcagcgtgctgcccaatgaggagaacagttgtggcagtgcggcggtgatgccggtgatgatctgcgcgatgcgcggacccacgttctcgatgaccgtgccgaccgaatctaccagctgcttggtcaatccgttgatgtcggcattgtccttgccgagctccgccagccagttctgccatgcggccttcatcatgccgacagagccctcgatggttgtcgcggcctccttggcggtggtgccgctgatgcccatctgctcctgcatgatgtggatcgcctgcaccacgtcggagaacttgtcgatggacaggtcgcccatctccccgttcgcctgcttgaccttgttcgcgtcctggatcagacgctccatctcggatttcgttccgccgtagccaagcttcagattgtcgagcatggcgtaattgccgcgcgccagagactggtaggtctgctggatggactcgatgtcggtgcccatcttgttggcgttgtccgacatgtcgaccatggcggtgttgccgagttccgcggccttcgcagtgtcgccgccgagcgagctgatcagcgaggcggaaaagctcgtgacctgcgtcatgtactcgttggcgctcactccggctgtccggtacgcttccgccgcgtatttctgcacggtgcccgaagcgtccttgaacagcgtgtccacgccgccgacggcctgctcgtatgtcgcgtatgcgtcgagagcgctcttgccgacgcctgccaaagccgcgacggcggtgccaacgcctgcaagtccgacagtggcaacacccttcaacgcgccgacggccttgccagacatggagctgatcgcattccatgcggtgtcggctccgcttttgagcttggagcctatcgcagacgcgacactgccggcggctccgggaatctgcgaaagcacgccgccgaccgcgccgccgacgttgccgagatagccgccgatggcattgctgacgtttttgaaaggcgctgggatccttgccgcgatggccgagctcatcgcggagaacttcgcagacaatggcgcggtaagacgtgacgcggtggattgcatggcagcgccggcagcgctcatgccgtcgcgggctttcgtggcgatgccggagaacgccgacgttgccgcgtttttgacccgtccgaacgcgccggagaccggctggattatcgccgaaccaagattcttgaacgccgatccaagcgaaccactgctggaagcgagattgtcctgcgcgtccttgagcgccttctgcgcatccttcaaccggttctcggcctgcgtcgcccggtcggtcatggtggacagcttcagccgcgcctgttcgagtctgatggtcgcggcctcggcctgcgtgctgccctcgccgtgcttggcgacggcattggcgacgctttcctcggcggcacgcacctgattcgccgcggccttctgctggagcatggactgacggtatgcggccgtggatttcgccacgtcacgctcataggatttcagcacgtccgcgccgaacgcgttcgccgactgtttgaacccgtttttgaacgcgcgtccgaacagtccgccgcttttgccgccgttcatgctcgaatcgaaggtcttcgacgcggccttgccgctcgcgccgacctccttgttgaccgtgctgcggaaacccttcatggaagggaacacgctgatatgcgcggaaccaagttcgctgccgaacgccatgcggaacctccactattcagttattcagtcttcgtaaagagtccggaataccgggctcatgcccttggtctgttcgcgcagccgctcacgctcggccttctccctgtccgcccgcaatcgtttcgcaagcgaatcgaaaggtttcggatactcttcgccgcccagcgcgtagatgaccagcatctcgccccaacgggccggatagtccaggccgttgagctccgcgcctgtgtaggttgacgggtctccaatgagctgttcgagcagcgctatcgcgtcgccgtagcggagcctgccgccaaggtcggtttgcaggctccagccacgtgccgtgaaatcggctcggatcacgctcccgtggtcggcgagctggcgggcgaaccattggattttcccagtgaggctccctgcgcgcgcactaccgcgtcgccgtagtcggacaggaggttgaacaccacctgcaccggttcgccgttcagcgctttcgcctgtttgtcgccagcgaaggcgcttagaatgcgtttgagctgttcgacgctctccgtatcgtcggacgtgttcgacagtttggtgaaatcgtcgatgctcatcgacagtggaagcttgtacgtgcgtccgccaggcacgagcgcccaatacacatcgcccttgatgatgtggcgcaccttgtagttctgcgcaatggaggcgaacgcctcctcatcgtttttctccgtccactggtcgaaatcctcgacggtcggcttgaagtcggtggaagttgaagtcattgtcttgtcctatctgcttttcgcctgcctgccgtgaaaaaagaagtcccggaccgcgcagacaggcgagatgggcggtccgggaagattttcgtccgccggtcaggcggcgcgtgtggtgacggtgaccgtcagatctggtgaggtcacgccgtcatatgtggcgttgagcctcgcgcttccggccttgacggcggttagcgtgcctccctcgacggtcgccacgcctgcatccttggacttgaatgtggcctgtccggtcacgtccacggtggtcttgtccacatgtgtggcgacggccttgagcgcgagcttcgcgccttggacgaccgacggcttcgtgttgccgtcagccgaggtcacggccaccgccgtcacgcttttgggtcgtaccagctttcgatccagcgggtgttcggatgctccgcatccacatacagcggatccttcatccattcgacggtcaatgcgcggccggtgaccgagccacgctcctgctggtccggctcgttgccggtgacctgcatgacgccggcacgacggtggacgcgcccggtgtcgaacgtctcctcttcgtacaccatccatttcgcgtcctggatgatgtcggccacgtggtagacgccctgcgcgtccggctcgccgatggtgatcttgcgggtcagcgcgttgttttcggccggactgaacgtctgcgtgaggctggtcgccaacggcagcttcttgtaaccgtcctgcaaaaactccagcgggtcgtcgccgtcgcgcgaatcctgattgccgccgtcggacttgacgagtccgatgcatgcggtcgaccgattgtaggcggccggaagttccggcgttgcattgcttgatgcgatcatctccggcgtgattttgttttcggtggagtacgggacgatcatgatggcggcggtgacgagcgcctccacctgtcccagatccatgccctgactgtctttggccatggcgtttcctttctatggttgtctgattccggccgtcgaatattcgacggtcatgtagtagcggcaccatgccgcgtcctcgctgaccgggtacgggccgttgcatccgtcaggcacgacggcgcagatgcggctgccttcggcgaatccgatgaggatgccgggctctccggtcagcacaccgtacacgcgggccgccagatcgcggcatggtttcgtatcgttgcgcgtccatccgagcacgttgacgcctatcgacctgtcgaacgtcacacggtcggcggattgcgtgccgccgtcatcacgcacgaccacgagcggataggagccgtcgtaaccatccggaatgcggtttccgacctgcaggcccgcgacgtccgtgatgttggagcgcagccatccggtaaggaacagttcgaggtctggtggaatgacgcttgccatcagaccctcgccttcctcaacgccttggccagattgccggtccgcgactccacgagcagggtcttcggatcgtggccgacgaccatgacggtcgttcggtgctcccttttgacctcctcgattccaaggccgtcgcggtatgcgccggtatctaccggagctgacgccttcgcgtaggcgagtgccctgttcgcagccagcgtggtgagcgacttgactccggcgctgttgagaatctcgtcgaagaatttctggttgaagttgaccgatatcctgcttttcgccatttgttcagccctttctttccgtcagacggcattccaaggtcggacgccagccggtgaacgcgttcgcgtccttcgaggggaatccgtcgacttcccacaagcgtccgtcgtcggggtctgcgcggatccggtcgccgattttcacgtcggctgtcgaatccgggatggtgaggtacgctgtggatgcggtttgtgtgtcgagcgtgtccggcgtgcgcatgctggagctggaggcgagggcgcccgtgatggctagctcgtccggaggcacgctccagtctggctcgttctgcgccgaattgtacaaattggccttgcgtttggcgcgcagtcgaataaagcgcgtggccccagccatggcggaaacgccgacagcggagttcaggtcgtcgatcaggctcacggcaaccctccaagcttgtagggtttgagcttgtcccgttcctcctgcatgagcgacacgacgtcgaagcttgcgctgctgccattcgttgactgcgaggtgataagcccaagcggactcatgccggcacgtttcgcggcgctgataagcaccgactgcacgtccggcgcgtcatcatagccagcatgaatctcgtagcggatggccgcgattccggcggggaagccaccggacaaggattcaaccaaacccgtctcaggatcgtaggcgtaagccagcttgttgccatcacggtcggtcaatgattcgatgctcgtcacatgacgcgcgggcagccgaatcaccatgccgccacgcgagttgagcacgccggacaattccgtgttcggcatgacatgccaaccgcattcacgcctgatcgccgactgcgcggccttaagccgaaactgcgcgtcatcctcgaaagccgaagggtcggcaatcatgtcaggaatcacattcacatcactcatgccgacccccacgcttactctgcagccatcaggccagccgcaatcagagaattgaccagggcgtcgaattcactcttggttggcgtgtcgccggcggccaaagccacatgcgttgcaggcttcactgcagcgctgccaatatcggtcggcttgccgttggccccgacgaagaccacatcggccacgttggcattcgggtcaagtttcgccgccgaggctggaatcactcgaaactgtcgagccatatcacgtctccttacttaagggtcagcttgacgaaagccttcggcttgcgcacggccaaagccacacgctccttggcgcgaatggtcaccagatcggaaatgaagtcggtgtcattggaattggtggcctcaaccgtcacaccgcccttgcgatagaaggtggcagcgcccttaaaggagccgacgatggctgtgccggcatcgacagcgggagtcaccacggtgtccagaccccagaggcgcggagtgatggtcaatgcgccaccattcacgccgtagaacggtccaccgccgatgaaattgccatcattgtccttcttcaatcgaatggcctcatagtctgtcggattgatgacaagggcatccggcatcatgccggtcgtggtggagatcatcgactgcgcgtgcagtacggcaacgtcattgccggcatcggtggcggtgtatgactggattccttcacgattcagcaggcccttgatgttcttgccggtaccgtcgccgttgagcagctgcttctcctcgacgatgctcaagtcgtagagcaggcgtccatcgatgtcggacttcaagaattcgaggtcggtgatcatgtcgttggattccttgatgaatccagcgatggtggataatgcgtcggtgtgctcggtggcgtcggcgtaatggatctggctgaattcctcgccttcgccgacggttttgaaatcgccttccttttcgccttccacgtagtagatgatggcctggccgctgatcgcgccgacaccgaacaggttggtgatggtcggacggcggtaagcctggacgaaattcggatccacgtaggtcaacagcgagccgtacacgccggacgggccgccggtaacctgcgtgtcagtgttgcccttgcggctcggagcccattccggtgctgcgattgacgctccggacactccctttatcttcgccagctgttcgccgatgttcttcacgacgaaatcgccaagagattcgtcggatgcggctccgctcttctgggtgtccgccagattgtcggtcaatcccgcgaaacgcttatgcaccgcatccaacgtttcgatggaatcctgcaattcgtgcgcttcggcgttcagccccttcagcttctcgatgtcggaagcgtcgagattatcctcgcccttggccagcaccgcttcgatggcggccttggtcttggcgagacgatcattgaaactcatttggtctccttgttgtccttgccgccagtgaccagttcacgggcggatttgattacgttcagacgctcggccttctcggcctccgcgtccctgcccttatcaggggcaagcttcttatcatcctttttctcgccggtcttggaatcatccggcttatcttcatcggaagtgctggaattgtcggaatcaatgccttccaacacctcgttcagcgacgccaatgcggcacgaagcttctcctcgttggcggagctgatggcgcgacctgacttgacggccaggatctcggcctgctggttcgcggccaccggcaccacgctgatctcgaaaagcttgatctgctggaattcggaatggccgccccacgggccgtcgcccttttccgtgatccacgcggtcttcgtcggcacgaagccgatgctcatctgatgaaccctgccatccttgagcaggtcgtaagcctgctgggcggtcggattatcctcgatatcgagctgggccgagatgagcagacccttctcgtcctccacggcgctcaaggtgcgtccgatgatgtcggtcggcttgccgtcctgatggttccaatggatcgggatgccggctccgccggcgtagtccttctccaaggtctccgcgaaagcgcccttggcgatcacgtcaccctgcaggtccttgttgccgaaagtgctggcgtagccgctgaaaacgccttcgccagcggaatcatccaaggatttcacgttgaatctgagctgtttgagattcactgtccttctccgttcactggattgttctgttgcgcgttctgcgtcctgccgccatcctgcgggctgggctgggcgcctgttgccacattcaagggcgtcaccaattcgtcgccaccatcaagcttcggatagttgaggatgcgccgcgcctcgttcgtggtcatgaagctgcgccccgtggccgtgctgagcgcctgatactgctcggagaacgtgccgcgcagcttcgcatccacattcgcttcgatgtaggcgtccggctggccgagcgcgtctggcagaagcagattgagcgactgttcgaaagccacgatgtacggcatcaattccacattccacatctgctccttgaaggaagcgatgttggaattcgtgccactgcgaaagccaagattctccggcgcgatatggaaggcgttggccacgtctatgcgaatcctgtccctcgcgtcgatgtcctgcatgtcaatcggcttgaacgcgtccacggtcttgatttccatgccgtcgttgagcaacggccagccaccggcaagattgcctccagccttgtagttcctcatgccctgcacgaattcgtcctgcgcctcctgcgacggccacggcatctccttcgggcgggagatgtacgctggaatctggccgccgttcttcgctatcgcacgccgatattcggccatctcacgcgcctccgccaaaagtggtgcgagagtgccggacaccggagaaccgccgatgccggacgtgctatagcccacatcaagcagaatctgcgggtctggcagtttgaaatactggcttccttccggctgtccggtactgatctgcacgccggtgatctcatcaagagtgttgccggaaagcgtgaaattctgcaccggaatacgccgcagccacaatctgccggactgcttgtcggcatcgagcaggcaaagccaccggtcattgagcaggccatcgcacagcaaagagtagaagaaccggtagcgggtcatgccaggaagcacgctcggcctggccatcaattgcgccaatgggcttgtggtgtcctccacgcgatcgccgtcagattgacgtcggtagaccttgaagggcatgctggcgatgttccgcgcgatatggtcgatgacggtacgcaccgccgcctcacgctcatacactccagcgccgaaccagtcgatgggaatctgcgccacctgtgaaatgttcactggcgattcggagaacttctgggccacggatacggggcttttcttgagccatctggaaaagaaacccatgaaacctcctcattgggtcatacgaccgcgaaatgcgtcacgctcggcgaatatttcggcgtttctgcttcgacctgcatggtctcaagcgcgtacaatgcctcgctctcggcgatgaggccgctgatctgcagggcgcttttcgcgcggtcccacacctcgacctcaccgagacgccttgtcacggccacgctcacctgctgttcgatggcgggctgcggcaggtgccggagcttgccttcgcgcacgcggtcgaggaagcggccgcagcacgcgcccaatcggaagccctcgatgagatgcacgttccagcctttttcggtgagcgggtcgatgaaatcgaccgccggacaacccttagactgcacggcaatctcacagacattcggccagctctcacgaagcaagtcaaggaaatgcggcacccacaacatgccgtcgcgcctggctataagctccacatgcgggagaccatcgtcacgaagaccggcggcggccacatacgtggtctggcggtcggccgaggtgtccaccgccaggaccacgcggttctcggcgggtatgcaggaagcgccatcggtgccatgcgcccacaatttcgggttgatgtagggcacgatgtcggcggtcacccactggcataaaacctcggtgcggaaagccgcctcggtcatgccatcgatgtcggagcgcacggaagccacggtcatcggcccgtaaccgagcgacgggttagcctggcggatcgcgtcggcatcatccaccgggcacttgccaggcgccgaccactcgaaatatccgaagctgccgtcctgctcgccattggcgaaagcctcggcggcatccacaccatcagccacatactgcttccaagcgtccacgagtttacggcccttgtccacctgcttgcggagcgcgacgctacgatagtcaccggcattgctgatgccccacaattgcgagctccacacggccttcgtggtctgcgagacggcattccagccatcatcattatgctgctcgcgcagctcgtcgaaaatcacacgggccgcgctcttggcacgaatgttcttgtcagcgcggacaatgtatttcgccttcgacttcagcacgatggcttcctcgccgttcgtgttcacgaatttctgcgtcatgcccgcaagctcgggcaccaccagatcggactcctcatcagtctcaggacgcggattacaccactccttgacctgactgtaaggccccttcgcattatcaagcgtctgagcggcgcccaccaccaggaacttcacgggcggcaccttatccgggtgcttattcgagtccacgaacagccaccatgcggccagcacacccatcagcatggtcttgccattctgcctagcgacaagcacaatcaccttgcggaagcgataactgccatcctcaagcaattccaaagcgtgcacgagcagccagcattgccaaggataaagatgcaccttcagcatgatttccgcgaacgcgatcacagcgaagccattagaagtgttcttatccaagggacgaagcggcggagtataaatacgcggcagggtcacaccatgcttctcatcatcgatggcgccgaaaacactcaaatcttccgacgccatcgaacgcctcctagccgaaacgcttcatgaaatcttccatctgcacaaccttgtcgctcttacgcgcctccggcttagattcaaccttcggcttcgcaggacgaccaaccttagccggagcatcaaccgtcaaacccaagctctggcaatacttcaggaacgtcggcagcgacacgttgtcgagcttgccgttctcatcgacaaaaccggaaaacgtcagataatcgatacgctcagccaacacgcgagccgcagcgacaacagcagaattcacagccttgaggtcagcgttcttcaacgaacgctccaacgcctccgccacattccgactcggaaacttcgcactcatcgaaaacaccccctaatctgccgtcgcgcgcgacccgccaacaatttcacttgtcggggagaggaagaccaaccacgcgggacgtcttgcgctctgtcgttggttttacgatttcaccgcccctaccccgtcgggtttggtttcgaatgctgttttgaatgctttgattgcgtttgtgaagcgtgtgatgagttcgtctgcgcttggtggcttgggcgtgatgagtgtggtgtatgcgtctccgactgtgaaggtgttgacttcgttgtgggtgacgttgattgggatgttgacggtgaatgagctgattgggaatgtcttgtcgctgattgtggcggtgagctctagtgtgactggctgctgtggcatcattgtctccttgctcatgctgtcttaatccattgcctgcttagtgttccgattggcgccggcggatcttggttgcctctcaagcggttgcagctggtgtggctcggtttgaagcctgccgggtcgaattggagttcgggatgcttgctgacggggaacatgtggtcgaggttgaagctgtcatcggtggtgttcttcgtggccgcatagtcgattggcattccgcatagccagcagactgcatgctgtgccttgcactgtgcgaagaatgttgctttgtctttttcgaattggcggctggtcttgcgtgctcttcctggcatacgatcaccgcctttggtgcttcgggctggagtcgaaccagcgcatggtgtgggatgcactatctcttatcacgggcattcaaagaatcatgaagccatggccggtctgttccgtcctctggtatctgtgctatccctcgtgctctgccactgagctaccgaagcgatatgaataatggcccagctatcattatgctgagccattcattctacgaacatacgacagtatagcattttaattgtgacagtcaagcatggctgtgagttctccgaggttgaacacgtactctcctttgtgttttgtcggcgtggcgtgcgacagtttgcctctggtgagccattggcggatctggtcgcttgtgcagtggatgtccattttggcgaggtatcttgcgacttcgactggttttccggtgtattcgagttgccagagtttgttgtcgcgtgtggctttgatggcttggactccgccttgccatttgcagtgcgggcatgtccattcgtcggcctgtggcgtgctggtggcttggtgaccgcattttgggcatgtgccgatgatgaccattgcctcttctggtgtcaaggccgtctcgttgcgtcggctgatgtgttccagtgctgcgtagtcgtcggctgcagtggtcatgtccaaaatggcatggcgattgcttaatatggcgagccatgctttgcgccagcggtagtcggcgtattgcggcctgattttgcccgcttgctcggcgagccatgcctccgattcggctatgagctgttgcgcgtgcgtgtcgattggcattggcgcgctgcctctgcttggcgcgtggcccgtggctccgatgtgcgcttgtttgagcatgatgctgctgagggcgggcagttggacgtgtccgagttggcggatgagcgtccagtaggtttcacggcaggtttggcagagcggattgtctgctgtcgttttcattggcttgtggcagtgctggcagtcggtcaaagtctggtctccttgtcgtgctggtggatgatggcggtgatttcggcttttggcacttgcggcacgagtctggcggtttcttccagggtgataccgtcctcatgccatttcaggatcatttcttcaaggattttcttcatttggtggcctccagatatgggttttctgtggtgtgtggcgggaagtcgcattcctggtctttccaaccggccgcgtagccttctcgccatgccttggccatgcgtcggtggtattcggcgtctgtgagatggtagatgagtttgggttctatcattgtgtgttctgctccttgttgagtcgttctgcgagttggcaggcttgttggtctggtgtggcggtttccttgtcgcgtccgagcgcttgcaggacgtgttcgcactgccacgtgtgcacatggcgtttcgacggtggtatgccgctcatgttggcgcggcgttggcaccagcctttccataggcgcgtccagtcggctatcgtgcggttttcgctataatgtcggcttaagaatgcgttccaagcgtcagtaacggcgagattcgcgtattccgctttgatcgccgacatggcggtggtgtagtccgtggaatcatggaacgcttcggcggtgatttctttggaagaagaaaatttattttcttcttctttctttctactcttactactactcctactactactacagtcgtgcaactgtccggaatcctccggagactcgcaggaatgttcctgcaactgtccggaatcctccggaatgaccttgtgtccacgcttgtcccagccgtccggtggcaggtagtggcaggtgcccggacgttggatgttctgccatttctcgaagccgggaatgaagaggagacgcttgccgtcgcgctcgtagcggatgatgctgccgcactgctccaattccgcgaaggcgtcctcgatggcatcgaggacggaatcgtcatacggcatgcactggccgcggaagagacgcggattgtcgagctgcacgccattgtcctcaacataagaccagaggttgatgaacacgagtcgcgtcttccacgtcatggagccgacgctctctgaactgtagaattcaggtctaatcgtcctgattctcattaatcctctcctcttgtgatgccgttgtatgccatccagattgcttcctgccgtggcgtggtgcagggcagatcggtgtagttggtgttcgcccatccgcttcccacgtgtggtttcgccatcgcatccaaggcttcggcgatctccaccaagtccggtggcgggtcaagcgtcaccatgacaaacccatcattacggcttgcttcgcgtccaccagccgatacccgcagtaagggcaggtgacgtaatatgtgcccaccgtctcaccgcagtgggcgcactcgacatatcggattgccttgctcattcgcttaccgccttccgtgcgatttcgagcatttccttggcctgtctgatatattcctcctggaagccgggaatctcaccggcataattccatgcgtcatcctcgcctttcgccacacagtcactttcgacaccatcccacttcttgcagcttctccatagaagtcgtttcgccacggcctcgatttcagcattcgtgggcagcgcttcacgtccatcgcagtaggcttcgtagaccgcgtcgcctaccgtgtaggctccttcgatgatctggcagcagtcgtaatctcgtgaattttcgtaggcttgcgcctcgtccagcatgatgctcaattagtcctctttccgtttgctttgaccatggcccacaggatttcgcttgccggacgcctcctgtatgacaggtctaatcatcattagcctccctctcaaggatgtagacgttcgtcgctgtgacggcgttatcacgcaattccgttggcggcatggtatccacccgcagaatctgccaaccctcgttcagcaacttttcaaacacacccatattcatcaaggtgcgctcatcgccgtaatcactccaaaaaagtgggcaaaccttgtaccgtttattcatttcgcgtcctccttcatgaagacaatccagtgtgttcccgtgcggttcggctgcttgttgccgaagagtggcttgtgcgctgtgagcttgagaatctgcgatacgggtatctgtgtctcattccatttgaaaatcaacactccatgctctttcaggacgcggaagcactcgctgaacatggtcttgaggtcagctttccacgtctcttggtcgaggcaaccgtatttctgcgccatgtagctcgtttcccccgcattgcgcaggtggggcgggtcgagcaccaccatgcggaacgtccagtcggggaacggcaggtcgcggtagtccatcagcatgtccggcttgacatcgaacctacgcccatcgcacaattcccagctctcatcacgcacatcaccaaaaagcacccgatcatccgatttgtcaaaccagaacattcggccgccgcaggcggggtcaagaacaggctgatacgcgctcatttcgtatccttccccttgtactcgtccacgagttctttccactgcctgcttgcgagtgcggcgtggctgaaccagctggtagagatatgtccacgtggacattggagccggtagactgtgagtgttgtccttactttgcggctctcgtggtatttttccgtttgcgatgccttgattactggtagtctgccgcacattggacacccatattcgttgcgtctgcgtttgaaccacataactattccttcgcgtcctcgctttgattgggtacctcggaaggcatggtgccggaatagccgagcatgtgacggcagtaattgattacatgctcgtaagccgtcgtcattccgtcgtaaaagtcgtacacttcttcgtctggattatcagaagcgttattagctgcatcccactctttttgcagaaagtcgatgacctcatgcagtgtcttgtctttctcagtcacgttcgtcgccattgttattccttactgctcttatcgttcttatcgtcatggtcgaagatgcatacgaacacgcctaatagcgtgagtacgcagagtatcgctatcactcccaaggtgatgacgatgaacacgcttgaaatattccagcaaacatcatccagactcatgttgtcttctcctcgcagtccaagcatttgagcattctcacagcctcaccgcgagtggcccagccggacgtgaacagtcgattggattcttcatcggtcctatccgcgaagccgccgccatgcgccctgctccatgcgtcgccatcattcgtttccggaaaccacctgttcacagtggtttgccgcccggtatcgaggttcgtggacacgatcacctcttcgcggtggacatatccgatgcaataaccgcaatgggcgcagtagacctctgcataaccgggtttaatgaagccgagtctcacgcacatcattcatccttcttctgctcgcagaattgtcttatcgcactctcggcgtcgtaatagcgtgcgacagcgcgtatccacgagttgaacgcatcttcggcagtctgacagacctcgccttgaagacacttcaatacgcactcgtaccggtagacggtatgacgtggattgtgatatgtgcatttgccgctaactattattggcgcgtcaccgcagtaagggcatcgaagataactcttgggctggggcttcttcttacgcccgaacatcactcacggcctccccacattccttcttcgttggttccatagtttttgcattggaagattcgagccaattcctcagcgtcgtaaagcgcctgttccaacgcttgtttccgtgagacggtcttggatactgggtattcgcgtgtcgcacgaaacagccaagtgttctcgatcacgtcccaatgccataagaccagctcatatccatagaatgtctcatccggcatggtgtagctatgacggatgctgaccgcgtattggtcgctcatgcgctcacctccttgagtatgttcaatgccttcacgccatcaaccacatgctttccgcctgcgttcacgctgatgatgaccggctggtacacgccttcaaccatcaatgattcgcagattccttccgtcgcgcctcgtaattccttgcggagtttcgacggcacgtatctcagatacccgtcgatgatcgtgccttcgttgagttggattatcgccctatgcccgtcgagcatgctcatgggcagcgaccgccagtcggataggctttcatgcacgttcatggtcgaacaccccgttttccaatcgtgcgagcaggtctttgccgaagttgattcccgtcccgcagacggcattctcgatgtctttcgtatgcttgtcggaagatgggttgtcccgcactgtctcacattcatgaatgagcgtgtgcaaaaagttggtgaggttggtcaaccgacgctccgcacgagatgtatcgttaagattcactggtatcagcgggaaagcgtcagcatcgaacgtgcgtttgaccacgctccagtccatcgtttccaaatccccgtcagcgaacaattgcgcatcacagtcgatattgtgaatgtgccaagcgtcaccgtcgtagctcaacaggtcttcaccatcccgagtcgcataccagcccggttcggtgggcatgtcatcagacgagtgcgcctgatcgtacatggctttcacctgcttgtagatgtcatccagttccctcccgtcgaactccacggtcagacaagtgccagccttgtcggtaaacaggtaaggcattgttttgaaatcaatgcttctcaacatttcactctccttcttcgttgaacgatgcctgtagagtgtccgcgaacacctgcaatgcgtctttgaccttctcgttgaaaccgtccggcacgtccgccgtgacatgtccctgctgcatgttgtcgagcttgttgtccgtcttcgtgtacatcggcacatccacttcgacggatgcgagttcgatctgcggatagtcgaacgcgcgcacacggaacgtgaccttgctcgtgccgactttcactttgtcgctcattggtgtctccttgggaggattgttctgatggttcttgccggactctcataagcggtacgcaccacgtatgccctgtggtagaagtcggctttggaacgtgccgcgcccacagcttcatccagtgagtcatacacgcggcatgtgtgcactcccgtctcaccttgcggccagacgatgtagccggtcttgcctgtgaaaacactcatttgaccgtctccaccgtgctgcaaccgatatattctctgttatgtttcaaacacgcccatgtcacgtcaccggtcttgaccgtttccatttgaaaacccgtattggcattcgtgccgacattaggcgccattcctaagctgaacgaagtcaagacaatcgtgatgcagataatcgccgtgagggcaaccctcgtcttatccatcactcaccatcctttgcgatgacggcacctatggcttcccgatatttcttcgtccgttggaaccggtcggcaagcatgttcgcggccttgtcgataatctcgtccttgcgttcttcgaggaagctttgcaaagcttcctccatcatggtcttacacatgttttcccgcgaatacgcgttggtgcgcgcgaaaacagtgtccatggtttctttgacgatcttgtcgagcacgtccttgtaggcgtattcctcgatgcggttctggatggccttgtcgtcaatgccgatggcgaactgcacgatatgttccatgattacttgccttccttttcgatttcattgatcttgtcttttaagagtcccggaatatcacctctatgccagacagtgaatgcatcccaaacactcttaagaccagcccaatcctctctggcgagagtgtggaacaatgcaccagcgagttccgcccagtcacttacggcgtaaatcggaattccatgcacgagcgcgtcgttaacgaaccacaaggcttttttcaggtcttcgacaccgttcttgtgctgccacctgaagcagtattggacggcttgaccccagtcgcttgacaacagtcgggacagttcgatgcattcgaacgggccatccttgtaatgcgatggattgatgttgtcagtcatttgattgttcctttgtcgatgaatatttgccgtctgtggtgagatacacgagtccatgccaagttcgtaccggcacttccaactggtcttgaaacgatttcacacaccagccgttctcataagcgatagtcggatgcatgtgaacgaaaccatgacagcccgtcgtacccgaaccgcaaagcagaatcagattctgcacttgatgcttctccaccctcgtgcattggctacggagtttccgatgatgccgggaaccgccaaccgcatacaagcttcggccacaacgcacgcaacgcctaccatcacgatcatcaaccatgcggcacgtctccttggatggattgtcactgctcactggggttctcctggaacaatcccttgttgtcttcaaccaattggatgccctcacctatccatctcatgacaggaaccgccatcgaattaccgagcgccttgtagcgtggactatccggcgcgtgcttcttccccttccacggaatatccgtccatccgtccgggaaaccttgaagcctttcgcattccaacggcgtcaacctgcgaaccgtcaaaccattcatcgaatcctccgtatgtagaaactggtcattgtgcgtgctgagcgtggcagaaagctcgtcctgcccgaggaatcccttaccccccccccgctccgccaccgcgaatcttgaaagtgaaaaccactagtctctcctattagttgtcggatagatgaatggggcatcctttccggcgtgagccatcaatgtcggagaaagatcgaatccttgtgcggcattcgcctgagtgtccgcgcgacacatcactctctctctctctcaatttggtagacggctggattatggtcagtactcaaagtgggactcacttcgccaatcgccagactccggatcttctcaccctggctccatttgaacgccttaatcaggggaacattgttgccaccggtacccatgtgcgaggtgagcgtattcgacacgtcgggatgatcgctgaccttgaaccgtccatcctgctgatggaagtccaacatcaatcccctagcgtccgaatctgcgtctccaacgcctcccgcagttccctgggtaaggctttgcctcttctctcggctcgacgtatgatcccagcacaggctctcgcgctcaaaaagtaccggcgcggcacgccgccagtctcgagtgttgacgacaaggaacacacgctcgcgccgctgggccacaccgaagaactgagcgtccagcactcgccatgcaccccccccatcaggccagagttcggccacggcttcaaggagcgactggaaagcccgtccgtgttcagccgacagaactccgggcacgttctcccatacgatccattccggatcaatttctgcgcaagctcggagatactcgagcatgagctggccgcgaggatcgtccagagccttcctgagtccggcgatgctgaatgcctggcaggggcttcctcccacaacgacatctgctgcatggtggtattccttccaattaactttcgtcatgtcccctaagtctggaacgttcggatagtggtgtttgagtactgctttggggaatggttcgatttcggcgtatgcgactggctcccatccgagtgtttgccatgcgacagttgctgcttcaatgccgctgaacaggctgatgtatttcactagggttcttccttctggtttagctcattggcttttttgacggctgacgccatgtcggtcacgtcatcctgcgattggagatgcaaggctttcaacgtgtgttcgcaagcccaagtgtggacgtgtggcttcgacggtgggataccacccatttgcgcccggttctcacaccagccacgccataggcgtatccaatcccccacggtgctgattctggcatagtgacggacggagaaagcgttccaagcatcctgtaaatccaagttcgggtaagcggtgcgcatcatgctgtccgccgccgtcaactctgtggagtcttggaacatggcaagtgtcatttctttggaagaagaataatattcttcttctttcttttgggttctggtgttctggtgttctggtgtttgtcccgatgtcacacgcatgtcacgctgtgacactgctgtgacagtgctgtgaccacgggatttgctcttgcgtgccttcgcgtcggctcgcgcgtgcatgacctgctctttggtgcgattgtgagcggtgtaatcgtggattatccaaccgtcatcgacctcttcgagcattccctcgtccaccagcgcctgcacctgctcctgagtggcaccgatgttagagagcatggcgcggcgcggcacgaagccatccgtgagcctgtccccgcacagcgagagagccatacagaacacgcccaccgagtcagcacggccaatgcgcacgagatcacgcaccttgtcgttgtcgtagaagccgttcacgagctgcacgtaaccacgccttgccattagtcctcccctcttgtgatgccgttgtattccatccagattgcttcttgtcttggtgtggtgaccggcaggccgtcacagctgaagacgatgccgctcccccagtgtggtttcgccatcgcgtccagggcttcagcgatttcaaccaagtccggtggcgggtcaagtttcatcacagttccttttgcaaatgatttccaaaccgggctgataccggtaggttgactggttgctgtagtaggcgtcccagtaggctccgtagtgtggattgtcggcagtgctttggtatgggactgctttcctgtcctggaggagttggacgatatggcgtcccttgtcggtcagtctgagcgcattgtcggataccaagccgcgccgtctgagcgcttgaatccacagccacggtttctgacctgtgtggggttccggcattcgaccggtacgccatatgctgacaagcgcctcatgctgttggctgctcaaatggatgccgttgacgttgactgctggaagaatcatcgtccacctccgagcggcaacccactgttcaacatgcccgccaattcacccaacgtgaatcggatgaacattcgagtgcccgagtcaacgcattccatagacggtttggccggtagtaatgtctcgaacttgtcccacacgctcagactcgtgtacgcgggttgagacgcgatccactcacgctcgcccatcacgtcagcatcgaacatgccatcggcttgtatgacgaacggatattcagaatcaatgtcaccagccaacagttcagccttatcgaagcatttcaccatcggcacgttcggattggcgaacgtcgaaacactgatcggttgtcccttgtagtacaggttctcaacatggtcgagacgcttatcgtctaacgcccaagccaagtaatcccagacacgcagttggaacagcatctcaccggtattcaggctggtttccgacatcgcttatcatctccttcgtgtttctgacgagactttccaacccgccgtgaatgtcatgcaagggttctatatggatttccgtatgcggctcataaggattgccgccgtatgtcaacggcattccctgccgacgtttgacaagccgtttcgcccgttgtccccatgccatacggtcgggttccagcatggcgcacaacgtgagtttcacttgctggtcatccacgtaggccaaaccgttcaacgcgtccttgacgagcttttccagattgtccaaatccggtttcccatgacgccccttataaaacatgagaatcatcagcacgtccccgtccaatggttcggcatgagggtagaacatgtggaattggttccgcaccagttcctcagcatccctcgtatgttgaggggtcacagcccgatacccgtagaatcgtggacggcccttcgcgacgggttcgcctggaatgtcgaaatcataggtggtcataagtcccatatgctcgcgtctccaatatcctcccaatagtcttcggcttccgactcgcattcaggacaagtggggccgtaatattcgaccccatgcttgtcacaccatgcgggttcggtcatcccagagagcggaaccatcagaacagtgtcgcctctccaagcttctcttcaagatcgcgcatcagattcaccgacgcatcccaataggaaggcttcaattcaatgctcatgcccttgcggccaagtttgattgcctcgtacacggtcgagccgatgccaccaaacgggtcgaacacaagctcgcccttgttgctccacaagcggatgcaccgttcgatgaaatccaattgcagcgggcagatgtggcgttcatcggtatcctcacggccaagacgctcgttcagcgtgttggtctctcgaatgttccaccagaccggttgcgcccaatcaatccattcctcgttggaaacatcgttcttgatcggcacctgattgtcgccgggcttgcggaacatcagcagatagtcagccaacgcgggacggctcatactggaatccttgttcttcgtgacgaacatgagggcttgggctttcgtgcgaatcgcctgagcctgtggatttttgttcacggtgacttcgccgtggaaaatccaaccgttctccacgtaagcgcggattacatcaccacggaagtcggtcaatccaaccacgccgtcagcggtcttcgtggtcaccacctgctgcacatgcacgcaagcgatacggccaggtttcgtgaccctcaacagttcgcggatgatgtacccgtaattctcgatgaactcttcacgggaactattgttgcccaagtcgcgggttgaatcggagtacacgtacaggcttgcgaacggcgggctgctcacactcagatcaacactgttgtcagccatttccgtcatgcgttcgcacgagtcgccaagccatagtgtccaatccttgcctttggcttcatcggtcatatacatttcatcgaccatcatgcggcctttccgaaagagtttgattcattcatcgtctttaccagttcgtcactcaaatgagtggcctgctgttccttgcgggtgatgttctccgctatctcgcgttccaaatcggacaccaccacatgcacgtcaaccacgcgcttctgtccgaaccgatagcagcggcgtatcgactggtagtaggattcccacgagtcgttcaaaccgcagaacgccattcgagcgcagttctgccagttcaaaccgaacgatgccatggaacccttcgtaatcagcaccggaatgttcccatcagcgaagtcaaggaacgccttggccttgtcttccggcgacatggagcctttcacattcacactgccggggataagcctgttcagcatgtccgcctcgtcgttcaatccagcccagataatccactgttcgcccggttcgctgttgacaagatcgacgcaacggttcacacggtcaacaagcgtttccttacggactctcgcacgcccgccgacgccaccaaggtcagctgcgaacaattggccttccgggatgctgccgcgataggcgacaacatcaacggtctgattcaatccgggcaactcatatcccgcatcatcaccgccaatatcggacggcttgcgcaatgcgatggcccattgcgacatccaccgcatcatcggcttaaccgcgtgacctttcaaacgccaaatattcccgtcatgcacgaaatacgtggcaagcatcttcacacgggtggcgtatccaaggaactcggcctgattgcatagttcctccgggtcgttcggtgccggtgtggcggtacaggcgagacggtatttcgtatccctgaacgtgtcgatcagcattttgcgggtcttgccgtccgactgtttcagaatcgaagcctcgtccaatacgaccgcatcgaacttcgacacgtcgagtttcggcacacgctcatagttcgtgatgttgaatccgtcagagacttccgactggtcatgcacataacgcacttccatgccgattgcggcgccttcgcggatggtttgctggcatacggccaacggcgctagaataagccccgtcccatgtccggcgcagacttgccgtaaccattcgagttgcattctggtcttaccaagacccgtatcggcccatatggctgcacgtcctactttgcaagcccatgtgacgatacgtttctgccagtcgaacagggatgggtggagctgttgcgggctaacggtgatgccagtctcctgctcgcgcagctcctttcttttcagaaactccctgtatggaatgatgtttgccatgttggttccttttagtctggattagaactcgtccgtgttgccgccgaaactgccgaagtcggaaggctgattattgttcgacgcccaagggtctccacccaactgttgagactgtgcgggctgctgaccggcctgttgcggctgttggaatccattggatggaggattattgaaaccggcttgtggggcaccctgatagccgccacgttgaatcttctgcacttgcgcggtcgcattccgcaatgaggggccgatttcgtccacttgcatttcaaccacggtgcggttcgtgccgtccttcgcctgataggaacgctgttgcaaacggccttgcgcgatgaccctcatgcccttgtgcagggattgggcgcaatgctgggccatgtcacgccaaatcgtgccgcgcatgtaaagcgtgtcaccatcctcccactggcccgactggctgttgtattgtctggtgtttgacgcgatgttgacattgcagacggcctcaccattgcgggtcgtgcgtaattccggctcgtcggtcagattgccaatgatcgtgattacggtttctccagccattatgcggcctccttgacttcttcattctttttgaaactgttgatgaacaattgggcttgccagtcggtcaacctcgcatagttcacaggcattttgatgcgattgccgatggcttcggactcacgtccggctggaacattcccctgagccaacaaggcggcaacctgcctgcgcaagtcctcgttcatcggattgccacgctgatagccagccaactggccgtcatcatcactggtagcaagacagaacagggtgagcagactgtaccttctcgcataggtttccgcactcccataccgttgcatgaacggctgttcacgtttacctgcggaatcacccacgatgatcgggacgggagcttcaaacgcgctccaagacttgctgtcatccttccagtagcgggttacgacgaatccatacccgttcggatattggggtagattatcgtattggatgctctgctgcaccttgaccttcaacgtttcggtcacatagttgaccacactgcccaagtcggcgtaatcataaccgtaggctttacggttcttcgctatcacatttcccattggtcatcatctccaatcagatggttcatctgccagtcagtgaatctgataggcataggcgtcttcgataatccttggttgagcatgtcttccaacggaatatggttattccagtagaagctgagcctatccaacgcttcacgaatctgcttcaccgcgacaagtgagatttcaggatcgttttcggatagttcccaaatcatccagtcgtatggttcctgcttctcctgcacgacgaatctgaatcccatcgcaccctggtatccggttacgagccgatacagcatcatgtagaaggcggcttgaatgtggtagccgaatttgtatgccgaaccagtgaagtcctgcacgtcatggccggtggtcttgtagtcgtacagccacatgacgccgtccatgtcgggatggtcgggcagccagtcggccttgcctttcaactgcaatccagtggtcgggtcaatggcgaacaaggcgatttccggtttgccttccacgagactgttcatgtccggcgcgtaatccaccatgttttgaagcttctcatagtcggaaccggaaaggattaccagatcgtccgatttggctcgttcggcttgtgctttaccggctttggtgcgcccgtcgagtttcctttcgaccttcgggccactaccgagaatgagactgtgcgcggccttcccgaacgccaacgtactgttgtcgagagggttcagcttgtgccatgcgtacgctcttggagactccatgaacttcttcaaaccagtctggtcgattgccggatgtgcgaaatactccttgtccggcatgtcaaccatgctggggaatttcacttccgtcatgcttccgccacactccgttccataatgtgggcattattccggtagcgccacttctcataaccctgttcgacaagcgggaacaatgagcgggtgtaaatgatggcaccattgctgttctcttccaacaagtctcccttaccggcattcagaatcgtgttcttcacgacttggcccagtccggtgaggttacgcttggcgtcttctggatgctgttgggtcatgtattccctgagcgtgatgcggtaatccggttcgattttgattggatgccggtccgacacgtccaatggttccggaatggcgtcttccaccagccggtaggttcgtccgaacaagctgatctcgtccggtactttcgtgtaggtttcgccattcacgttgatggtgtccatgagagttttcctttctgtgattgcgtgctggtggatggagtcgaaccatctgaccgccgatggatcgaacgactgagatagcagcggccacgttccttgcaccagcgattggttgacgggagagagtgtgtatgtaagcgcctagagaaatcgactttggaatatgattttttaggctcccccgtcaaccgggttttcaattatgtcgggccgtctcacgacggcttcggacgtgggcgggagtcgaacccgcgacccgtaggggaagaagaaccagagaccccgagtcatccaatccacgtcaaatccccagtccggcaatcgcactaaccggtggggacagtggccgcaacaggagtcgaacctgttaggattcacgccaatgaatgatgcaaaaccgttggaacccgacctgaacgggttcacggccaacatcacggcaacaggaaatgtcaaaacctgaatgcgagatggataaggtgattcatgagttgtcaaacttaaggagtccggcatgaatcccacaaccatgtgcggccaatgcgcctacgtgatttgctgcgcggtattgagttcgtaggcgcgtggataatatcgatattcagttatggtccccactggccgacgaatgagtgaacgtgggtatcctgcggaacaacccgatttttggttgtttgttgggactgccagccagcgggaagtctttaatcgcgtggcgcgaatctgacgatcagccacaatgcggtggcgatgtacacgccttccaccatgagcgcggcgttcaatcaggctgatgatcgtgtttttgatcgtgtcacgacacaactcgtccatgcggtcgtcgattttcgatgtccgctctcccagtgtccttgtttttgcgaaatgctgggaaagtggactgtcatagggcaaccgttccggctgcacgtgcgagtacaggccggtcgccagcgcgtccaaagcgcccggccagactttcaggccgagcgtgatgagcgcgcacgcgccacccacaccaccaaaacccgctaaaaacgtttgaaacacatcacatctccttgaaatcgtttaatcttttggcatggtgtcgccatcgaaataattgcccggcaatcccaacgagacgagctgctgccactggtcttgaggcacgcacaagcccttgctcagattgaccgtgcaattgttcagcccgacgagaatgccgtgagtggtgctggcggcggtgaagacgtaatccacgcgaccattcgaagcgaccggcccactatcgctgccattggtggtgagacgcaagtgcggatcgtcgccactcgtgggcagcatgtaacagacgacgctcacatggtatttcacgcccgccgtcaaccccgtgaaggtgatgtccgatggtgtcgtgttcttcgtcttgacgctcacaccgtctttcggcatgacgcagtgattaacgatgggagtcatgccaccacccccaatgcgagggtcaggcgcgcggcatcgtatccccgtcgaaatatccgatgctgtcgagcagggtcttgttcgcgagataatcggcctgcgtgcagatgagtatatttgtcacggtgacggtcggactgcctgacttgacggaataattcgctgatagcggactggaattgttgacgtacgtcatgtagctgacacgttggcgtgcgctgaattcgccctgtgttccgataatcgagacagtgccgcctgtgacgttcacatcgaaactgacccaatatgtcatccatctcacgctcggaacggtcgtgagacgcacccacttgtctgcttgcaaggtgatggtcgaggatgggctcgtgcataggttcgtgaccatcatcgggcaccacccgcccggcggacgctcctatgcgcgcggcatcgtgtcgcccgagaagaagcccggaagcccccccccccacggctttatcgtaagtgtcggcgcgttcgatgagaatatcgctcagcatgactatcgcgccgaccactttgcctgctgtggtgcggatgatgagttcctcgcagtcgtccggcaccgttatggtcccgtcgacatcgaccgtcgtgccatccgctatttctttttgcaatggcaccgtatacttgccaccgaccctcgtgtagacgcggacgaatgcgttggcgtgcttcgcgaaggcattgcagtgcacgtggtaggttccagccggtggaagacggtcgccttgcagcgaatactgcgcgtaagtgtctccaacggtgagcacggtcgcgcgcagccagttcctgcgggccacgaccggaaaatccacttttatgatgctcggcgcatacggtttaaccgtcttcgtgatgttcgggtcggggaaccagttaatcctcaatgtcatcatccacccccttggctgcgtcgagcacgtcctgcgggatcagtttcatggccgccgtaagctggctggtcaggattgcgttttgcttgttgagagtgccgatttgcgcggagagcgtgtcgatgacctcgttcgcgtcggctggaatctgagtcaaaatgtctccttaaatacgaaacccccgcaatccgtgtggattgcaggggttgaaaaaattggaatgctggattagtcggctgctgtcatcgtatcgatgcgcgtaacggccttaagcccgtcgagcgtcaaagtgcggccgagattcgtcttcacgtccgtcaacgtgacggacgtgccggaatcgtcgaacgtcgcaagcacgccacgctggtaatcacgccacgattcggcggtgccgtcagcgctggaaaactccaatcccaaacggcacagttcagctcgcaccgactccttcggcggacgcaaatcaagcacgccagacggctcggcgggcgtcacggcaggcacggtatcggtagtggtagtggtctcagtggtcacatcggccatgatcaattctccttaattctgttggttttgtcttggcatgagggattcatagaagcgttcctcggccgcatccaaatccgaacgcatgacttcggtggcgaaaagccttccgatggccttggcgtccacgcaatccgtgtcgatgccggtggtcggtgtcgcatcggccgtttcaccagacagcatggccgtctggacggccgcgtccgcatcgttggtgatcggcggcagtcccaaagccgtcctcgtacggttgcgggcggccgtcatcggatcatcctgtacctcgccactgtcggacatcatggacacggattccgccgcggtatccgacaaggccgcctccaagccctcataggcggtcgtgtacgcgttacgtccggtctgcggatcgtacgagccggccgattcccttgcctgcatcatggccgcgcacgtttccgcgacgctcgtcgtgccgagcagcgcccgccatgcggcgatagcgtccatgccgcacacaagcccccgctcgccttccgtttccgctctgatgacgaggttcccgtcctcgaaaaccgtttgcaaaacatgcctcctttatttggtcagccaggcgatggcgttgacgtacatgtcgccatggaaggttgcggttccggcgttgtaccccataacctgcatcgacccagcgccaccggtgttgcacacgtgcatgaagatcgacccccagttgaggtcggaattgcagacgccgtagtagcgtccgaacttcgccggcgtccatgaccacgtggtctgtggcacggtggagtccgcggttagcgtcgcgttctggtagattcgccaattggtgctttggaatgtgtggcggccgttgatgccgccaagatagccgccaagatacacgtatccggtgctgatgtcggacaacatgccgatttcgccgttagcgtcggaggcggtgcagtatgcgcgggccttcgcgccctgcgagtgcacgccgacctcgcacaagctgccggaatcactgcgcacgttgagatacgcggaagcgccggaaccgccgacaccctgcatggtgagccgtgaggagctttttttcgacgggtcggactcgtcataattcgtgtcggcggtcagatacacttgggacgtgatgccgctgccggtgccgcctttcgcacgaggcttcgatttgagagacacgaacgcagcagggtcgtttttagtgacgtgtccgctccacaagtccagtccgcccatcgcgccgacctgattcgactggatgacagaagcaatggccggatgagagtaaaaagccgtcgaaccgttgtaagcggggaattccaggccatcaccaacgaaagtctcagtgccgccgatgatgtaggtctgataatccgggctgatacgcaccctgtgcccgctcgtgcgggtctggaacgtgccggtcagcaggttgctcttgccctcaccgtccaaataaacggtctggttatggctcgaatcccacatccgcaaagccgtgctattgagcttcatgcccgtgttctccgcctcggagctctggaatatcgcgccggtgaagacatagcccttgaactggcctgccgccaccttgtcagacgtgatagtgccagccgcgatcttgacagccgtcacgctgtttgccgccagcttgtcggcggtgatcgcgccggacactatcttcgaagcgttcaccgagttcgccgcgagcttgtccgcgttaaccgcgttcgcggcgagcttgtccgtcgtgattgcaccggacacgatgtcgcccgcctgaattttgtgcacgttcaggagcgccacggtcatatcctcagtgaccttgagcttcgcggtcgtcactgcgttggcggcgagcttatcggtaccgatggcaccggcctgcaccttgcccgccgtcaccgcgttggccgccaatttgtcggcgttaacgctgttggcggcgagcttatcggtcgtgacagcgccagccacgatatcggacgcctgaatcttatgcgcgttgagcaacgcgacggtcatatcctcagtgaccttgagcttcgcggtcgtcaccgagttggccgcaagcttgtcggctgtgatggccaatgcgacgatattccgcgcctgcaccgagccagcagccaacttgccagcggtcaccgcatcggacacaagcttctccgtcgtcacgctgttggcagcgagcttgtccaccgtgatcgcattggccttgaccttttcggcggtcacggaatccacggcgagatgcttcgcggccacggtcccagacgcgagaatgttgttcgccacgaggtcaaaaggttcgaagcgcgtgccgtcccacgtcagcacctcgataacgcgatccgtcaatggcacgagcacggacgggctagcgtttggagcgccggtccagtacgtgtaaaagtcggccatgaggctgggcgaattgttcttctcgcccttccagcgcgtccaatacttctgcgtgcgccaccacatgtcacccggcttcaacccatcatgcgcgggttcgtcggggccacggtagatgaggttctttccgtccgcggtggtctgtgcctttttcgcggcggcctgcgcctgattcgcctgtgacgcggcgttcgcggcggcggtctgagccttgtcagcggtggattgcgccgtctgcgcggcagcatgtgccttgacggcggcgtttgccgcatcggtagcggccttgtccgtcaccgccgcccaagccgacccgttccaccgtttcggcgtgttcgcaccattcgccgtgtcgatccacaaggtagtcggcttgcgcatcgacgtggccggtgctgtgctttggatgagcacgtcggccttgccgttcgccacgccagcggcggcggcagcggccgtattcgccttccttgcggcggtggccgcgtccgtggcggattgggccgcgctgtcggcggtggccttggcctgcgtggcaacgctcgaagcgttcgaggcggtggtcttggcgttggccgcatcggtcttcgctgcggaagcgtccgatttggcggaagccgcgtcggacttggcagcattggccgaagcgttggccgtgttggccagtgtttccgcattgcctgcggtcttcttggcgctttcggcggcggcgtttgctgcgttggcggcatccttggcctgacctgcggtggctgtcgcacttttcgcggcagtctgagccgcgttggcggtatcctgcgcggtcttcgccgcaccattcgccgtgtcagccgtgccctgcgcgtttttcgctgcggcagcggcattctcggcagccttcttggcgtcggtggtcttcgccgcattgtccgcgatatccgacttcgccttggaaatttcgtccgcgttcttctcgacatcggcatagccaagatggttccaattcgagccatcccacaccagcgtatcgataactcggtcagcaagcggcactagcacggaagggctggcgtttggcgtgccggtccaatacgtgtagaagtcagccaagaggctcggagaattattcttctcgcccttccagcgtgtccaatatttctgggtcttgagccacaagtcaccgacaatcagattgtccttcggctcgtcaggcccacgaaacgtatgattcttgctgtgggcttcggcatatgcgtagactgtgagtgttgtccttactttgcggctctcgtggtatttttccgtttgccatgccttgattactggtagtctgccgcacattggacacccatattcgttgtatttacgtttgaaccacatgactatgcctccgcgtctttgttccgctttcggcccgtccgactcaacataaagccgtccaaatagagctggaacaggctcacgtactgtccgtcgtcgatgtcgtcttccggtttcgcatacagtcgtgtgttcaggagtgcgaccggcagtccggtatgctcctcccgctcgacgtggaacggtatttcttcctgaccgtgagcgttctcaaggacggccacaccgtagtcgccaacctgtggctgaaggtccgggctgctgtcatcgatgtcttcatagttgagacaggacggcatggagccgctgtagccgagcatggaacggcagtgttcggcggtcttgtaatatgcgtctatttgagctttgaccactgcataagcagccaagtcatgcttctgcagcaaagcattggcaagccgtaatccctcaacctcgcgctgctcacaccattcgataaccttgtgcagtgtctcgtcttgctgactcacgttcgtggccatgtcagtgctcctcttcttcgattcggattgtgattcggtaccagccttttcggctgcttggctctccgccgcggtagtcggggccgatgagatgctttgagtcatcgtcgggccagaatccggtatcggtgagcgcgtcaaggatggccttgaccatgggcgccgcgttctccgggtcgaagcgcccgtgcgtcaatgggtgaatgacggcagtgacgtgcaccgggaagtgttgtggacggtggtggccgttttggagccagaatctggcgaatgccacggcacgctgtttgactgcgctcgtgtgcgcgaatttcacccaccagtggccgcgccgattctgcgtccaccattcgtcccgtggaatgtccacgacgaattcctgcatcatcattcctcctcttcctcggcttcttcctcgcatattgggcatgggatggggcgcgccggatacagcgcgcacccatgaatcggacatgtgggcagcacgtccggcggctcaatccactcacgcatcagaagtcaggctctccagccggagcgccccacgggtcatctgccggagcctgcgactgctgctgtgtctgctgcggctgctgatagccgccaccattggcgttgccctggtatccgcctgactgcatcttctgcacctgcgccgtcgcataacggagcgacggtcctatctcgtccacggtcatttcgatgacggtacggttggaaccgtcctgcgcctgataggaacgctgctgcaaccggccctgcgcgatgacgcgcatgcccttgcggagcgtctggacgcaatgcgaggcgaggtcacgccaggccgaacagcggaggaacagcgcctgaccgtcctcccactgattggcctggctgttgtatacgcgtggcgtggccgcgatgctgaaattcgccaccgtggaaccattgcgcgtcgtgcgcatctcaggatctgcggtcagattgccaatgatcgtgataacagtctctccggccatcactcggcctccttcacttcagtctgctgcccggtttcaacgtccggctccatgacctcggcggtcacgtcatcagctccatcatcgccatcgtcatcaagcaccggctggaacacgtcgccgtaatcgggcgtggtgtcatcgctggcggcggcggtctgcgcctgcaccgtcaacggcagataaggcgccgcgcggcggatggcggtcttcttggccatggcctcgtagtcggttttccatgggccgaaattgccgctcttgctgcgtgccctcgcctgctcgatctcctgacggttcaggacgaggaagtagtggccgccgtccttgaaatgcgcgaccatgtacacgtgggtcagttcgccggggttggcgcatggcacgtggtgcagatcctcgttgagaccatagctgtaggagaattcgtctccctggtgtacggctcgggcgctgatgtccacgagctggccgctgcgtcgcgccaaatcgatcatgccgcgatagcccatgatgaacgtggcttccatgccgccggattttttgttgtagaagggaagcacgtaggcgcgtcccaatccgtccacgttggatggttcgaggccgagcgcggagcaggtcatgaagcaggagagcacgctttgcggcgagcattccgcgagtttcggcgtcttgttgatggcgctgacgcacatctggtagaggcggtcggggctgatgttgttgccgacgacgctggcgatgcgcggccagcttttcttcatcagcatctggaggttcttcttcggcgtcatttcgaccatctgacggccttgcgcctgctgtgcgattgctcccataatcattgctccttttcttcgatggatttgaatgcgaatttgcggtatgtggtggctttgacggtgtactccttgcgggtcgtcgtcttgtaggtggcttggaggttgccgcagcgcacgcccgcatgcgagccgatgcgcaggatgatctgttcctgcaattccttctgagtggccttcatgtcatgaagcattccggtggcgctctcgtatcttgcgagcaggtcgtagaggacatcgtcggcgctttcgtcaacgatgtccggcgtcggttccgggaacgccttctgcacgtcgccggcagtcaattgcggtggagtgccggtggtgacgaaatgccagaagtcggctgcggccttgtcgatcgcggccatatcctccacgtcggccttgaacgggatctccaccggctcgtcgtctccgatggccgcgtatacgtagccccacgtccatccagtgacgagcgcgtagaattcgacttgagccaagtagtatggcggaattcggaggttgccgtcctcgtcacgccagtcccccgctcgacgattacccgccgtcttgatctcaaggattccgaagctcccgtcctccccctgaaggatgccgtcaagcgaagcgcgaagatacggcttccctcggctgatgaattgcttgtcggttccgtccgtgacgagcatttctggatgctgcgcgcggaatcgcttccttaattcgttttccagggcattgcccttgaccaccgcccacttgtcggaaatgtcctccggttccacgcgacccgtcttctcaagccacaattcgtaaggcgttttgaaagcgttcaggccgagaatcgtgctcatgtcagacccgcccacaccagccttgcggcttttcagccaggcaagatgccgttccgtcttcttgccctgcttgaaccgttcgaccgtgtagcgttccgtgtctttgagtgggatacgcttcatttcaggctccctgctgattgcttggcttgtttatgtctgctttgatgatgtcggcgtcgaaataatcgaccaggagattggcaatattcaacgcggacgtcctgagcttgatggtttccgcctcggactctggcttgatggtgaaaacgccactctcgctatcgaatttgagtctcattttgcgtccttcgagtaattggccttgatgtccatcaattcgccggtgagcagtttcgtggcgaatccgtagaccaccttgtcgttggcttggaatgctgtgcgctgcaaggcgctcaccgcgtcgaagatgccgaccaaggcgtttgcgatgatgatgcgcggatcggctgtggcttgtggcccgacgctgatggttccgacgggggtgagtttcgttgcggtgattttgtccactgtgagtttcgatgtggtggtcatggtttctttcttctttccggttgtggtggttttgcgtgttttgcggggtgaatgctggtcgaaggccggcaggagtccttctttgcggagttgaccgatgatgttgcctgctgttttctggcttatgtcgagcgcttcggcggtttccttgccgtcgaatggttggccttggtcgatgcggtttctgcaatgcgcgaggatgagatcacgtttcgacggttccgcctgttccgccgtgggcttgccgacggcctgatagtcggccaggatgtcctcatgcgcctcctgttccggtggcaggtccggggtgaggagtcctgccttgcgtaacgcacgcatttcgccgatctggagtccggcttctcccgactcgtcgtagattttcttcagttcggcgagctcgtcgcccgtgtattcgtgtttcaacgtgttcctttcctgagtctttcaatgagccgatggttttgcctgatgaattcgtccacgtcgatgccctgctgcgtgatggtcggcttgccggtatcgacgcgtgctttcccgtcgcttttgatgtttgggtggcttttgcactgtgtcgccggaacgaacatgccgtttttcatctcgccaccgtccttcggtattcgtgcgccagagcccaccgttcagcgatttgacgctggtagcggacttttcgcctgtcctgatggccttcgggcggttccacgccgattttcacgtatggcgggcctttgccgatgctgcgccagttggcgagggtgcgtgggctcatgccgagcatggcggcaagttcggctggcgtgagcaggtcggtcatggcctgccgtcccgaatgtcacccatcgggtcgatgtggaggccgtcgagcatttccacggtgtcgctgccgcctccgcgttcgaggtgacgtttgagcgccttgtcgagcctggcatgcgattcgggcggcgagtgcggttattccgccgagtctgtcgccgggcaggtgaacgctgcataccagatcatcggatgcgtctaacggcatgatgaattcgccgatgatcgagtgggtggcgttctcgtttccgatgacttcggccgagaatgtgaatctcagcgtcctgctttccttgctggtcattgctttcctttgcttgttgacgttgtaggccccgtcctgacgagtggatggggctgagtggctggcttcggagtcgaaccgatgccgtccttggattccgagcgcccctttgactgttggaacacgacctgaacgtgttcacggacggtggcgtggccgacggcgactggccgtcaggcggacttgaaagggtttgcaagcaccggaatgcctgcgtttttgatagagagagaagagattggaatccgtggacgggcgaaccgtcgcccagccaatgcgccgacagtgtatgtgcagcgataatggtcggcgcgtggataataatcgatattcagttatgtgtccccgccagccgactggtgaacgtggatgtccgcgaaaacatcccggatttggtttgttttgttggactgtcggctggtgggaagtctttagtcgcgtggcgcgaatctgacaatcagccacaatgcggtggcgatgtacacgccttccaccatgagcgcggcgttcatgaagcggcggcgtgctactctcccacaccctctcgagtgcagtaccatcgccgcgcctggccttagctaccgggttcggaatgggaccgggcgtctcaccagggctatgaccaccgcaaaaccgcgatcacggaacgacagccaaaacacatggcgaccattccggccattcaattatcgtgtggcggtttgggaaccggctagcggacgcgaggcaaacgcctatcgtttaaatcgtattcgtgaccatcccaacgcatattgccgtccaggacgatccagcacaggaaagacgcggaaccaaccctccacaagggaaggatcggaatgttatgtcgccgtcgcccgttagtaccggtcggctccacccctcacggggcttccacctccggcctatcaaacacgtgttcaacatgcgggctacaggatctcgaagatccatggaatcctaatcttggagcaggcttcccgcttagatgctttcagcggttatccctcccgaacgtagccaaccggccgtgccgctggcgcgacaaccggcataccagaggttcgtccacccaggtcctctcgtactatgggcaggcctcctcaggattccaacgagcgcagaggatagagaccaaactgtctcacgacgttctgaacccagctcgcgtgccgctttaatcggcgaacagccgaacccttgggacctgctccagccccaggatgcgacgagccgacatcgaggtgccaaaccatcccgtcgatatggactcttgggaatgatcagcctgttatccccggggtaccttttatccgttgagcgatgccgcgcccgtgcgccggcaccggatcactatctccgactttcgtccctgctcggaccgtcgtcctcgcagtcaagcccgcttgtgcgattacactcgacacccgattgccaaccgggctgagcggacctttgagcgcctccgttactctttgggaggcaaccgccccagttgaactacccgccaggcactgtccctgacaaggatgacttgtcgaggttagacgtcaaacgagaacagagcggtatttcaccttgcggctccacgaatgctggcgcacccgcttcgaagcctcccgcctatgctacacaatccgcgcctaacgccaataccaaggtatagtaaaggtcccggggtcttttcgtccttctgcgcttaacgagcatctttactcgtactgcaatttcgccgagctcctggtcgagacagtggggaagtcgttacgccattcgtgcaggtcggaacttacccgacaaggaatttcgctaccttaggatggttatagttaccaccgccgtttaccggggcttgaattcaccgcttcgtccccgaagggattgacggatcctcttaaccttccggcaccgggcaggcgtcagtgcatatacagcggctttcgccttcgcatgcacctgtgtttttggtaaacagtcgctaccccctggtctgtgccacccaccaaagctccccgggctagccggttcaccccagcgggtctcccttataccgaaggcacgggagtgatttgccgagttccttgaccaggattcgctcgatcgccttggtattctctacctgaccaccagtgtcggtttggggtacgggcggccatggccctcacgccgaggcttttctcgacggcctggacaaccggatatcgagccataacggctcccatcatcacacctcgccatgcatgccatgcggatttgcctgcatgactggctgcgtgcttgaccacggaaaaccacctccgcggccggctcccattccgtgtcacccctgcgctgacctactgcggctacagtcccaacaccacgcggcgataccaacccgaaggaaggaaccaccacgaggcggaggttagtactcaccgtctcggttttgccggtccatggtcggtacgggaatatccacccgttcatccattcgactacgcctgtcggcctcgccttaggacccgactcacccggggacgacgaacgtggccccggaacccttggtcatccagcggacgggatcctcacccgtctctcgctactcatgtctgcattctcactcccacgaagtccacggcacggttacccggccgcttcgcccctcgcaggacgctctcctacccagcaaccatgaagattgctgccgcgtcttcggtggtgtgcttgagccccgctacattgtcggcgcggaaccactagaccagtgagctgttacgcactctttcaaggatggctgcttctgagccaacctcctggctgtctatgcgactccacatcctttcccacttagcacacgcttcgggaccttagacgacggtctgggctgtctccctctcgacgacggagcttatcccccgccgactcactgccggaatacacgtcaacggtattcggagttcggctgctgttggtacccaacaagggcccgcaagcatccggtagctctacccccgcgacgcaatcgaccgacgctgcacctaaatgcatttcggagagaaccagctatcacggaatttgattggcctttcacccctagccccaggtcatccccccggttttcaacccaggtgggttcggtcctccacgcggtcttacccgcgcttcaacctgcccagggctagatcatcccgcttcgggtccaggacaagcgactacaaacgccttttaagactcgctttcgctacgcatacgccacacggcttatgctcgccacccgccactgactcgcagactcatttttcgataggcacgccgtcaccccacgcagaggctccgacggtttgtgggcgcacggtttcaggaactgtttcactcccctcccggggtgcttttcacctttccctcacggtactggtacgctatcggtcagacaggtatgcttagacttacccaacggtctgggctgattcacgcgggattccacgaggcccgcgctacttgggacaacacgatcggaagacggctcacgtccaggtacggggctggcaccctctacggccaggccttcaagcctgttcccctggcaagccgttttatgactcccgcccggcccgtcggaaccgggacacgtgatcccacaacaccggcaacgcaacccccgacgggtatcacgcgcaaccggtttggtctgatccgctttcgctcgccactactcacggagtatcccttcctgcaggtactgagatgtttcacttccctgcgtaccccccgcccataggcggtgccggcccatgacggccggcgggttcccccattcggagaccctaggatcaaagccatgttggaggctcccctaggattatcgcatcctcaaacgtccttcatcggtactgtctgccaaggcatccaccatacgccctcgcaagcggcacaacagcaaaacaaattgtcattgccccacccgcgggtttcctgatagcaagatcgccagacgacaaatcttaacactaaaatgatcacaaaacgatcgatctcgaaaccaaactcaattgaagagtttggcgaaatcgcgataagcaaaaagaaacgttctttcagtttctcttgctcgcgtccactatccagttctcaaaccaccacgcgccacacgtttccaacccgccccgaagggaacaggcctactccatgtgggcatcgaaccgcaccacgatagaacaccgtggggtggcggtccgggagcccaaaagcatacccataccactcccggacatcccgacgggacatccaagcccatgatctcttccacaccagcatccccatgcgagaccgtggaaccattccacgagcacggggctcacaccggacacggaaccgtgtcctgaaattctccgtagaaaggaggtgatccagccgcaccttccggtacggctaccttgttacgacttagtcccaatcacgagtctcaccttagacggctccccccaaaaggttgggccaccggcttcgggtgctacccactttcatgacttgacgggcggtgtgtacaaggcccgggaacgcattcaccgcggcgttgctgatccgcgattactagcgactccgccttcatggagtcgggttgcagactccaatccgaactgagaccggttttaagggatccgctccccctcacgaggtcgcatcccgttgtaccggccattgtagcatgcgtgaagccctggacgtaaggggcatgatgatctgacgtcatccccaccttcctccgagttgaccccggcggtcccccgtgagttcccaccacgacgtgctggcaacacagggcgagggttgcgctcgttgcgggacttaacccaacatctcacgacacgagctgacgacgaccatgcaccacctgtgaacccgccccgaagggaggccccatctctggggctgtcgggaacatgtcaagcccaggtaaggttcttcgcgttgcatcgaattaatccgcatgctccgccgcttgtgcgggcccccgtcaatttctttgagttttagccttgcggccgtactccccaggcgggatgcttaacgcgttggctccgacacggagaccgtggaatggtccccacatccagcatccaccgtttacggcgtggactaccagggtatctaatcctgttcgctccccacgctttcgctcctcagcgtcagtgacggcccagagacctgccttcgccattggtgttcttcccgatatctacacattccaccgttacaccgggaattccagtctcccctaccgcactcaagcccgcccgtacccggcgcggatccaccgttaagcgatggactttcacaccggacgcgacgaaccgcctacgagccctttacgcccaataattccggataacgcttgcaccctacgtattaccgcggctgctggcacgtagttagccggtgcttattcgaaaggtacactcaccccgaagggcttgctcccagtcaaaagcggtttacaacccgaaggccgtcatcccgcacgcggcgtcgctgcatcaggcttgcgcccattgtgcaatattccccactgctgcctcccgtaggagtctgggccgtatctcagtcccaatgtggccggtcgccctctcaggccggctacccgtcgaagccatggtgggccgttaccccgccatcaagctgataggacgcgaccccatcccataccgatgaatctttcccagaaggacatgcatccaactggagcatccggcattaccacccgtttccaggagctattccggtgtatggggcaggtcggtcacgcattactcacccgttcgccactctcacccaggagcaagctcctgggatcccgttcgacttgcatgtgttaagcacgccgccagcgttcatcctgagccagaatcgaaccctccacaaaaaaaccttttcatgaagagacatcgacacgatgactctcgaaataagaaaattgacgatcgccttataaggaaaggcgcatcgcacaaaaaccatcgacaccgcgttgaccgcgtacgagcagcaggtcgaaccactcctcaaaaagtaaggaccaagtattatgaaatcgttaccatcggaagaaaatggaatttcggttattgttccttcgtttcagtccaatttggaacaactttgccgatgtctaaaaagtatttctaatcaaatagctgataatttaaatattgaatgctatgtcatttttgatggtgaaccgtttaaaaatattcaacatatattagatatatatccaaattttcattttatcactatcaagcatagtggagtttctattgctcgcaatgagggcattcaacattcacattgcaggtatctcactttcgtagacgtagatgatgaattgcctgatcatgcattaaaaaaaatgtatgattatgctgaacagaattcttgtgacattgttcaaggggcatatgaagcagttctttccactggcaaagagttgcattcctataaaaagcaaagacagctttatatacgtaatgatgagttgatggcttttagaaaagacgttcttcatcctgattctggaacgagtttggtgtggggaaaattatttcgcagatctcttattgttgaaggggatatcgaatttgattctgacatggaagtaagtgaagatacggcttttgtttttgatgcatgcagtaaggctcatgtgattggttttatccctgatattgtatatcgatattatagaagcacttcttctacagtatcttcattccggaaagactatgaaatacgtatccttaacgcaattcagcatatgtcggagcatgtcaattcgttttcttgcaaaaatgagtatgctgattcttttaatagctatgttttattccatctgcttcttgttcagcagcattttatatttaataaagctgctccgtggaatgaagcagaacgacgtcgaatttataataaaacaatccaccaaagcatttttaaaaatgcgcttaagttagttagttatagagattttcctttagttaagagaattgctcttttttctttaaagaaaaaaatgtataattttagtaaacttatttcatatatacgatatattcagttcataatataatttcatgttgatattctaagtcaaggtatattttatatggggaaatataaagaattactgttaaatacaggattatttgcaattagttcgatttcgtctaaattaattagtttcattctcgttcctttatatacatattacttgtccacctctgaatatggcgtaacggacatgtctgtgatagtcatctctcttatcacaccgttgtgtacaggatcgattactgatgcggttttgagatttgctattgatgataggaaacagtctgcaaaatatatctcaataggtttgcaagtcactatattcagtattctgatagttgggttattactccctctgcttgatttgccttttttgggtggacttggacagtataagcttttatttctgttaaattatatcgtaagtatcttacagctttttttgagtaatgtggcaagaattaataatcagcttaagttaatccctattagttcagttatctcatctttgagtaatatgttttttgcatatatatttattgttttagagaatctgagagttaatgggtatttttattcaatgatcctttctggtgttttaggtattattgcctttatttggaataagaacatgcatataccgataattttggataaaagtaatattcagctgttaaagcgtatgtttgtttttgctcttccactagtacccaatgcggtattctggtggattggaaccagtgtcaatcgttttttaattaccagtatgattggtatcgcctcttctggtctattcgcagctgcaagtaaaatacctaacctaattacaatggtctatcaaatatttcaacaggcgtggaatctttccgtgttccaagaatttagacattcagggctagctagattttatgaaaatatattcaaaataattttatctattttgtctgtttctgcgtctgtgttgattgtttcctctaaacctatcgcggagctttttttacaaaaaaatttttattctagttggacattaatgcctttattgattgtagcggtttattttaattcgctaaattcttttctggggacaatctcgaccgcttgcatgaaaacaaagaatcttcttgtaactacattttttggtgctttgttaaatatttgtttcacttggattcttattccaatatgtggattatatggtgcatgtattggaatggtgatcagtaattttgcaattctggttttgagatttattatttcacttcgtttattaaaatttcatatcccatgggtgtctatggctatgttatttgctggattgtccttacaagctatactgaagatatattctggttttccctctttgttgattcagatttgtttgatattcgttatttgggttatttctatcagcatgattgctcccctggccaattatttaaatttcaatcgtcgaaaaggatagtatctaaatgatacaaaataaaattagctggtctgatttacctgtagactttctgttattgaaaacagaaaagaagattcttgatttaattaatcctaagccttggccgattcaatgctttggtaatttatatcaaagtctgaatgacaaattatctgttttctattcagactttttcaaaaccgagttatccaagtttactgcgtgtgctgagagtgctgaaccgtatcgggggagcaaggcggagacggctccaatttggatgctttggctgcaaggcccatcaaatgtgccagaagaattattgatttgtattaattcaatcagagcgcattcttgcggtcatcctgttaacctgcttagtctttctgatgcgaaagaattagttgacatacctagctatttaatttccttatatgaaagtggccaattgcgccctgctttactatgtgattatattcgtgctgctttgctggaacggtacggtggaatatggttagatacttccgttttattaattcacgatcttccctcttggattcttaatgttccattctggtcagttaaaggtcttgattattttcctttttcacctgtagtgccagatggaagacgatggcaaatctatgcaatggctggacagccgcatgctttgttctataaagcgttttgcgaactattccttgaatatgtccaaagaattgatacatccatcgattattttatgtcgtaccagatatcttatttattgagagaaaatgtgcctgcgattgcggcatcatatgaacgtgtgcccaataacaacagtaaatgtgaatctttgcaagcatatttgcaaggatatcagcccgttcgttctcgaggtatacagtcagtctttaacgatgatactttcctttacaaattatctcgatacgatgctggactgattcagaatgcggcaggaataatcgacgatctcaaaaaaacgaaggatttaatattatgaaacatgcgtatttgattattgctcatgataaaccagatgagcttatgcgattactctccgcgttggattatagtgaaaacgacatttatgttcacttggatcgtaagtcaacctgcttttctattgaaatacttaaagaacaggtatgcaaaagtgacctgtattttgtgccaaggattgatgtaacttggggcggacaatcgcagatacaggcggaacttagccttttttctgaggcctttgcgcatggcggttataggtattatcatctcctttctggtattgattatccagttaagtcgcaagaatacattcataattattttaataggacagatggtacaaattatatctcgttaaaagatatcgatgatgaatccaaacgattcaaaatgcgttttgaacaatatcatttattccatgaacgatttgtagggaagaagcgtaatatttggaaatatgtagattttgcatgctgttatttacagaaaataatcggcatacgacgttttaaaggccaatctatgaaacgtcatagcaattgggttagtgttaccgacaaggttgtccagacgatagtaagaaacaaagatcgtatccttaaagaatatcgctggacttattgttgtgatgaagtttttttattgtcggaaatttgggatacacctttgcggaaaacgctatcttcaaaaggaaatttgaggtatatggagtgggtgcatatttcgggaagagattactcgccacggcttattaccgaaaaggatattgatattcttgctgatccgaatattttatttgcaagaaagtttactcttccacaatcaaaaaagatttatgactatctagataaaaatattctttaaaaaatgttttgcacaaattgtgtatggaatgagaggtgtcgttaatccgttgattaacgacacctctcatcgtggcagaaattattttttaattattttgttgtggccacgcagttcggtgtgatgtcagtgatggcctggccgccggagacggccgcggactcgcccttcacgtcatacagcttcccgccgttgtcatcggtcacggagccatacgagaacgacaggccggtcttcacggagcccgcagaaggcaccgaggccttccaccagccgccgcacgccttcgtcatctccataccgccggtcgagtccggggtcccatacacgcgccactgcagacgcacgcgcgactgaacggacgacggcttgtaccacaccgtcaacggctccgcgctacggaacgcccacctctgcgaggtggagccgttcgacgaccacaccgcgaacgtgcaggtgtggtcgtcgaacggctccacctcgcagaggtgggcgttccgtagcgcggagtttatggtcaaataaacccatacagcgtcaccaccaaatctgagcacctttatttgatcacataatgacagggttgtgaacctgtacatcagatacgtgcacagccctttatcaatagggaatctggggtggattaagtatatagtgtttggagttgggtttgaacttgaaaatggtgaggaacaattcatatggtgcatgattatgaacatccttggaataatccgagtgactcaggctctgtctgcattgctgttgctgttcataagccttaccgcatgcctaaagattctatgtacttgcctttgcaagttggtaaggcacttcatcctgaaatcgatttgggttttcagacggatgatactggagataacatctctttgctgaatgcgagttattctgaactaactgcattgtattggctgtggaaaaatagtgatgctagatacaagggtcttgcacactatcgtcgtcattttgcctcacattatatgcatttcaatttaggtgatagatttaatcgaatcgtaaagcacgaagagattaaccagctcttggagtcgaccgacatcattcttcctgaaaaaaggcaatattatatcgaaacgatgtattcgcattacgcgcacacattttttggtgaacatcttgatgagacacgttgcattatcgaagatttttccccggattatttgcctgcgtttaatgaggtaatgcacagccgtggtggacatatgtttaatatgttcattatggaacagcgtaaatttgatgagtattgcgcttggttgtttcctatcattgatgagttgaccaatcgcgttgattcatcacaatatgacgcgtttaatgcccgttatcctggcagggttagtgaaattcttttagatgtttggataaagacgaaggggtactcatatactgaattaccgattgtaagtactgagcctgtgaattggtggaagaagggaactggattcctgatggcgaagtttgacagtaaaaaatacacgaagagtttctagaggcgagctatgtcagttcaattaaacacggctgctggttcagtgaagagaactggtaactcagaaactcgtattaagtggattgacatcgctaagggcataggtattatgctggtcagtttcagttttggacatttgcgcaatggtgatggtcaaagtgttgtgttcggattatttcatttgaatgtaattgattttggttttgtcatccaattttacgcaggtcgagtgacagcgttgatgcttattcttctttgttatgtcttggtctatcgtgaagagtcatacatgttcccgaaaagaagttggaattatctgaaagtaatataatgactgtatactattttactttttttcttacttttgttttgtgctttatgtacgactatattgttagttttcgtcgtgtagagagaactaaagaattattttctaaagcattattttttatcagaaaaatacttttatttgcgtgccctgtaccgttaatccttattacaatttttagatacggaatcggatttgattattttcatacgtatgtaagtgattataaaatatatcagcagggaggaaggattcattctgatttcggctgtgcatttttgtataaaatatcacaggctatatcaaataatccgcaagtattttttataattacaggttttttaactcttgcatgttattatgctgcagctcagagattttctaaagtagcatgcctccccttcttgatttttattttggatggctccttctttcgttcgttgtcaatggtgtcgcaatactttggaattgcctttctattgctttcttttgcattactaaataccggtaaagtaaaaagaactaatgccattattgcttttattctgatttttcttgcagtatcagttcactcatctggaataatagtaggactagttcttatcgttttattctttttaaaagataaattgtctattaggtttttaataaaaatctcatgcttccttcctatatgtgtttttttattaaaatctgtaattgttagtatattgcttccgataattgagaaaacaagattctcgtcgtatattaattcagtttttgatggtcgctctgctagatcgattcttttaattgaattattcttttttataatgtacctcattcttattctgaaatataaaaataacgtaggcaagtatgaggcttttggaatattgtttgaatctcttgccgtaagttgtgctctattgcagaacgctttgccgctcatggatcggatggcttattattttgcagcgtttcatattttgacttttccgaggatggttagtttgatcaaatccccgatccttaaatgtttaagtgttgtgagcgtgtgctgttttttggctacctggttatatctgtatccgatttctggtaattacgataatttccaaccttatatgtctatttttggaaataccataattgaatattagaggtgttgaaatgcattttattgaattatgtaaaaggttctttctccatataaccgttttttcattctattatgcttttcttgaattgcttattgtattagatagacctatttctttaaaattacataagcctttttcgcataaattattaaggcttaaagagagatacattatttcttggctcaaaaaaaattttggtgatgttatcgccaaatatgaaaatatcgaagaaacagtcattaagccaaataaaataaatgaacttccaatttggatttgttggctgcaaggttataatttggcccctaattttgtaaaaaaaatgattaagaatgtcaaaaaaaaatcaaacggacatcctgttttcttgattgatgtagataactacatgcaatattgttctttgccagctaatatagtacgaaaatataaagcaggtttgatgccgcaacaacaatttgcagatattcttagagctggtttattgtctcaacgtggaggattatggatagatgcttcagtctttataactcgtcctattcctgatgacgttttcaatgttcctgtttataacattaaaaatataaaaccgaattattatagggatgcagtggcttgcgattctacaaagtgggaagcatattttattgcctcttggccgaaatccgttacatactcgtttattttcgaatgttttattcgttattgggaaaagtataatgttttaattgactattttcttttttcgtatcttgcaaaaataagtcgcgaagaaatagctgctggtataagtgagtattctttgattccagataataattttaattgtgaacagttgagtgactatttgatgactagtccatcttattctgaatctaaatatcgtgaaattataatgggtgacacttttgtgtataaactgacttggaaaggaaattattgtttaattcctaattccggggaaaaattacttgcagaaaaactatttgagttgtgaaggatttaattatgaaaaaagtattgttgataaatcagggacatactgctaatttaggggatattctcatatcgaaagttatgagtagttttttcttagaacaaggatttgaaattgagacactaccttacgatgatgttgtccaaaatagatttcgtctaccttttgacaagaagaatatacttccaagattaattgaacggattccttttgttatggattatgctaattttaagcgtatcaataatttagttaaagggaaaaaattcagttttgctgtaattggtggtggggaactgttggcttctcatcatggttttaattcggctcttcttatgtggtgtcgtcttcttgaaaaaaagaatattcctgtttatctttatggggtaagcggagatactgatatgtcttttttctacaaagcccgatataagcgtgcattaaaaacatgtaggtctatatccgtacgtgatcattcgacagaatcaattctgcgtgattattataaaattaaagcaacatattatcctgatgtagttttttcattctggcatttttttaagaaacctcagatagataagaagaatagagttatttgcattcctaaacaacttactgatagacagcttcgaactttaggtttacgcaatcatgttgatttctatgactatttaattaatctagtacaaaaaagtggtgcttctaatataattctcacttcgacagaggcggaagatagagatgctatattgggattttatcgatattgtgtaaacaatactcattataatatcaaacttatcttctctccttctgttgaagaattcataaatatgcttgctgcatcttcatgtgttatttcatgtcgtatgcatgcctgtattcttggccttttgaatgatactgacattcttcctgttccttttaaagaaaaacttgctgttttcgcaaaggaatattctgataagagatatgctataaaggccatggaacagtcatatgtaggtttacttagcattattaaagattttaaggagcttcactaagctttcagtatctgcgataggcatcgatttgtttggaaggttgttttgttatgactgatgcggtggagtatcccgatctggtggtggtgaaccgcccctctcaatttcaaccagttcccccagcttacgctgttcccaagcgggggtgcggtattcttgtgaaagatgtgcagtcgctcgtggagccgcgcattttgccggcaccgcaatgaggagggatagatgaacaagcagcagctcgcttcgaaaatctgggagtccgccaataagatgcgttccaagattgaggcgaacgaatacaaggattacattcttggtttcatcttctacaagttcctttcagagaccgagctgatgcgcttgaaagccagcgatttcaccgatgatcagctgccgcagcttacggaggataatccggacattgtggaattcgtgcagggtgagtgtggctacttcattgcctatgacaatctgttctccacatggatcaaaaaaggtaatgattttgagatttccaacgttcgtgatgctctttcggcgttctcccgcaatatcaatccggcgcacaagaaagtgttcgacggtattttcgacaccctgcagaccggactttccaagcttggcaccgatgcgaggagccagtccaaggccgcacgagacctgatttatctcattaaggacattccgatggatagccgtcaggattatgacgtgctcggattcatttacgaatatctcatcagcaattttgccgccaatgcgggcaagaaggccggtgaattctacacaccgtccgaggtctcccagctgatgagcgaaatcgtcgcatggcatttgcaggggcgcgagcagatcaagatctacgatccaacatccggttccggctctttgctgattcatattggccagtctgtggctcggcgcaatggcaatccggattccatcatgtattacgcgcaggaactcaaggagaacacctacaacctgacgcgtatgaatctggtgatgcgcggtattcttcccgacaacatcgtcgcccgcaacggcgacaccttggaagacgactggccgtggttcgacacgttggagaacaaggaggaaacatacaatccgttgttcgtggatgcggtggtttccaaccctccctactcgcagaattgggatcccactgacaaggagatcgatccacgcttcagctatggcatagcaccgaagtccaaggcggattatgcgttcctgctccatgacttgtaccatctgcgtgccgatggcatcatgaccatcgttctgccgcacggtgtgctgttccgcggtggcgaggaaggccagattcgtaagaatctgattgaaaaccaccatattcaggcgattatcggccttccggcgaatattttcttcggtacgggcatccccaccatcgtgatggtgctgcgcaagaaacgcgatgacgacagggtgctcattgttgatgcgtcgaaacatttcatcaaggacggcaagaacaacaagctacaggcttctgacatcaaacgcattgtcgacgtggtgtcgaacaaccgtacagtgcccaaattcagccgtttggtgtccattgacgagattcgcgccaatgattacaacctcaacattccccggtatgtcgattcatctgagaatgcggagacgtgggatgtgtacgcttcgatgttcggtggcgttccgaagagcgaggtcgagcagcttggggaatattggaatgcctggccgagtctgaaggctgagctgttccgcgataatggtgcctgctatgcctgcgatcacgatgatatcgccactgtggtgcgcaataatgccgacgtacaggcgttcattgcctcgtatggacaagccatttccgacctgcctgctgacttgcgctcccgtttggtggagcatcctgaacaggtggatgcgctcgggcaggaaacggccattggcaaggaattggatgcgatgattgccgataccgcgctgatcgacccgtatgacgcctatcagaagcttgatgatgcatggaacggtatctccattgatttggaagtgctgggttccgaaggtttcgatgcggtaagagccgtggatccgaacatggtcatcaagaaaaaaggcggcaaggatgtggaagtgcaggatggctggattggccgcgttctgcccttcgacttggttcagcgtgagctgctgcacgatgatttggccgcgatcgaggcggacgaacgccgtgtacaggacattgattccgagattgaaaccattttggaaggtttcgatgaggatgacaagcagaatagtgatgcggttaatcaggacggtgatgccttcgttgctgccgagttgaagaaagcggttaaggcgatcggcaagaatccggcttctgattttgagcgcggcttggtgcaggcccaaaagctgttcgatgagtcaaagaaactgaagtccggtatcaaaaccaagcgaagcgcgttggaagagaagacctgcgatgcgatcaaggcgttgagtgatgacgaagccagaaggttgctggaagccaagtggattacaccattgcagaagcagctggaggcattgccgaatgctgtgatcgacgagttcatcggcaaagtgaacgcgttgaagaacaagtatgccaccacatatgccgatgtatgcggccaaatcgatgaagcggagaaggaattggctggaatgctgggcgatttgaccggcaatgctcgcgatatggcgggtctggaagagctcaaagcactgctcgggggtgaatgatatggccgaacagcatgaaaaagcgttggttccgcagattcgtttcactggtttcactgacccttgggaacagcgtaagctgggggaattagcatctaagcgaattgaaaagaatacacagcctaatcaggtaccattaataaaccacgtccaacttccggggcgcagttcatgctgagagaggggcaatgtttaaccgagttttccgatgatccgcttctcgttttcgctgagcggccatatggtcacgtcctccgcggccttcagctccgcggccttcagctccgcggccttcagctccgcggccttagcttcgctcaggagatagccgccgccgtagatggccttcttcacggccttctgcgagtcgagagccctcgtgaacgcaacatctgaagccttgacgcagaactcgacctgcttgccaatcttcccgagcctgctcacggtaagcagttcacgcggatacgcgtatttcggcggatgcctgcgttgctctttcctgacgcgcttcacggtctcgtcgatcgcgttggccaagtccggcgcggtgcggatcaggtcatcaccgaaactcgtcacgaacgacgtgttgacctgcgcgccgttcgcgtattcgatggtcgaatccgtgacgatcatgtgcgccccattgcgcgacgtgctggagaagatcgtgagatacggcgcgaacaggaagaacgggatatgacggtcacggtagaacgtgcatatcttcgatagaatcgagaaaggtggattgtccaccaccaccttgccgtccgaatagtcgaaccgctcgtaatcgccgcccggatagaacgggcgcaccaccttatcagggtctataccgtattcccggcaagcccagtcttttatcgcctcatacactgcgggggggggtgtagcagtcgtccgtggtcttcttcggtttgaatttctccacgaacgacccataatcgtcaatcgtctgctgtctgatgcccattttgaaagtcctaaaaataaggcccctcctccatgatggagaaggggcaaatgttaaaaaacgggtgtaaaaaattccacggacactacagtgccgcaaatttttccacacctgatgttgagtttccgtcgcgagtttgagtctcacgccagaaaaatcaatcacggcgcagcggattgtaggccactccgagaccgctggcgatgaagccggccacggtcgaaatgtagccgccgacagccgcatcaccaaaggtcatgaaaccaaggccaacgcaagaggcgaccaagccaagcacgtagaccacggtcctcacctgcttgctgaaaaccggcgtatacacgtccggcggctggttgtcctgaccatcctcacgctcgttggtcaggttgttgactgtagtttccaaagtcgtttgcgctgcatgctgagccattgaaacctccctagaatcgtccttggttgagcgccgactgcaaggcgcgtgcggtcgcagggccgaagctcgcatcctgagccaacccgtaatgcgcttggatggcgcgaatggtggccggtccgagcagaccatcaacaccacagcccaggcgacgctgcacggcacggatcagatcactgccgccagcgccgtagcggaccacgctcgaatcgatggcgggacgcgcgtaagtcctgccgtcaggcacctgctggccgctgatgatgccatccaccgcggtgcccatcacctgctgccaacggcggacagtggccggaccaacattgccgtcaaccgcgagagcgccggcggaagccgaagagacgccgccgtagcgcaaatagcagttccacggatagttgtagtagcccctgatatttgtctcgcgggcggtctgatcgcccgccctgccatacgcggtgccacgctccgagatgcttgcctgcgcgagcctgccgccacccagatagaccgcgacgtggtgcacgtcgttgagcaggatgtcgcccggctgcggactgccgttgacgggcagacgcctccacccacgcttggtcagattgtcggacaggttgccggtgtaggtggcgctgccggtgtcaaaacccgcctcgcgcaggcagtggattaccaggctggagcagtcgcagttgcccgacgaagcgttaaaattccaacggtccgcctgcgaatagcccaagttggccacggcgcaccagtagcgcatgcggttgatcaaagcgccgacgcttgccatgctcagtcctccaatccatctacggccttggccgcatcctcctcggacacgacctgaatgttctcgggcggcagactgtcgccctgcggtgtcatctctggtgtcatgacggtgttctcgtccatgacgcttcctccttccgccccgttttggggcatgaaaaaaggccatccgatcacgaatggccttatggttgaaaaatgctcagcgcttgtgcgcgccatgattgaacatgagaatgagcgcgagcagcagcaggtatatgccgcctgcgatggctagacgtgtcattgccggtcctccaaatatttttctgcggcagcgattatccagcattgcgcgtccaatttctcaagcttcgacagctcgtagctgacggcctcgctgtggtcggtatccttgtcgccgtaaatcaggctgatgatcgtgtttttgatcgtgtcacgacacaactcgtccatgcggttgtatttcgtcaagtcggtgtttcgtgtttagtcatgtatttttttcgggtttaggcagttgcatgcattttccttatttttccggttgcgcggaggtgttcctgccgaacatgagggcctcactgacgcggcggctctggccggtgaactcgaggagccgcccgtggtgcacgatgcggtcgatgatcgctgcggcgagtttgtcgtccgcgaagaccgtgccccatttactgaactcgatgttcgtggtgaatatgatgctccgtctttcgtagctgcccgcgatgatctggtagagcaggcgcgccccgtcgatgtcgaagggtacgtagccgaactcgtccagtatgatcaggtcggcacggccgatgtcccggagcatcgtctcgagcgtgccgtcgcgtttggccttgcccagctggaggacgagctcggcggtctgatggaaccgcacgcccagccccatgtcgatcgccttcatgcccagcccgatcgcgagatgtgtctttccgcgcccggtcttgccgtagaacaccagatcctgcgcgcgcgggatgaaaccgagccctaggagctcatcgagcatgtagccgtcggggagcctgacgttcgtgaagtcgtagccgtcgagacccttgacgacggggaaccgggcgcggcgcaggagcctgtcgtgcttcgcgcgttccctgttcgccagttccgtgtcgagcaggcggtggacggcgtcgacctggcggggcgtggcccagccggcgaattcgtcgatgctcgccttggagatgaacagcttgcgggccttctcgtagagcccttcgtccgtcttcgtgttcatcgcccgcctccctgcacgccgacgtccgcggtgaacgcgatgtcgtattcactcagatccggcctgtcatcgtcgtattcgatacccgccacgccctcggcgagcctggccgcgagcagtgtgacaccggcgcggtccgccccgccggtcgattcgaggatggaaagcatcgcctcgaccgcgttcgcccacccggattccctgtcaacgcgtttgagggtctgcagcgcctcgttgcgtgtctgtctgtcctgccgatccagccattcccgcaacgggtccggcaacgcgtcacgtacccggctgttgggccaggacgcgggcttgttgcacagcagcgccaactgcatggacgggtcctcgctgttcgtgctggcctggccgtacgcccgaggatgggtcgccaggtgcttgcccgacgagtcgaggacctcgacctcgagcgcgcggaggcccacgatcacctctctgcccgcgttcgcccggtccgcggaataacgatgccgtccctcgagcgtgaccacgccgtaccggtcggccttcatatgccgccacgtgaccacgtcgaaacgcttcccgggcaacggcagcagcgccgcacggtcctcggagaacaggccacgttcctccgtgtccttgcggtaatgcggtttcgtggccagctccaggcaccggtccggcagcccggcgttaaagttctccaggctccatacgctcggccggggcacgaacagcttgcgccgcaccatgccgaccttggactccaccgcgcccttctcatgaccggaatacgggttgcagaacgaacaatcgaacccgtaatgcgcctggaaggcctggaacaggtgcgtcaggcgcggctcgcgctccccgtaccccttatggcccacgccggcggcgttatcgaacacgatccgctccggcacaccgcccagccactcgaacaggttgcgcaacgccaggcacgtgcactcagcgttctcgcccggcatcaactgcaccagaccgacgttcgaatacgggaaatcaagcacgaaatgatgcatccgctgcaccacgccgcgcaacagcacgtcgacctcgccgaaatcggcctgcgcctcgcccggatgccataccaggtccatgaacgcctcatcacgctccgccgcgaactcacgcctgagccgcgccaccgcccgcgtcaccgtggacagggagacctccgcgccatgctcgtccctcaaccgctcccagatcctagtcgcggtatgccgctgcttgcgccagttcgcgcgatcctccgcgagccactgctcgatcacgggcagatacgggtcgatcaccgacgcgcgcggctttctcaccgacggcacggccgacagatcctccttcgcgaggtacttacgcaccgtcggctcgctgacatgtgttttccgcgcgatcgacgcgacggattccccgttccgccgcaaacgacggatagactgtacttggggcatgctgatcataatcctttccggtcctttctggcggagatacaagcaccatccagttaagaccattccgtggtcggcatgctctgcctaaacccgaaaaatcatcgtgactaaacccgcaacaactaattgaacacaaacaaattggtattgccctcgatcgtctggactcgctcatcacccttcatcagcgtaagctcgaattactgcggaatatcaagaaatccatgctcgacaagatgtttgtataggggtgttcatggcaacaatcacgttatttcacggttctccgtacgaatccgtgacccccgaatacggtttaggcaatgacaaacacgactacggccgtggtttctatctgaccgcgaatgtggaactggccaaggaatgggccgtgtgcaggccggatgaatccaacggctgggtccaccagtacgaactggacacgaatgggctgcgcatcctggattttcaggagcatagcgtgcttacttggctggctgagctgatgaagcatcgtgatgccgctgattccaagcgctatcgcgtgctggctacgaagttcatcgccgaatatggcattgacaccagcggctatgacatcatcaaaggctggcgtgcgaacgcctcgtatttttatatcgccaaagaattcgtccgagacaatgtggacgtcgatatcttggaggaactgctgtcgcttggaggtctgggcatccagtattgcgtcaagaccgcaaaggcgtacaggcaactgcgcgaagtcccggacggcctgctttccgtcagctacagcgaattcaacgacaaatacaatcagagggatgttgaggcacggcagaacatgcgcgacctcatcgattccgatgccaatacggtgaccaacgtgttcagcacgttgctctaggggtgatgacaatgcgggcatatccagaggtctaccgggatgatgtggtggaaactcaaggcaagctcttcgactacgtggcacagtcgtttccgggcaagagcacagaggatttcatcgccatgtatatgacgagcaaaacacgcaaaagcattgatgaggccaaagcctacgtcaacacgatggatgcgaaagagctgtggaagtatttcaccgagaccgagcactaccagttgaaggacggcagggcgctcgaagggttcatgcctgattggattggcgaattctacgcctactaccaatggttctacgccattcccagtgctgaagtgatcgccaaggtgccgctggacttcctgaagaaagcctatttcgggcttcatgatctcgatctggagcttgcggtgcggaaagtcggcgaagaatgacggacatcatctgcttccataatcccgatgaggagaacggatacctgagcaactggtatccatcgtgcttcgttgcggatgatgtcgagttttcctcaatggaacagtacatgatgtaccgcaaagcctgctgtttcaacgatgccgaaacagccgcgcggatgcttcgaaccagcgacgtggccgagatcaaacgccttggccgactggtggccggttatgacgaccacgtatggaatggcgttcgccaaatcgaagtctatgaaggattgcttgccaaattcagtcagaacgccgaactcggtgcgcaactcgtagcgaccggcaatgcgatattggcggaatgcgccgtcaaagaccgcatctggggcatcggcttgtcaatgcatgacccagccaggctcgatccagcccaatggcgcggtcagaacctgctcggatacgctctaatgctcacaagaaagaagctcaaccgcatacatgagcgataatgcggccgttttcccgtatcaatcgcccccccccgcttgggaacagcgtaagctgggggaattagcatctaagcgaattgaaaagaatactgaactgcgccccggaagttggacgtggtttattaatggtacctgattaggctgtgagggacatgttccggaattcctccggggtgtgtccctccagtcgtatctggcgtcgtctggtgttccagtggatgatgtacgcgtccagttcgttcttgaactcctcgtacgaggcgaactcgcggccggtgtagaactcgtccttgaggtggccgaacacctgctcggtggcggcgttgtcgatgcagttgcccttgcggctcatggactggcggatgcccagttccccgagcctgttccgccaccagtcgtgctggtattgccatcccatgtcgctgtggagtatgggatcggcgccttcgggcagcttctcctcgagcatggcgagcagccgttgctgctgggcgaggtcggggtgccggctgacatcccaggccacaatctccttggatcccatgtcgtatatgggcgcgaggtacgccttgccgcccgctgccctgaactcggtgacgtccgtgcccagcttcacccacggccggtcggccgcgaagtcgcgttccagcaggttcggcggcttcgcgcccgtatcgccttggtatgagctgtatctgcggtatgggttcgggcggcgtatggcgcacttcaatcccatgcggcgcataaccctgagcacgctcttatgactcacacgcacgccgaactcgtatacgaggcacatgcgcacctgccggtggccgcacccgttgggcgtgcgatggaagacctcggcgaccatcggctcgatatccggccgggtgaccggctcgggatgcgaaaggagatagtagtaggtgcttctcgccaatcccgcgattttcaacaggcaccggagcggatggccgagccccgccagcgtcgagacgatcaccgacttctcccggttgtcggcttcgacgccagcagggcgcgggctttttccagatacgcgaccctcgccttgagatacgcgttctcctcctcgaggagctgttcgcgcgtgggagccggtttcggtttggatttcgcgcccttcggcctgcccttgggcttcgggcgcagcgcctccggccctccgcgacgatagtcctggcaccactgtttcagacacgtccggctggcgatgccgtaacgttccatgacctccggcctgctcatcccacgttccagatggtcgagcacagcggcgagcttcgtctcgtaatcgtatttcctgttgccctcgcgttctcccatgagcgccgcctctccgccgattcggtatgacaacaaccattctctcgtggtttccttggacacgccaagccggcgggcgagcgacttggcgccgatcccatcgcgaatcaacccgacgacgattctcatatactcgacatcgtatgaacccctgcgtttccgtgacatagaaaaccgcacctccaaatcatcggacatgaattactccagtccaacaatcggggtgcggttcaactttttgaggagtggttcgacctgctgctcgtacgcggtcaacgcggtgtcgatcacgttgtgcatgtcgtaatacttgtacgtgcccaaacggccgccgaacacggtcctcggctcggccttcgcgagctcctcgtacctcgcgtacaacgccttgtcggcctccgtgttgatcggataatacggctcgtcgccacgctcggcgaaacggctgtactcctcccacaccacggtcctgtccgggttctgcgaagccctgcgctccgggttgaagttcttgaactcgatcgcgcgcgtgtacggcacgtccgggtcggagaagttcatcaccgggcagccgaaatggtcgccctcgtcgtaacgcacctccctgaagtccaccgtgcgccacttcagctcgccgagcgagtagtcgaagtagcggtccaccggacccgtgtacaccaccggcacgcccgccgcggccaaggccttcctgttgtacggctgggactcgtcgaagaagtcggtcctgagggtcacgtggatgcgcgggtcgtcgatcatgcgctccatccacgcggtgtagccgtccgtgggcaggccctcccacgtgtccctgaagtaccggttgtcgtagttaaagcgcaccggcaggcggttgatgatgcccgcgggcaggtccttcggatcggtctgccactgcttgcccgtgtagttcttgatgaacgcctcgtacagcgggcggccgatcagcgaaatgcccttgtcgttgaggttcttcgggtccgtgcccgccaattcgccggcctgctcgtcgaccagggccttcgcctcggccggcgtgtaacgcgcgtggaagaactggttgatggtcccgaggttgatcggcagggggatacacctcgccgtcgtgcgtggcgtacacgcggtgcacgtagtccgtgaagcttgtgaaacggttcacatagtcccagaccctcttgttggacgtgtggaacaggtgcgcgccgtacttgtggatctccgcgccggtctcctcgtccatgtagctgtacgcgttgcctccgatatggtcgcgcacgtctatgatctcgaccctcgcgcccagatgctccacagcctgctgggccacggtcaggccgaacaggcccgcgcccacgaccaccagatcgggatactccaccgcatcagtcataacaaaacaaccttccaaac
